United States Patent 9,587,003 (MODIFIED POLYNUCLEOTIDES FOR THE PRODUCTION OF ONCOLOGY-RELATED PROTEINS AND PEPTIDES) - sequence listing, part 8

SEQ ID NO: 11803 - DNA, 1788 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagctgaccctgcagagcgccaagagcagagtggccttcttcgaggagctgtag

SEQ ID NO: 11804 - DNA, 663 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgaggtgaagaagcagatcctggacgagaagatctactgcccccccgaggccagcgtgctgctggccagctacgccgtgcaggccaagaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagggccagagaggcagaagcgccgaggccggccccgccggcagcaccagaggcggcgccaagagccaggccgaggcccccggcgactgccaccaggcccacgtgcccgcccacgagcccaacagcagcaccgtggccagctag

SEQ ID NO: 11805 - DNA, 1524 bp, Artificial Sequence; identical to SEQ ID NO: 11802
  Description of Artificial Sequence: Synthetic coding sequence

SEQ ID NO: 11806 - DNA, 1773 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11807 - DNA, 1650 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11808 - DNA, 1647 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11809 - DNA, 1773 bp, Artificial Sequence; identical to SEQ ID NO: 11806
  Description of Artificial Sequence: Synthetic coding sequence

SEQ ID NO: 11810 - DNA, 1806 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatggagagacagagactggccagagagaagcagatgagagaggaggccgagagaaccagagacgagctggagagaagactgctgcagatgaaggaggaggccaccatggccaacgaggccctgatgagaagcgaggaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagggcatgttcctgttcttcttcatcctgttctgctggttcagcctgaagcccaaggccgaggacctgagcgccttcgagcccagcaacagcccctgcagagcccccagccccgagtggcccagcctgaagagcagcagcagatag

SEQ ID NO: 11811 - DNA, 1686 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagtacggcgactacgaccccagcgtgcacaagagaggcttcctggcccaggaggagctgctgcccaagagagtgatcaacctgtaccagatgacccccgagatgtgggaggagagaatcaccgcctggtacgccgagcacagaggcagagccagagacgaggccgagatggagtacctgaagatcgcccaggacctggagatgtacggcgtgaactacttcgccatcagaaacaagaagggcaccgagctgctgctgggcgtggacgccctgggcctgcacatctacgaccccgagaacagactgacccccaagatcagcttcccctggaacgagatcagaaacatcagctacagcgacaaggagttcaccatcaagcccctggacaagaagatcgacgtgttcaagttcaacagcagcaagctgagagtgaacaagctgatcctgcagctgtgcatcggcaaccacgacctgttcatgagaagaagaaaggccgacagcctggaggtgcagcagatgaaggcccaggccagagaggagaaggccagaaagcagatgaaggaggaggccaccatggccaacgaggccctgatgagaagcgaggagaccgccgacctgctggccgagaaggcccagatcaccgaggaggaggccaagctgctggcccagaaggccgccgaggccgagcaggagatgcagagaatcaaggccaccgccatcagaaccgaggaggagaagagactgatggagcagaaggtgctggaggccgaggtgctggccctgaagatggccgaggagagcgagagaagagccaaggaggccgaccagctgaagcaggacctgcaggaggccagagaggccgagagaagagccaagcagaagctgctggagatcgccaccaagcccacctacccccccatgaaccccatccccgcccccctgccccccgacatccccagcttcaacctgatcggcgacagcctgagcttcgacttcaaggacaccgacatgaagagactgagcatggagatcgagaaggagaaggtggagtacatggagaagagcaagcacctgcaggagcagctgaacgagctgaagaccgagatcgaggccctgaagctgaaggagagagagaccgccctggacatcctgcacaacgagaacagcgacagaggcggcagcagcaagcacaacaccatcaagaagccccaggcccagggcagaagacccatctgcatctag

SEQ ID NO: 11812 - DNA, 1773 bp, Artificial Sequence; identical to SEQ ID NO: 11806
  Description of Artificial Sequence: Synthetic coding sequence

SEQ ID NO: 11813 - DNA, 498 bp, Artificial Sequence
  Description of Artificial Sequence: Synthetic coding sequence
atggccggcgccatcgccagcagaatgagcttcagcagcctgaagagaaagcagcccaagaccttcaccgtgagaatcgtgaccatggacgccgagatggagttcaactgcgagatgaagtggaagggcaaggacctgttcgacctggtgtgcagaaccctgggcctgagagagacctggttcttcggcctgcagtacaccatcaaggacaccgtggcctggctgaagatggacaagaaggtgctggaccacgacgtgagcaaggaggagcccgtgaccttccacttcctggccaagttctaccccgagaacgccgaggaggagctggtgcaggagatcacccagcacctgttcttcctgcaggtgaagaagcagatcctggacgagaagatctactgcccccccgaggccagcgtgctgctggccagctacgccgtgcaggccaagctgaccctgcagagcgccaagagcagagtggccttcttcgaggagctgtag

SEQ ID NO: 11814 - DNA, 663 bp, Artificial Sequence; identical to SEQ ID NO: 11804
  Description of Artificial Sequence: Synthetic coding sequence

SEQ ID NO: 11815 - DNA, 2772 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcgagttccccacctacggcttcaactgcgagttcggctggggcagccacaagaccttctgccactgggagcacgacaaccacgtgcagctgaagtggagcgtgctgaccagcaagaccggccccatccaggaccacaccggcgacggcaacttcatctacagccaggccgacgagaaccagaagggcaaggtggccagactggtgagccccgtggtgtacagccagaacagcgcccactgcatgaccttctggtaccacatgagcggcagccacgtgggcaccctgagagtgaagctgagataccagaagcccgaggagtacgaccagctggtgtggatggccatcggccaccagggcgaccactggaaggagggcagagtgctgctgcacaagagcctgaagctgtaccaggtgatcttcgagggcgagatcggcaagggcaacctgggcggcatcgccgtggacgacatcagcatcaacaaccacatcagccaggaggactgcgccaagcccgccgacctggacaagaagaaccccgagatcaagatcgacgagaccggcagcacccccggctacgagggcgagggcgagggcgacaagaacatcagcagaaagcccggcaacgtgctgaagaccctggaccccatcctgatcaccatcatcgccatgagcgccctgggcgtgctgctgggcgccgtgtgcggcgtggtgctgtactgcgcctgctggcacaacggcatgagcgagagaaacctgagcgccctggagaactacaacttcgagctggtggacggcgtgaagctgaagaaggacaagctgaacacccagagcacctacagcgaggcctag

SEQ ID NO: 11816 - DNA, 420 bp, Artificial Sequence
  Description of Artificial Sequence: Synthetic coding sequence
atggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcggcagcagattcttcaagcaccaccacaagcagcagagcatgagaccccagaacctgcaccacaacagcatcctgctgctgtag

SEQ ID NO: 11817 - DNA, 1926 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggagggcaccatcaacaccgaccaggagtgcccctgcgccagagccctggccaaggacgccaagaagaagaagagatgggccgacagcacccactgcagatgcgtgagaagcatccacggcgagatgtggagcagcggcaagggcgtgtgcagcctggacgccaacctgtag

SEQ ID NO: 11818 - DNA, 567 bp, Artificial Sequence
  Description of Artificial Sequence: Synthetic coding sequence
atgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggacgccaagtacagactgagagtgagcgtggtgagaagcaagagcagcagcagcagcaccagcctggagcccagacccctgagcagcctgaagctgagcttcttcagctacaagatcaagatcacctag

SEQ ID NO: 11819 - DNA, 1830 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggagggcggcaccaccgtgctggccaccgagaagcccaccgtgatcgacagcaccatccagagcggcatcaagtag

SEQ ID NO: 11820 - DNA, 1935 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcggcatcaagtag

SEQ ID NO: 11821 - DNA, 2115 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcgccgagaccatcttcatccccctgctgtaccacttcagcagctgcctgagctgggaccagctgacccccgtgtgcgtgctggtgaccccccacggcagagagctgcccagaaacagaagctgcctggccagaaccagagccagcagcttcccccacgtgatctggatcgacgagctgttcctgatcgccaccaccatctgcaacaacaacctgagccacttcgagagccagagactgggcctgagctag

SEQ ID NO: 11822 - DNA, 261 bp, Artificial Sequence
  Description of Artificial Sequence: Synthetic coding sequence
atggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcgccagactggaggtgagcaccctgaacctgagcctgcacaaccccccccagcagaaggccctgatctag

SEQ ID NO: 11823 - DNA, 2772 bp, Artificial Sequence; identical to SEQ ID NO: 11815
  Description of Artificial Sequence: Synthetic coding sequence

SEQ ID NO: 11824 - DNA, 2208 bp, Artificial Sequence
  Description of Artificial Sequence: Synthetic coding sequence
atgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcggcaccaccgtgctggccaccgagaagcccaccgtgatcgacagcaccatccagagcgagttccccacctacggcttcaactgcgagttcggctggggcagccacaagaccttctgccactgggagcacgacaaccacgtgcagctgaagtggagcgtgctgaccagcaagaccggccccatccaggaccacaccggcgacggcaacttcatctacagccaggccgacgagaaccagaagggcaaggtggccagactggtgagccccgtggtgtacagccagaacagcgcccactgcatgaccttctggtaccacatgagcggcagccacgtgggcaccctgagagtgaagctgagataccagaagcccgaggagtacgaccagctggtgtggatggccatcggccaccagggcgaccactggaaggagggcagagtgctgctgcacaagagcctgaagctgtaccaggtgatcttcgagggcgagatcggcaagggcaacctgggcggcatcgccgtggacgacatcagcatcaacaaccacatcagccaggaggactgcgccaagcccgccgacctggacaagaagaaccccgagatcaagatcgacgagaccggcagcacccccggctacgagggcgagggcgagggcgacaagaacatcagcagaaagcccggcaacgtgctgaagaccctggaccccatcctgatcaccatcatcgccatgagcgccctgggcgtgctgctgggcgccgtgtgcggcgtggtgctgtactgcgcctgctggcacaacggcatgagcgagagaaacctgagcgccctggagaactacaacttcgagctggtggacggcgtgaagctgaagaaggacaagctgaacacccagagcacctacagcgaggcctag

SEQ ID NO: 11825 - DNA, 2721 bp, Artificial Sequence
  Description of Artificial Sequence: Synthetic coding sequence
atggagagaggcctgcccctgctgtgcgccgtgctggccctggtgctggcccccgccggcgccttcagaaacgacaagtgcggcgacaccatcaagatcgagagccccggctacctgaccagccccggctacccccacagctaccaccccagcgagaagtgcgagtggctgatccaggcccccgacccctaccagagaatcatgatcaacttcaacccccacttcgacctggaggacagagactgcaagtacgactacgtggaggtgttcgacggcgagaacgagaacggccacttcagaggcaagttctgcggcaagatcgcccccccccccgtggtgagcagcggccccttcctgttcatcaagttcgtgagcgactacgagacccacggcgccggcttcagcatcagatacgagatcttcaagagaggccccgagtgcagccagaactacaccacccccagcggcgtgatcaagagccccggcttccccgagaagtaccccaacagcctggagtgcacctacatcgtgttcgtgcccaagatgagcgagatcatcctggagttcgagagcttcgacctggagcccgacagcaacccccccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaagagcttcgagggcaacaacaactacgacacccccgagctgagaaccttccccgccctgagcaccagattcatcagaatctaccccgagagagccacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcgagttccccacctacggcttcaactgcgagttcggctggggcagccacaagaccttctgccactgggagcacgacaaccacgtgcagctgaagtggagcgtgctgaccagcaagaccggccccatccaggaccacaccggcgacggcaacttcatctacagccaggccgacgagaaccagaagggcaaggtggccagactggtgagccccgtggtgtacagccagaacagcgcccactgcatgaccttctggtaccacatgagcggcagccacgtgggcaccctgagagtgaagctgagataccagaagcccgaggagtacgaccagctggtgtggatggccatcggccaccagggcgaccactggaaggagggcagagtgctgctgcacaagagcctgaagctgtaccaggtgatcttcgagggcgagatcggcaagggcaacctgggcggcatcgccgtggacgacatcagcatcaacaaccacatcagccaggaggactgcgccagaagcacccccggctacgagggcgagggcgagggcgacaagaacatcagcagaaagcccggcaacgtgctgaagaccctggaccccatcctgatcaccatcatcgccatgagcgccctgggcgtgctgctgggcgccgtgtgcggcgtggtgctgtactgcgcctgctggcacaacggcatgagcgagagaaacctgagcgccctggagaactacaacttcgagctggtggacggcgtgaagctgaagaaggacaagctgaacacccagagcacctacagcgaggcctag

SEQ ID NO: 11826 - DNA, 318 bp, Artificial Sequence
  Description of Artificial Sequence: Synthetic coding sequence
aaccacatcagccaggaggactgcgccagaagcacccccggctacgagggcgagggcgagggcgacaagaacatcagcagaaagcccggcaacgtgctgaagaccctggaccccatcctgatcaccatcatcgccatgagcgccctgggcgtgctgctgggcgccgtgtgcggcgtggtgctgtactgcgcctgctggcacaacggcatgagcgagagaaacctgagcgccctggagaactacaacttcgagctggtggacggcgtgaagctgaagaaggacaagctgaacacccagagcacctacagcgaggcctag

SEQ ID NO: 11827 - DNA, 234 bp, Artificial Sequence
  Description of Artificial Sequence: Synthetic coding sequence
tgacccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcgccagactggaggtgagcaccctgaacctgagcctgcacaaccccccccagcagaaggccctgatctag

SEQ ID NO: 11828 - DNA, 303 bp, Artificial Sequence
  Description of Artificial Sequence: Synthetic coding sequence
tgaacccacggcggcctgggcctgagaatggagctgctgggctgcgaggtggaggcccccaccgccggccccaccacccccaacggcaacctggtggacgagtgcgacgacgaccaggccaactgccacagcggcaccggcgacgacttccagctgaccggcggcaccaccgtgctggccaccgagaagcccaccgtgatcgacagcaccatccagagcggcagcagattcttcaagcaccaccacaagcagcagagcatgagaccccagaacctgcaccacaacagcatcctgctgctgtag

SEQ ID NO: 11829 - DNA, 711 bp, Artificial Sequence
  Description of Artificial Sequence: Synthetic coding sequence
gtggacctgggcctgctgagattcgtgaccgccgtgggcacccagggcgccatcagcaaggagaccaagaagaagtactacgtgaagacctacaagatcgacgtgagcagcaacggcgaggactggatcaccatcaaggagggcaacaagcccgtgctgttccagggcaacaccaaccccaccgacgtggtggtggccgtgttccccaagcccctgatcaccagattcgtgagaatcaagcccgccacctgggagaccggcatcagcatgagattcgaggtgtacggctgcaagatcaccgactacccctgcagcggcatgctgggcatggtgagcggcctgatcagcgacagccagatcaccagcagcaaccagggcgacagaaactggatgcccgagaacatcagactggtgaccagcagaagcggctgggccctgccccccgccccccacagctacatcaacgagtggctgcagatcgacctgggcgaggagaagatcgtgagaggcatcatcatccagggcggcaagcacagagagaacaaggtgttcatgagaaagttcaagatcggctacagcaacaacggcagcgactggaagatgatcatggacgacagcaagagaaaggccaaggtgagagccggcgactgggaggaggtgatcccctacgtgctggacttcaaccagggccccctggccttcagcagatag

SEQ ID NO: 11830 - DNA, 513 bp, Artificial Sequence
  Description of Artificial Sequence: Synthetic coding sequence
tgacccggcggcatgttctgcagatacgacagactggagatctgggacggcttccccgacgtgggcccccacatcggcagatactgcggccagaagacccccggcagaatcagaagcagcagcggcatcctgagcatggtgttctacaccgacagcgccatcgccaaggagggcttcagcgccaactacagcgtgctgcagagcagcgtgagcgaggacttcaagtgcatggaggccctgggcatggagagcggcgagatccacagcgaccagatcaccgccagcagccagtacagcaccaactggagcgccgagagaagcagactgaactaccccgagaacggctggacccccggcgaggacagctacagagagtggatccaggacgccaagtacagactgagagtgagcgtggtgagaagcaagagcagcagcagcagcaccagcctggagcccagacccctgagcagcctgaagctgagcttcttcagctacaagatcaagatcacctag

SEQ ID NO: 11831 - DNA, 2721 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggagcccatcagcgccttcgccggcgagaacttcaagggcggcaccctgctgcccggcaccgagcccaccgtggacaccgtgcccatgcagcccatccccgcctactggtactacgtgatggccgccggcggcgccgtgctggtgctggtgagcgtggccctggccctggtgctgcactaccacagattcagatacgccgccaagaagaccgaccacagcatcacctacaagaccagccactacaccaacggcgcccccctggccgtggagcccaccctgaccatcaagctggagcaggacagaggcagccactgctag

SEQ ID NO: 11832 - DNA, 300 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaacctgctgagcgcctggaagatcagcctgaccagcagaagcttcgcctag

SEQ ID NO: 11833 - DNA, 1668 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaaggtgggctgcagctggagacccctgtag

SEQ ID NO: 11834 - DNA, 2706 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggagcccatcagcgccttcgccggcggcaccctgctgcccggcaccgagcccaccgtggacaccgtgcccatgcagcccatccccgcctactggtactacgtgatggccgccggcggcgccgtgctggtgctggtgagcgtggccctggccctggtgctgcactaccacagattcagatacgccgccaagaagaccgaccacagcatcacctacaagaccagccactacaccaacggcgcccccctggccgtggagcccaccctgaccatcaagctggagcaggacagaggcagccactgctag

SEQ ID NO: 11835 - DNA, 2781 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggagcccatcagcgccttcgccgtggacatccccgagatccacgagagagagggctacgaggacgagatcgacgacgagtacgaggtggactggagcaacagcagcagcgccaccagcggcagcggcgcccccagcaccgacaaggagaagagctggctgtacaccctggaccccatcctgatcaccatcatcgccatgagcagcctgggcgtgctgctgggcgccacctgcgccggcctgctgctgtactgcacctgcagctacagcggcctgagcagcagaagctgcaccaccctggagaactacaacttcgagctgtacgacggcctgaagcacaaggtgaagatgaaccaccagaagtgctgcagcgaggcctag

SEQ ID NO: 11836 - DNA, 2796 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggagcccatcagcgccttcgccggcgagaacttcaaggtggacatccccgagatccacgagagagagggctacgaggacgagatcgacgacgagtacgaggtggactggagcaacagcagcagcgccaccagcggcagcggcgcccccagcaccgacaaggagaagagctggctgtacaccctggaccccatcctgatcaccatcatcgccatgagcagcctgggcgtgctgctgggcgccacctgcgccggcctgctgctgtactgcacctgcagctacagcggcctgagcagcagaagctgcaccaccctggagaactacaacttcgagctgtacgacggcctgaagcacaaggtgaagatgaaccaccagaagtgctgcagcgaggcctag

SEQ ID NO: 11837 - DNA, 2730 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggagcccatcagcgccttcgccgacgagtacgaggtggactggagcaacagcagcagcgccaccagcggcagcggcgcccccagcaccgacaaggagaagagctggctgtacaccctggaccccatcctgatcaccatcatcgccatgagcagcctgggcgtgctgctgggcgccacctgcgccggcctgctgctgtactgcacctgcagctacagcggcctgagcagcagaagctgcaccaccctggagaactacaacttcgagctgtacgacggcctgaagcacaaggtgaagatgaaccaccagaagtgctgcagcgaggcctag

SEQ ID NO: 11838 - DNA, 1668 bp, Artificial Sequence; identical to SEQ ID NO: 11833
  Description of Artificial Sequence: Synthetic coding sequence

SEQ ID NO: 11839 - DNA, 309 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggctag

SEQ ID NO: 11840 - DNA, 2781 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatggccaccgtgagcgccagcatcgtggacatccccgagatccacgagagagagggctacgaggacgagatcgacgacgagtacgaggtggactggagcaacagcagcagcgccaccagcggcagcggcgcccccagcaccgacaaggagaagagctggctgtacaccctggaccccatcctgatcaccatcatcgccatgagcagcctgggcgtgctgctgggcgccacctgcgccggcctgctgctgtactgcacctgcagctacagcggcctgagcagcagaagctgcaccaccctggagaactacaacttcgagctgtacgacggcctgaagcacaaggtgaagatgaaccaccagaagtgctgcagcgaggcctag

SEQ ID NO: 11841 - DNA, 2730 bp, Artificial Sequence
  Description of Artificial Sequence: Synthetic coding sequence
atggacatgttccccctgacctgggtgttcctggccctgtacttcagcagacaccaggtgagaggccagcccgaccccccctgcggcggcagactgaacagcaaggacgccggctacatcaccagccccggctacccccaggactaccccagccaccagaactgcgagtggatcgtgtacgcccccgagcccaaccagaagatcgtgctgaacttcaacccccacttcgagatcgagaagcacgactgcaagtacgacttcatcgagatcagagacggcgacagcgagagcgccgacctgctgggcaagcactgcggcaacatcgccccccccaccatcatcagcagcggcagcatgctgtacatcagattcaccagcgactacgccagacagggcgccggcttcagcctgagatacgagatcttcaagaccggcagcgaggactgcagcaagaacttcaccagccccaacggcaccatcgagagccccggcttccccgagaagtacccccacaacctggactgcaccttcaccatcctggccaagcccaagatggagatcatcctgcagttcctgatcttcgacctggagcacgaccccctgcaggtgggcgagggcgactgcaagtacgactggctggacatctgggacggcatcccccacgtgggccccctgatcggcaagtactgcggcaccaagacccccagcgagctgagaagcagcaccggcatcctgagcctgaccttccacaccgacatggccgtggccaaggacggcttcagcgccagatactacctggtgcaccaggagcccctggagaacttccagtgcaacgtgcccctgggcatggagagcggcagaatcgccaacgagcagatcagcgccagcagcacctacagcgacggcagatggaccccccagcagagcagactgcacggcgacgacaacggctggacccccaacctggacagcaacaaggagtacctgcaggtggacctgagattcctgaccatgctgaccgccatcgccacccagggcgccatcagcagagagacccagaacggctactacgtgaagagctacaagctggaggtgagcaccaacggcgaggactggatggtgtacagacacggcaagaaccacaaggtgttccaggccaacaacgacgccaccgaggtggtgctgaacaagctgcacgcccccctgctgaccagattcgtgagaatcagaccccagacctggcacagcggcatcgccctgagactggagctgttcggctgcagagtgaccgacgccccctgcagcaacatgctgggcatgctgagcggcctgatcgccgacagccagatcagcgccagcagcacccaggagtacctgtggagccccagcgccgccagactggtgagcagcagaagcggctggttccccagaatcccccaggcccagcccggcgaggagtggctgcaggtggacctgggcacccccaagaccgtgaagggcgtgatcatccagggcgccagaggcggcgacagcatcaccgccgtggaggccagagccttcgtgagaaagttcaaggtgagctacagcctgaacggcaaggactgggagtacatccaggaccccagaacccagcagcccaagctgttcgagggcaacatgcactacgacacccccgacatcagaagattcgaccccatccccgcccagtacgtgagagtgtaccccgagagatggagccccgccggcatcggcatgagactggaggtgctgggctgcgactggaccgacagcaagcccaccgtggagaccctgggccccaccgtgaagagcgaggagaccaccaccccctaccccaccgaggaggaggccaccgagtgcggcgagaactgcagcttcgaggacgacaaggacctgcagctgcccagcggcttcaactgcaacttcgacttcctggaggagccctgcggctggatgtacgaccacgccaagtggctgagaaccacctgggccagcagcagcagccccaacgacagaaccttccccgacgacagaaacttcctgagactgcagagcgacagccagagagagggccagtacgccagactgatcagcccccccgtgcacctgcccagaagccccgtgtgcatggagttccagtaccaggccaccggcggcagaggcgtggccctgcaggtggtgagagaggccagccaggagagcaagctgctgtgggtgatcagagaggaccagggcggcgagtggaagcacggcagaatcatcctgcccagctacgacatggagtaccagatcgtgttcgagggcgtgatcggcaagggcagaagcggcgagatcgccatcgacgacatcagaatcagcaccgacgtgcccctggagaactgcatgggccccaaggcctgcatcgccgacgagtacgaggtggactggagcaacagcagcagcgccaccagcggcagcggcgcccccagcaccgacaaggagaagagctggctgtacaccctggaccccatcctgatcaccatcatcgccatgagcagcctgggcgtgctgctgggcgccacctgcgccggcctgctgctgtactgcacctgcagctacagcggcctgagcagcagaagctgcaccaccctggagaactacaacttcgagctgtacgacggcctgaagcacaaggtgaagatgaaccaccagaagtgctgcagcgaggcctag

SEQ ID NO: 11842 - DNA, 462 bp, Artificial Sequence
  Description of Artificial Sequence: Synthetic coding sequence
atgaccaagatcaaggccgaccccgacggccccgaggcccaggccgaggcctgcagcggcgagagaacctaccaggagctgctggtgaaccagaaccccatcgcccagcccctggccagcagaagactgaccagaaagctgtacaagtgcatcaagaaggccgtgaagcagaagcagatcagaagaggcgtgaaggaggtgcagaagttcgtgaacaagggcgagaagggcatcatggtgctggccggcgacaccctgcccatcgaggtgtactgccacctgcccgtgatgtgcgaggacagaaacctgccctacgtgtacatccccagcaagaccgacctgggcgccgccgccggcagcaagagacccacctgcgtgatcatggtgaagccccacgaggagtaccaggaggcctacgacgagtgcctggaggaggtgcagagcctgcccctgcccctgtag

SEQ ID NO: 11843 - DNA, 273 bp, Artificial Sequence
  Description of Artificial Sequence: Synthetic coding sequence
atgaccaagatcaaggccgaccccgacggccccgaggcccaggccgaggcctgcagcggcgagagaacctaccaggagctgctggtgaaccagaaccccatcgcccagcccctggccagcagaagactgaccagaaagctgtacaagtgcatcaagaaggccgtgaagcagaagcagatcagaagaggcgtgaaggaggtgcagaagttcgtgaacaagggcgagaagggcacctgggtgcagccccaggcccccagcgccccccccgtgtag

SEQ ID NO: 11844 - DNA, 2265 bp, Artificial Sequence
  Description of Artificial Sequence: Synthetic coding sequence
atgtggaagctgctgcccgccgccggccccgccggcggcgagccctacagactgctgaccggcgtggagtacgtggtgggcagaaagaactgcgccatcctgatcgagaacgaccagagcatcagcagaaaccacgccgtgctgaccgccaacttcagcgtgaccaacctgagccagaccgacgagatccccgtgctgaccctgaaggacaacagcaagtacggcaccttcgtgaacgaggagaagatgcagaacggcttcagcagaaccctgaagagcggcgacggcatcaccttcggcgtgttcggcagcaagttcagaatcgagtacgagcccctggtggcctgcagcagctgcctggacgtgagcggcaagaccgccctgaaccaggccatcctgcagctgggcggcttcaccgtgaacaactggaccgaggagtgcacccacctggtgatggtgagcgtgaaggtgaccatcaagaccatctgcgccctgatctgcggcagacccatcgtgaagcccgagtacttcaccgagttcctgaaggccgtggagagcaagaagcagcccccccagatcgagagcttctacccccccctggacgagcccagcatcggcagcaagaacgtggacctgagcggcagacaggagagaaagcagatcttcaagggcaagaccttcatcttcctgaacgccaagcagcacaagaagctgagcagcgccgtggtgttcggcggcggcgaggccagactgatcaccgaggagaacgaggaggagcacaacttcttcctggcccccggcacctgcgtggtggacaccggcatcaccaacagccagaccctgatccccgactgccagaagaagtggatccagagcatcatggacatgctgcagagacagggcctgagacccatccccgaggccgagatcggcctggccgtgatcttcatgaccaccaagaactactgcgacccccagggccaccccagcaccggcctgaagaccaccacccccggccccagcctgagccagggcgtgagcgtggacgagaagctgatgcccagcgcccccgtgaacaccaccacctacgtggccgacaccgagagcgagcaggccgacacctgggacctgagcgagagacccaaggagatcaaggtgagcaagatggagcagaagttcagaatgctgagccaggacgcccccaccgtgaaggagagctgcaagaccagcagcaacaacaacagcatggtgagcaacaccctggccaagatgagaatccccaactaccagctgagccccaccaagctgcccagcatcaacaagagcaaggacagagccagccagcagcagcagaccaacagcatcagaaactacttccagcccagcaccaagaagagagagagagacgaggagaaccaggagatgagcagctgcaagagcgccagaatcgagaccagctgcagcctgctggagcagacccagcccgccacccccagcctgtggaagaacaaggagcagcacctgagcgagaacgagcccgtggacaccaacagcgacaacaacctgttcaccgacaccgacctgaagagcatcgtgaagaacagcgccagcaagagccacgccgccgagaagctgagaagcaacaagaagagagagatggacgacgtggccatcgaggacgaggtgctggagcagctgttcaaggacaccaagcccgagctggagatcgacgtgaaggtgcagaagcaggaggaggacgtgaacgtgagaaagagacccagaatggacatcgagaccaacgacaccttcagcgacgaggccgtgcccgagagcagcaagatcagccaggagaacgagatcggcaagaagagagagctgaaggaggacagcctgtggagcgccaaggagatcagcaacaacgacaagctgcaggacgacagcgagatgctgcccaagaagctgctgctgaccgagttcagaagcctggtgatcaagaacagcaccagcagaaaccccagcggcatcaacgacgactacggccagctgaagaacttcaagaagttcaagaaggtgacctaccccggcgccggcaagctgccccacatcatcggcggcagcgacctgatcgcccaccacgccagaaagaacaccgagctggaggagtggctgagacaggagatggaggtgcagaaccagcacgccaaggaggagagcctggccgacgacctgttcagatacaacccctacctgaagagaagaagatag

SEQ ID NO: 11845 - DNA, 1437 bp, Artificial Sequence
  Description of Artificial Sequence: Synthetic coding sequence
atgtggaagctgctgcccgccgccggccccgccggcggcgagccctacagactgctgaccggcgtggagtacgtggtgggcagaaagaactgcgccatcctgatcgagaacgaccagagcatcagcagaaaccacgccgtgctgaccgccaacttcagcgtgaccaacctgagccagaccgacgagatccccgtgctgaccctgaaggacaacagcaagtacggcaccttcgtgaacgaggagaagatgcagaacggcttcagcagaaccctgaagagcggcgacggcatcaccttcggcgtgttcggcagcaagttcagaatcgagtacgagcccctggtggcctgcagcagctgcctggacgtgagcggcaagaccgccctgaaccaggccatcctgcagctgggcggcttcaccgtgaacaactggaccgaggagtgcacccacctggtgatggtgagcgtgaaggtgaccatcaagaccatctgcgccctgatctgcggcagacccatcgtgaagcccgagtacttcaccgagttcctgaaggccgtggagagcaagaagcagcccccccagatcgagagcttctacccccccctggacgagcccagcatcggcagcaagaacgtggacctgagcggcagacaggagagaaagcagatcttcaagggcaagaccttcatcttcctgaacgccaagcagcacaagaagctgagcagcgccgtggtgttcggcggcggcgaggccagactgatcaccgaggagaacgaggaggagcacaacttcttcctggcccccggcacctgcgtggtggacaccggcatcaccaacagccagaccctgatccccgactgccagaagaagtggatccagagcatcatggacatgctgcagagacagggcctgagacccatccccgaggccgagatcggcctggccgtgatcttcatgaccaccaagaactactgcgacccccagggccaccccagcaccggcctgaagaccaccacccccggccccagcctgagccagggcgtgagcgtggacgagaagctgatgcccagcgcccccgtgaacaccaccacctacgtggccgacaccgagagcgagcaggccgacacctgggacctgagcgagagacccaaggagatcaaggtgagcaagatggagcagaagttcagaatgctgagccaggacgcccccaccgtgaaggagagctgcaagaccagcagcaacaacaacagcatggtgagcaacaccctggccaagatgagaatccccaactaccagctgagccccaccaagctgcccagcatcaacaagagcaaggacagagccagccagcagcagcagaccaacagcatcagaaactacttccagcccagcaccaagaagagagagagactgcacctgaagaagaagaagaagaagaagtag

SEQ ID NO: 11846 - DNA, 333 bp, Artificial Sequence
  Description of Artificial Sequence: Synthetic coding sequence
atgggcgccagcggcagcaaggccagaggcctgtggcccttcgccagcgccgccggcggcggcggcagcgaggccgccggcgccgagcaggccctggtgagacccagaggcagagccgtgccccccttcgtgttcaccagaagaggcagcatgttctacgacgaggacggcgacctggcccacgagttctacgaggagaccatcgtgaccaagaacggccagaagagagccaagctgagaagagtgcacaagaacctgatcccccagggcatcgtgaagctggaccaccccagaatccacgtggacttccccgtgatcctgtacgaggtgtag

SEQ ID NO: 11847 - DNA, 1206 bp, Artificial Sequence
  Description of Artificial Sequence: Synthetic coding sequence
atgtggagcggcggcagcggcaaggccagaggctgggaggccgccgccggcggcagaagcagccccggcagactgagcagaagaagaatcatgagcatgagccccaagcacaccacccccttcagcgtgagcgacatcctgagccccctggaggagagctacaagaaggtgggcatggagggcggcggcctgggcgcccccctggccgcctacagacagggccaggccgccccccccaccgccgccatgcagcagcacgccgtgggccaccacggcgccgtgaccgccgcctaccacatgaccgccgccggcgtgccccagctgagccacagcgccgtgggcggctactgcaacggcaacctgggcaacatgagcgagctgcccccctaccaggacaccatgagaaacagcgccagcggccccggctggtacggcgccaaccccgaccccagattccccgccatcagcagattcatgggccccgccagcggcatgaacatgagcggcatgggcggcctgggcagcctgggcgacgtgagcaagaacatggcccccctgcccagcgcccccagaagaaagagaagagtgctgttcagccaggcccaggtgtacgagctggagagaagattcaagcagcagaagtacctgagcgcccccgagagagagcacctggccagcatgatccacctgacccccacccaggtgaagatctggttccagaaccacagatacaagatgaagagacaggccaaggacaaggccgcccagcagcagctgcagcaggacagcggcggcggcggcggcggcggcggcaccggctgcccccagcagcagcaggcccagcagcagagccccagaagagtggccgtgcccgtgctggtgaaggacggcaagccctgccaggccggcgcccccgcccccggcgccgccagcctgcagggccacgcccagcagcaggcccagcaccaggcccaggccgcccaggccgccgccgccgccatcagcgtgggcagcggcggcgccggcctgggcgcccaccccggccaccagcccggcagcgccggccagagccccgacctggcccaccacgccgccagccccgccgccctgcagggccaggtgagcagcctgagccacctgaacagcagcggcagcgactacggcaccatgagctgcagcaccctgctgtacggcagaacctggtag

SEQ ID NO: 11848 - DNA, 1116 bp, Artificial Sequence
  Description of Artificial Sequence: Synthetic coding sequence
atgagcatgagccccaagcacaccacccccttcagcgtgagcgacatcctgagccccctggaggagagctacaagaaggtgggcatggagggcggcggcctgggcgcccccctggccgcctacagacagggccaggccgccccccccaccgccgccatgcagcagcacgccgtgggccaccacggcgccgtgaccgccgcctaccacatgaccgccgccggcgtgccccagctgagccacagcgccgtgggcggctactgcaacggcaacctgggcaacatgagcgagctgcccccctaccaggacaccatgagaaacagcgccagcggccccggctggtacggcgccaaccccgaccccagattccccgccatcagcagattcatgggccccgccagcggcatgaacatgagcggcatgggcggcctgggcagcctgggcgacgtgagcaagaacatggcccccctgcccagcgcccccagaagaaagagaagagtgctgttcagccaggcccaggtgtacgagctggagagaagattcaagcagcagaagtacctgagcgcccccgagagagagcacctggccagcatgatccacctgacccccacccaggtgaagatctggttccagaaccacagatacaagatgaagagacaggccaaggacaaggccgcccagcagcagctgcagcaggacagcggcggcggcggcggcggcggcggcaccggctgcccccagcagcagcaggcccagcagcagagccccagaagagtggccgtgcccgtgctggtgaaggacggcaagccctgccaggccggcgcccccgcccccggcgccgccagcctgcagggccacgcccagcagcaggcccagcaccaggcccaggccgcccaggccgccgccgccgccatcagcgtgggcagcggcggcgccggcctgggcgcccaccccggccaccagcccggcagcgccggccagagccccgacctggcccaccacgccgccagccccgccgccctgcagggccaggtgagcagcctgagccacctgaacagcagcggcagcgactacggcaccatgagctgcagcaccctgctgtacggcagaacctggtag

SEQ ID NO: 11849 - DNA, 1116 bp, Artificial Sequence; identical to SEQ ID NO: 11848
  Description of Artificial Sequence: Synthetic coding sequence

SEQ ID NO: 11850 - DNA, 1116 bp, Artificial Sequence; identical to SEQ ID NO: 11848
  Description of Artificial Sequence: Synthetic coding sequence

SEQ ID NO: 11851 - DNA, 105 bp, Artificial Sequence
  Description of Artificial Sequence: Synthetic coding sequence
atgtggagcggcggcagcggcaaggccagaggctgggaggccgccgccggcggcagaagcagccccggcagactgagcgcctacgccccccccctggtggcctag

SEQ ID NO: 11852 - DNA, 573 bp, Artificial Sequence
  Description of Artificial Sequence: Synthetic coding sequence
atgctgagagtgcccgagcccagacccggcgaggccaaggccgagggcgccgccccccccacccccagcaagcccctgaccagcttcctgatccaggacatcctgagagacggcgcccccgaggaggccgagaccctggccgagaccgagcccgagagacacctgggcagctacctgctggacagcgagaacaccagcggcgccctgcccagactgccccagacccccaagcagccccagaagagaagcagagccgccttcagccacacccaggtgatcgagctggagagaaagttcagccaccagaagtacctgagcgcccccgagagagcccacctggccaagaacctgaagctgaccgagacccaggtgaagatctggttccagaacagaagatacaagaccaagagaaagcagctgagcagcgagctgggcgacctggagaagcacagcagcctgcccgccctgaaggaggaggccttcagcagagccagcctggtgagcgtgtacaacagctacccctactacccctacctgtactgcgtgggcagctggagccccgccttctggtag

SEQ ID NO: 11853 - DNA, 705 bp, Artificial Sequence
  Description of Artificial Sequence: Synthetic coding sequence
atgctgagagtgcccgagcccagacccggcgaggccaaggccgagggcgccgccccccccacccccagcaagcccctgaccagcttcctgatccaggacatcctgagagacggcgcccagagacagggcggcagaaccagcagccagagacagagagaccccgagcccgagcccgagcccgagcccgagggcggcagaagcagagccggcgcccagaacgaccagctgagcaccggccccagagccgcccccgaggaggccgagaccctggccgagaccgagcccgagagacacctgggcagctacctgctggacagcgagaacaccagcggcgccctgcccagactgccccagacccccaagcagccccagaagagaagcagagccgccttcagccacacccaggtgatcgagctggagagaaagttcagccaccagaagtacctgagcgcccccgagagagcccacctggccaagaacctgaagctgaccgagacccaggtgaagatctggttccagaacagaagatacaagaccaagagaaagcagctgagcagcgagctgggcgacctggagaagcacagcagcctgcccgccctgaaggaggaggccttcagcagagccagcctggtgagcgtgtacaacagctacccctactacccctacctgtactgcgtgggcagctggagccccgccttctggtag

SEQ ID NO: 11854 - DNA, 480 bp, Artificial Sequence
  Description of Artificial Sequence: Synthetic coding sequence
atgctgagagtgcccgagcccagacccggcgaggccgagaccctggccgagaccgagcccgagagacacctgggcagctacctgctggacagcgagaacaccagcggcgccctgcccagactgccccagacccccaagcagccccagaagagaagcagagccgccttcagccacacccaggtgatcgagctggagagaaagttcagccaccagaagtacctgagcgcccccgagagagcccacctggccaagaacctgaagctgaccgagacccaggtgaagatctggttccagaacagaagatacaagaccaagagaaagcagctgagcagcgagctgggcgacctggagaagcacagcagcctgcccgccctgaaggaggaggccttcagcagagccagcctggtgagcgtgtacaacagctacccctactacccctacctgtactgcgtgggcagctggagccccgccttctggtag

SEQ ID NO: 11855 - DNA, 4212 bp, Artificial Sequence
  Description of Artificial Sequence: Synthetic coding sequence
atggccacccagcagaaggccagcgacgagagaatcagccagttcgaccacaacctgctgcccgagctgagcgccctgctgggcctggacgccgtgcagctggccaaggagctggaggaggaggagcagaaggagagagccaagatgcagaagggctacaacagccagatgagaagcgaggccaagagactgaagaccttcgtgacctacgagccctacagcagctggatcccccaggagatggccgccgccggcttctacttcaccggcgtgaagagcggcatccagtgcttctgctgcagcctgatcctgttcggcgccggcctgaccagactgcccatcgaggaccacaagagattccaccccgactgcggcttcctgctgaacaaggacgtgggcaacatcgccaagtacgacatcagagtgaagaacctgaagagcagactgagaggcggcaagatgagataccaggaggaggaggccagactggccagcttcagaaactggcccttctacgtgcagggcatcagcccctgcgtgctgagcgaggccggcttcgtgttcaccggcaagcaggacaccgtgcagtgcttcagctgcggcggctgcctgggcaactgggaggagggcgacgacccctggaaggagcacgccaagtggttccccaagtgcgagttcctgagaagcaagaagagcagcgaggagatcacccagtacatccagagctacaagggcttcgtggacatcaccggcgagcacttcgtgaacagctgggtgcagagagagctgcccatggccagcgcctactgcaacgacagcatcttcgcctacgaggagctgagactggacagcttcaaggactggcccagagagagcgccgtgggcgtggccgccctggccaaggccggcctgttctacaccggcatcaaggacatcgtgcagtgcttcagctgcggcggctgcctggagaagtggcaggagggcgacgaccccctggacgaccacaccagatgcttccccaactgccccttcctgcagaacatgaagagcagcgccgaggtgacccccgacctgcagagcagaggcgagctgtgcgagctgctggagaccaccagcgagagcaacctggaggacagcatcgccgtgggccccatcgtgcccgagatggcccagggcgaggcccagtggttccaggaggccaagaacctgaacgagcagctgagagccgcctacaccagcgccagcttcagacacatgagcctgctggacatcagcagcgacctggccaccgaccacctgctgggctgcgacctgagcatcgccagcaagcacatcagcaagcccgtgcaggagcccctggtgctgcccgaggtgttcggcaacctgaacagcgtgatgtgcgtggagggcgaggccggcagcggcaagaccgtgctgctgaagaagatcgccttcctgtgggccagcggctgctgccccctgctgaacagattccagctggtgttctacctgagcctgagcagcaccagacccgacgagggcctggccagcatcatctgcgaccagctgctggagaaggagggcagcgtgaccgagatgtgcgtgagaaacatcatccagcagctgaagaaccaggtgctgttcctgctggacgactacaaggagatctgcagcatcccccaggtgatcggcaagctgatccagaagaaccacctgagcagaacctgcctgctgatcgccgtgagaaccaacagagccagagacatcagaagatacctggagaccatcctggagatcaaggccttccccttctacaacaccgtgtgcatcctgagaaagctgttcagccacaacatgaccagactgagaaagttcatggtgtacttcggcaagaaccagagcctgcagaagatccagaagacccccctgttcgtggccgccatctgcgcccactggttccagtaccccttcgaccccagcttcgacgacgtggccgtgttcaagagctacatggagagactgagcctgagaaacaaggccaccgccgagatcctgaaggccaccgtgagcagctgcggcgagctggccctgaagggcttcttcagctgctgcttcgagttcaacgacgacgacctggccgaggccggcgtggacgaggacgaggacctgaccatgtgcctgatgagcaagttcaccgcccagagactgagacccttctacagattcctgagccccgccttccaggagttcctggccggcatgagactgatcgagctgctggacagcgacagacaggagcaccaggacctgggcctgtaccacctgaagcagatcaacagccccatgatgaccgtgagcgcctacaacaacttcctgaactacgtgagcagcctgcccagcaccaaggccggccccaagatcgtgagccacctgctgcacctggtggacaacaaggagagcctggagaacatcagcgagaacgacgactacctgaagcaccagcccgagatcagcctgcagatgcagctgctgagaggcctgtggcagatctgcccccaggcctacttcagcatggtgagcgagcacctgctggtgctggccctgaagaccgcctaccagagcaacaccgtggccgcctgcagccccttcgtgctgcagttcctgcagggcagaaccctgaccctgggcgccctgaacctgcagtacttcttcgaccaccccgagagcctgagcctgctgagaagcatccacttccccatcagaggcaacaagaccagccccagagcccacttcagcgtgctggagacctgcttcgacaagagccaggtgcccaccatcgaccaggactacgccagcgccttcgagcccatgaacgagtgggagagaaacctggccgagaaggaggacaacgtgaagagctacatggacatgcagagaagagccagccccgacctgagcaccggctactggaagctgagccccaagcagtacaagatcccctgcctggaggtggacgtgaacgacatcgacgtggtgggccaggacatgctggagatcctgatgaccgtgttcagcgccagccagagaatcgagctgcacctgaaccacagcagaggcttcatcgagagcatcagacccgccctggagctgagcaaggccagcgtgaccaagtgcagcatcagcaagctggagctgagcgccgccgagcaggagctgctgctgaccctgcccagcctggagagcctggaggtgagcggcaccatccagagccaggaccagatcttccccaacctggacaagttcctgtgcctgaaggagctgagcgtggacctggagggcaacatcaacgtgttcagcgtgatccccgaggagttccccaacttccaccacatggagaagctgctgatccagatcagcgccgagtacgaccccagcaagctggtgaagctgatccagaacagccccaacctgcacgtgttccacctgaagtgcaacttcttcagcgacttcggcagcctgatgaccatgctggtgagctgcaagaagctgaccgagatcaagttcagcgacagcttcttccaggccgtgcccttcgtggccagcctgcccaacttcatcagcctgaagatcctgaacctggagggccagcagttccccgacgaggagaccagcgagaagttcgcctacatcctgggcagcctgagcaacctggaggagctgatcctgcccaccggcgacggcatctacagagtggccaagctgatcatccagcagtgccagcagctgcactgcctgagagtgctgagcttcttcaagaccctgaacgacgacagcgtggtggagatcgccaaggtggccatcagcggcggcttccagaagctggagaacctgaagctgagcatcaaccacaagatcaccgaggagggctacagaaacttcttccaggccctggacaacatgcccaacctgcaggagctggacatcagcagacacttcaccgagtgcatcaaggcccaggccaccaccgtgaagagcctgagccagtgcgtgctgagactgcccagactgatcagactgaacatgctgagctggctgctggacgccgacgacatcgccctgctgaacgtgatgaaggagagacacccccagagcaagtacctgaccatcctgcagaagtggatcctgcccttcagccccatcatccagaagtag

SEQ ID NO: 11856 - DNA, 3726 bp, Artificial Sequence
  Description of Artificial Sequence: Synthetic coding sequence
atgcccctgcacatcggcgacttcgtgtgggacagcaaggtgcacagcctgcagagcagcctgaacatcttcagcctgctgcccaccaagggcagaaccgagcacctgttcttcagccacatcctgagcttccactggcccgccttcagcagcatcagactggagctgtggatcaacctgagatgcgagttcctgagaagcaagaagagcagcgaggagatcacccagtacatccagagctacaagggcttcgtggacatcaccggcgagcacttcgtgaacagctgggtgcagagagagctgcccatggccagcgcctactgcaacgacagcatcttcgcctacgaggagctgagactggacagcttcaaggactggcccagagagagcgccgtgggcgtggccgccctggccaaggccggcctgttctacaccggcatcaaggacatcgtgcagtgcttcagctgcggcggctgcctggagaagtggcaggagggcgacgaccccctggacgaccacaccagatgcttccccaactgccccttcctgcagaacatgaagagcagcgccgaggtgacccccgacctgcagagcagaggcgagctgtgcgagctgctggagaccaccagcgagagcaacctggaggacagcatcgccgtgggccccatcgtgcccgagatggcccagggcgaggcccagtggttccaggaggccaagaacctgaacgagcagctgagagccgcctacaccagcgccagcttcagacacatgagcctgctggacatcagcagcgacctggccaccgaccacctgctgggctgcgacctgagcatcgccagcaagcacatcagcaagcccgtgcaggagcccctggtgctgcccgaggtgttcggcaacctgaacagcgtgatgtgcgtggagggcgaggccggcagcggcaagaccgtgctgctgaagaagatcgccttcctgtgggccagcggctgctgccccctgctgaacagattccagctggtgttctacctgagcctgagcagcaccagacccgacgagggcctggccagcatcatctgcgaccagctgctggagaaggagggcagcgtgaccgagatgtgcgtgagaaacatcatccagcagctgaagaaccaggtgctgttcctgctggacgactacaaggagatctgcagcatcccccaggtgatcggcaagctgatccagaagaaccacctgagcagaacctgcctgctgatcgccgtgagaaccaacagagccagagacatcagaagatacctggagaccatcctggagatcaaggccttccccttctacaacaccgtgtgcatcctgagaaagctgttcagccacaacatgaccagactgagaaagttcatggtgtacttcggcaagaaccagagcctgcagaagatccagaagacccccctgttcgtggccgccatctgcgcccactggttccagtaccccttcgaccccagcttcgacgacgtggccgtgttcaagagctacatggagagactgagcctgagaaacaaggccaccgccgagatcctgaaggccaccgtgagcagctgcggcgagctggccctgaagggcttcttcagctgctgcttcgagttcaacgacgacgacctggccgaggccggcgtggacgaggacgaggacctgaccatgtgcctgatgagcaagttcaccgcccagagactgagacccttctacagattcctgagccccgccttccaggagttcctggccggcatgagactgatcgagctgctggacagcgacagacaggagcaccaggacctgggcctgtaccacctgaagcagatcaacagccccatgatgaccgtgagcgcctacaacaacttcctgaactacgtgagcagcctgcccagcaccaaggccggccccaagatcgtgagccacctgctgcacctggtggacaacaaggagagcctggagaacatcagcgagaacgacgactacctgaagcaccagcccgagatcagcctgcagatgcagctgctgagaggcctgtggcagatctgcccccaggcctacttcagcatggtgagcgagcacctgctggtgctggccctgaagaccgcctaccagagcaacaccgtggccgcctgcagccccttcgtgctgcagttcctgcagggcagaaccctgaccctgggcgccctgaacctgcagtacttcttcgaccaccccgagagcctgagcctgctgagaagcatccacttccccatcagaggcaacaagaccagccccagagcccacttcagcgtgctggagacctgcttcgacaagagccaggtgcccaccatcgaccaggactacgccagcgccttcgagcccatgaacgagtgggagagaaacctggccgagaaggaggacaacgtgaagagctacatggacatgcagagaagagccagccccgacctgagcaccggctactggaagctgagccccaagcagtacaagatcccctgcctggaggtggacgtgaacgacatcgacgtggtgggccaggacatgctggagatcctgatgaccgtgttcagcgccagccagagaatcgagctgcacctgaaccacagcagaggcttcatcgagagcatcagacccgccctggagctgagcaaggccagcgtgaccaagtgcagcatcagcaagctggagctgagcgccgccgagcaggagctgctgctgaccctgcccagcctggagagcctggaggtgagcggcaccatccagagccaggaccagatcttccccaacctggacaagttcctgtgcctgaaggagctgagcgtggacctggagggcaacatcaacgtgttcagcgtgatccccgaggagttccccaacttccaccacatggagaagctgctgatccagatcagcgccgagtacgaccccagcaagctggtgaagctgatccagaacagccccaacctgcacgtgttccacctgaagtgcaacttcttcagcgacttcggcagcctgatgaccatgctggtgagctgcaagaagctgaccgagatcaagttcagcgacagcttcttccaggccgtgcccttcgtggccagcctgcccaacttcatcagcctgaagatcctgaacctggagggccagcagttccccgacgaggagaccagcgagaagttcgcctacatcctgggcagcctgagcaacctggaggagctgatcctgcccaccggcgacggcatctacagagtggccaagctgatcatccagcagtgccagcagctgcactgcctgagagtgctgagcttcttcaagaccctgaacgacgacagcgtggtggagatcgccaaggtggccatcagcggcggcttccagaagctggagaacctgaagctgagcatcaaccacaagatcaccgaggagggctacagaaacttcttccaggccctggacaacatgcccaacctgcaggagctggacatcagcagacacttcaccgagtgcatcaaggcccaggccaccaccgtgaagagcctgagccagtgcgtgctgagactgcccagactgatcagactgaacatgctgagctggctgctggacgccgacgacatcgccctgctgaacgtgatgaaggagagacacccccagagcaagtacctgaccatcctgcagaagtggatcctgcccttcagccccatcatccagaagtag

SEQ ID NO: 11857 - DNA, 4212 bp, Artificial Sequence; identical to SEQ ID NO: 11855
  Description of Artificial Sequence: Synthetic coding sequence

SEQ ID NO: 11858 - DNA, 3726 bp, Artificial Sequence; identical to SEQ ID NO: 11856
  Description of Artificial Sequence: Synthetic coding sequence

SEQ ID NO: 11859 - DNA, 678 bp, Artificial Sequence
  Description of Artificial Sequence: Synthetic coding sequence
atgctgggcctggacgcctgcgagctgggcgcccagctgctggagctgctgagactggccctgtgcgccagagtgctgctggccgacaaggagggcggcccccccgccgtggacgaggtgctggacgaggccgtgcccgagtacagagcccccggcagaaagagcctgctggagatcagacagctggaccccgacgacagaagcctggccaagtacaagagagtgctgctgggccccctgccccccgccgtggaccccagcctgcccaacgtgcaggtgaccagactgaccctgctgagcgagcaggcccccggccccgtggtgatggacctgaccggcgacctggccgtgctgaaggaccaggtgttcgtgctgaaggagggcgtggactacagagtgaagatcagcttcaaggtgcacagagagatcgtgagcggcctgaagtgcctgcaccacacctacagaagaggcctgagagtggacaagaccgtgtacatggtgggcagctacggccccagcgcccaggagtacgagttcgtgacccccgtggaggaggcccccagaggcgccctggtgagaggcccctacctggtggtgagcctgttcaccgacgacgacagaacccaccacctgagctgggagtggggcctgtgcatctgccaggactggaaggactag

SEQ ID NO: 11860 - DNA, 882 bp, Artificial Sequence
  Description of Artificial Sequence: Synthetic coding sequence
atgcccgccagaagcggcgcccagttctgcagaagaatgggccagaagaagcagagacccgccagagccggccagccccacagcagcagcgacgccgcccaggcccccgccgagcagccccacagcagcagcgacgccgcccaggccccctgccccagagagagatgcctgggcccccccaccacccccggcccctacagaagcatctacttcagcagccccaagggccacctgaccagactgggcctggagttcttcgaccagcccgccgtgcccctggccagagccttcctgggccaggtgctggtgagaagactgcccaacggcaccgagctgagaggcagaatcgtggagaccgaggcctacctgggccccgaggacgaggccgcccacagcagaggcggcagacagacccccagaaacagaggcatgttcatgaagcccggcaccctgtacgtgtacatcatctacggcatgtacttctgcatgaacatcagcagccagggcgacggcgcctgcgtgctgctgagagccctggagcccctggagggcctggagaccatgagacagctgagaagcaccctgagaaagggcaccgccagcagagtgctgaaggacagagagctgtgcagcggccccagcaagctgtgccaggccctggccatcaacaagagcttcgaccagagagacctggcccaggacgaggccgtgtggctggagagaggccccctggagcccagcgagcccgccgtggtggccgccgccagagtgggcgtgggccacgccggcgagtgggccagaaagcccctgagattctacgtgagaggcagcccctgggtgagcgtggtggacagagtggccgagcaggacacccaggcctag

SEQ ID NO: 11861 - DNA, 846 bp, Artificial Sequence
  Description of Artificial Sequence: Synthetic coding sequence
atgggccagaagaagcagagacccgccagagccggccagccccacagcagcagcgacgccgcccaggcccccgccgagcagccccacagcagcagcgacgccgcccaggccccctgccccagagagagatgcctgggcccccccaccacccccggcccctacagaagcatctacttcagcagccccaagggccacctgaccagactgggcctggagttcttcgaccagcccgccgtgcccctggccagagccttcctgggccaggtgctggtgagaagactgcccaacggcaccgagctgagaggcagaatcgtggagaccgaggcctacctgggccccgaggacgaggccgcccacagcagaggcggcagacagacccccagaaacagaggcatgttcatgaagcccggcaccctgtacgtgtacatcatctacggcatgtacttctgcatgaacatcagcagccagggcgacggcgcctgcgtgctgctgagagccctggagcccctggagggcctggagaccatgagacagctgagaagcaccctgagaaagggcaccgccagcagagtgctgaaggacagagagctgtgcagcggccccagcaagctgtgccaggccctggccatcaacaagagcttcgaccagagagacctggcccaggacgaggccgtgtggctggagagaggccccctggagcccagcgagcccgccgtggtggccgccgccagagtgggcgtgggccacgccggcgagtgggccagaaagcccctgagattctacgtgagaggcagcccctgggtgagcgtggtggacagagtggccgagcaggacacccaggcctag

SEQ ID NO: 11862 - DNA, 756 bp, Artificial Sequence
  Description of Artificial Sequence: Synthetic coding sequence
atgggccagaagaagcagagacccgccagagccggccagccccacagcagcagcgacgccgcccaggcccccgccgagcagccccacagcagcagcgacgccgcccaggccccctgccccagagagagatgcctgggcccccccaccacccccggcccctacagaagcatctacttcagcagccccaagggccacctgaccagactgggcctggagttcttcgaccagcccgccgtgcccctggccagagccttcctgggccaggtgctggtgagaagactgcccaacggcaccgagctgagaggcagaatcgtggagaccgaggcctacctgggccccgaggacgaggccgcccacagcagaggcggcagacagacccccagaaacagaggcatgttcatgaagcccggcaccctgtacgtgtacatcatctacggcatgtacttctgcatgaacatcagcagccagggcgacggcgcctgcgtgctgctgagagccctggagcccctggagggcctggagaccatgagacagctgagaagcaccctgagaaagggcaccgccagcagagtgctgaaggacagagagctgtgcagcggccccagcaagctgtgccaggccctggccatcaacaagagcttcgaccagagagacctggcccaggacgaggccgtgtggctggagagaggccccctggagcccagcgagcccgccgtggtggccgccgccagagtgggcgtgggccacgccggctag

SEQ ID NO: 11863 - DNA, 1044 bp, Artificial Sequence
  Description of Artificial Sequence: Synthetic coding sequence
atgcacgcccactgcctgcccttcctgctgcacgcctggtgggccctgctgcaggccggcgccgccaccgtggccaccgccctgctgagaaccagaggccagcccagcagccccagccccctggcctacatgctgagcctgtacagagaccccctgcccagagccgacatcatcagaagcctgcaggccgaggacgtggccgtggacggccagaactggaccttcgccttcgacttcagcttcctgagccagcaggaggacctggcctgggccgagctgagactgcagctgagcagccccgtggacctgcccaccgagggcagcctggccatcgagatcttccaccagcccaagcccgacaccgagcaggccagcgacagctgcctggagagattccagatggacctgttcaccgtgaccctgagccaggtgaccttcagcctgggcagcatggtgctggaggtgaccagacccctgagcaagtggctgaagcaccccggcgccctggagaagcagatgagcagagtggccggcgagtgctggcccagaccccccaccccccccgccaccaacgtgctgctgatgctgtacagcaacctgagccaggagcagagacagctgggcggcagcaccctgctgtgggaggccgagagcagctggagagcccaggagggccagctgagctgggagtggggcaagagacacagaagacaccacctgcccgacagaagccagctgtgcagaaaggtgaagttccaggtggacttcaacctgatcggctggggcagctggatcatctaccccaagcagtacaacgcctacagatgcgagggcgagtgccccaaccccgtgggcgaggagttccaccccaccaaccacgcctacatccagagcctgctgaagagataccagccccacagagtgcccagcacctgctgcgcccccgtgaagaccaagcccctgagcatgctgtacgtggacaacggcagagtgctgctggaccaccacaaggacatgatcgtggaggagtgcggctgcctgtag

SEQ ID NO: 11864 - DNA, 879 bp, Artificial Sequence
  Description of Artificial Sequence: Synthetic coding sequence
gaccagcagctgggcatccagaccaaggacgtggccgtggacggccagaactggaccttcgccttcgacttcagcttcctgagccagcaggaggacctggcctgggccgagctgagactgcagctgagcagccccgtggacctgcccaccgagggcagcctggccatcgagatcttccaccagcccaagcccgacaccgagcaggccagcgacagctgcctggagagattccagatggacctgttcaccgtgaccctgagccaggtgaccttcagcctgggcagcatggtgctggaggtgaccagacccctgagcaagtggctgaagcaccccggcgccctggagaagcagatgagcagagtggccggcgagtgctggcccagaccccccaccccccccgccaccaacgtgctgctgatgctgtacagcaacctgagccaggagcagagacagctgggcggcagcaccctgctgtgggaggccgagagcagctggagagcccaggagggccagctgagctgggagtggggcaagagacacagaagacaccacctgcccgacagaagccagctgtgcagaaaggtgaagttccaggtggacttcaacctgatcggctggggcagctggatcatctaccccaagcagtacaacgcctacagatgcgagggcgagtgccccaaccccgtgggcgaggagttccaccccaccaaccacgcctacatccagagcctgctgaagagataccagccccacagagtgcccagcacctgctgcgcccccgtgaagaccaagcccctgagcatgctgtacgtggacaacggcagagtgctgctggaccaccacaaggacatgatcgtggaggagtgcggctgcctgtag

SEQ ID NO: 11865 - DNA, 534 bp, Artificial Sequence
  Description of Artificial Sequence: Synthetic coding sequence
atggtgctgctgagcaccctgggcatcgtgttccagggcgagggcccccccatcagcagctgcgacaccggcaccatggccaactgcgagagaaccttcatcgccatcaagcccgacggcgtgcagagaggcctggtgggcgagatcatcaagagattcgagcagaagggcttcagactggtgggcctgaagttcatgcaggccagcgaggacctgctgaaggagcactacgtggacctgaaggacagacccttcttcgccggcctggtgaagtacatgcacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaacatcatccacggcagcgacagcgtggagagcgccgagaaggagatcggcctgtggttccaccccgaggagctggtggactacaccagctgcgcccagaactggatctacgagtag

SEQ ID NO: 11866 - DNA, 534 bp, Artificial Sequence; identical to SEQ ID NO: 11865
  Description of Artificial Sequence: Synthetic coding sequence

SEQ ID NO: 11867 - DNA, 459 bp, Artificial Sequence
  Description of Artificial Sequence: Synthetic coding sequence
atggccaactgcgagagaaccttcatcgccatcaagcccgacggcgtgcagagaggcctggtgggcgagatcatcaagagattcgagcagaagggcttcagactggtgggcctgaagttcatgcaggccagcgaggacctgctgaaggagcactacgtggacctgaaggacagacccttcttcgccggcctggtgaagtacatgcacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaacatcatccacggcagcgacagcgtggagagcgccgagaaggagatcggcctgtggttccaccccgaggagctggtggactacaccagctgcgcccagaactggatctacgagtag

SEQ ID NO: 11868 - DNA, 183 bp, Artificial Sequence
  Description of Artificial Sequence: Synthetic coding sequence
atggtgctgctgagcaccctgggcatcgtgttccagggcgagggcccccccatcagcagctgcgacaccggcaccatggccaactgcgagagaaccttcatcgccatcaagcccgacggcgtgcagagaggcctggtgggcgagatcatcaagagattcgagcagaagggcttcagactgtag

SEQ ID NO: 11869 - DNA, 1443 bp, Artificial Sequence
  Description of Artificial Sequence: Synthetic coding sequence
atggccaccgtgcccggcctgcagcccctgcccaccctggagcaggacctggagcaggaggagatcctgatcgtgaaggtggaggaggacttctgcctggaggaggagcccagcgtggagaccgaggaccccagccccgagaccttcagacagctgttcagactgttctgctaccaggaggtggccggccccagagaggccctgagcagactgtgggagctgtgctgcagatggctgagacccgagctgagaaccaaggagcagatcctggagctgctggtgctggagcagttcctgaccgtgctgcccggcgagatccaggccagagtgagagagcagcagcccgagagcggcgaggaggccgtggtgctggtggagggcctgcagagaaagcccagaaagcacagacagagaggcagcgagctgctgagcgacgacgaggtgcccctgggcatcggcggccagttcctgaagcaccaggccgaggcccagcccgaggacctgagcctggaggaggaggccagattcagcagccagcagccccccgcccagctgagccacagaccccagagaggccccctgctgtggcccgagagaggcccccccgcccccagacaccaggagatggccagcgccagccccttcctgagcgcctggagccaggtgcccgtgaacctggaggacgtggccgtgtacctgagcggcgaggagcccagatgcatggaccccgcccagagagacgcccccctggagaacgagggccccggcatccagctggaggacggcggcgacggcagagaggacgcccccctgagaatggagtggtacagagtgctgagcgccagatgccagggccccggccaccccctgcccggccagagacccgcccccgtgagaggcctggtgagacccgaccagcccagaggcggccccccccccggcagaagagccagccacggcgccgacaagccctacacctgccccgagtgcggcaagggcttcagcaagaccagccacctgaccaagcaccagagaacccacaccggcgagagaccctacaagtgcctggtgtgcggcaagggcttcagcgacagaagcaacttcagcacccaccagagagtgcacaccggcgagaagccctacccctgccccgagtgcggcaagagattcagccagagcagcagcctggtgatccacagaagaacccacagcggcgagagaccctacgcctgcacccagtgcggcaagagattcaacaacagcagccacttcagcgcccacagaagaacccacaccggcgagaagccctacacctgccccgcctgcggcagaggcttcagaagaggcaccgacctgcacaagcaccagagaacccacatgggcgccggcagcctgcccaccctgcagcccgtggcccccggcggccccggcgccaaggcctag

SEQ ID NO: 11870 - DNA, 588 bp, Artificial Sequence
  Description of Artificial Sequence: Synthetic coding sequence
atgggcggcctgttctggagaagcgccctgagaggcctgagatgcggccccagagcccccggccccagcctgctggtgagacacggcagcggcctgccccccagcgccctgaagagaggccccagctggaccagagagagaaccctggtggccgtgaagcccgacggcgtgcagagaagactggtgggcgacgtgatccagagattcgagagaagaggcttcaccctggtgggcatgaagatgctgcaggcccccgagagcgtgctggccgagcactaccaggacctgagaagaaagcccttctaccccgccctgatcagatacatgagcagcggccccgtggtggccatggtgtgggagggctacaacgtggtgagagccagcagagccatgatcggccacaccgacagcgccgaggccgcccccggcaccatcagaggcgacttcagcgtgcacatcagcagaaacgtgatccacgccagcgacagcgtggagggcgcccagagagagatccagctgtggttccagagcagcgagctggtgagctgggccgacggcggccagcacagcagcatccaccccgcctag

SEQ ID NO: 11871 - DNA, 354 bp, Artificial Sequence
  Description of Artificial Sequence: Synthetic coding sequence
atgaagatgctgcaggcccccgagagcgtgctggccgagcactaccaggacctgagaagaaagcccttctaccccgccctgatcagatacatgagcagcggccccgtggtggccatggtgtgggagggctacaacgtggtgagagccagcagagccatgatcggccacaccgacagcgccgaggccgcccccggcaccatcagaggcgacttcagcgtgcacatcagcagaaacgtgatccacgccagcgacagcgtggagggcgcccagagagagatccagctgtggttccagagcagcgagctggtgagctgggccgacggcggccagcacagcagcatccaccccgcctag

SEQ ID NO: 11872 - DNA, 510 bp, Artificial Sequence
  Description of Artificial Sequence: Synthetic coding sequence
tgatggagaagcgccctgagaggcctgagatgcggccccagagcccccggccccagcctgctggtgagacacggcagcggcggccccagctggaccagagagagaaccctggtggccgtgaagcccgacggcgtgcagagaagactggtgggcgacgtgatccagagattcgagagaagaggcttcaccctggtgggcatgaagatgctgcaggcccccgagagcgtgctggccgagcactaccaggacctgagaagaaagcccttctaccccgccctgatcagatacatgagcagcggccccgtggtggccatggtgtgggagggctacaacgtggtgagagccagcagagccatgatcggccacaccgacagcgccgaggccgcccccggcaccatcagaggcgacttcagcgtgcacatcagcagccacagactggcccccctggacagaggccagagagagcagcagatggtgcccggcatcccccagggcgcccacgaggcctag

SEQ ID NO: 11873 - DNA, 702 bp, Artificial Sequence
  Description of Artificial Sequence: Synthetic coding sequence
atgggcggcctgttctggagaagcgccctgagaggcctgagatgcggccccagagcccccggccccagcctgctggtgagacacggcagcggcggccccagctggaccagagagagaaccctggtggccgtgaagcccgacggcgtgcagagaagactggtgggcgacgtgatccagagattcgagagaagaggcttcaccctggtgggcatgaagatgctgcaggcccccgagagcgtgctggccgagcactaccaggacctgagaagaaagcccttctaccccgccctgatcagatacatgagcagcggccccgtggtggccatggtgtgggagggctacaacgtggtgagagccagcagagccatgatcggccacaccgacagcgccgaggccgcccccggcaccatcagaggcgacttcagcgtgcacatcagcagaaacgtgatccacgccagcgacagcgtggagggcgcccagagagagatccagctgtggttccagagcagcgagctgagccccaccggcgccccctggcccagcagaagacccacctggagaggcaccaccgtgagccccagaaccgccaccagcagcgccagaacctgctgcggcaccaagtggcccagcagccaggaggccgccctgggcctgggcagcggcctgctgagattcagctgcggcaccgccgccatcagatag

SEQ ID NO: 11874 - DNA, 354 bp, Artificial Sequence; identical to SEQ ID NO: 11871
  Description of Artificial Sequence: Synthetic coding sequence

SEQ ID NO: 11875 - DNA, 114 bp, Artificial Sequence
  Description of Artificial Sequence: Synthetic coding sequence
atgaagatgctgcaggcccccgagagcgtgctggccgagcactaccaggacctgagaagaaagcccttctaccccgccctgatcagatacatgagcagcggccccgtggtgtag

SEQ ID NO: 11876 - DNA, 195 bp, Artificial Sequence
  Description of Artificial Sequence: Synthetic coding sequence
atgttcctgcagtactacctgaacgagcagggcgacagagtgtacaccctgaagaagttcgaccccatgggccagcagacctgcagcgcccaccccgccagattcagccccgacgacaagtacagcagacacagaatcaccatcaagaagagattcaaggtgctgatgacccagcagcccagacccgtgctgtag

SEQ ID NO: 11877 - DNA, 7668 bp, Artificial Sequence
  Description of Artificial Sequence: Synthetic coding sequence
atgccccccctgctggcccccctgctgtgcctggccctgctgcccgccctggccgccagaggccccagatgcagccagcccggcgagacctgcctgaacggcggcaagtgcgaggccgccaacggcaccgaggcctgcgtgtgcggcggcgccttcgtgggccccagatgccaggaccccaacccctgcctgagcaccccctgcaagaacgccggcacctgccacgtggtggacagaagaggcgtggccgactacgcctgcagctgcgccctgggcttcagcggccccctgtgcctgacccccctggacaacgcctgcctgaccaacccctgcagaaacggcggcacctgcgacctgctgaccctgaccgagtacaagtgcagatgcccccccggctggagcggcaagagctgccagcaggccgacccctgcgccagcaacccctgcgccaacggcggccagtgcctgcccttcgaggccagctacatctgccactgcccccccagcttccacggccccacctgcagacaggacgtgaacgagtgcggccagaagcccggcctgtgcagacacggcggcacctgccacaacgaggtgggcagctacagatgcgtgtgcagagccacccacaccggccccaactgcgagagaccctacgtgccctgcagccccagcccctgccagaacggcggcacctgcagacccaccggcgacgtgacccacgagtgcgcctgcctgcccggcttcaccggccagaactgcgaggagaacatcgacgactgccccggcaacaactgcaagaacggcggcgcctgcgtggacggcgtgaacacctacaactgcagatgcccccccgagtggaccggccagtactgcaccgaggacgtggacgagtgccagctgatgcccaacgcctgccagaacggcggcacctgccacaacacccacggcggctacaactgcgtgtgcgtgaacggctggaccggcgaggactgcagcgagaacatcgacgactgcgccagcgccgcctgcttccacggcgccacctgccacgacagagtggccagcttctactgcgagtgcccccacggcagaaccggcctgctgtgccacctgaacgacgcctgcatcagcaacccctgcaacgagggcagcaactgcgacaccaaccccgtgaacggcaaggccatctgcacctgccccagcggctacaccggccccgcctgcagccaggacgtggacgagtgcagcctgggcgccaacccctgcgagcacgccggcaagtgcatcaacaccctgggcagcttcgagtgccagtgcctgcagggctacaccggccccagatgcgagatcgacgtgaacgagtgcgtgagcaacccctgccagaacgacgccacctgcctggaccagatcggcgagttccagtgcatctgcatgcccggctacgagggcgtgcactgcgaggtgaacaccgacgagtgcgccagcagcccctgcctgcacaacggcagatgcctggacaagatcaacgagttccagtgcgagtgccccaccggcttcaccggccacctgtgccagtacgacgtggacgagtgcgccagcaccccctgcaagaacggcgccaagtgcctggacggccccaacacctacacctgcgtgtgcaccgagggctacaccggcacccactgcgaggtggacatcgacgagtgcgaccccgacccctgccactacggcagctgcaaggacggcgtggccaccttcacctgcctgtgcagacccggctacaccggccaccactgcgagaccaacatcaacgagtgcagcagccagccctgcagacacggcggcacctgccaggacagagacaacgcctacctgtgcttctgcctgaagggcaccaccggccccaactgcgagatcaacctggacgactgcgccagcagcccctgcgacagcggcacctgcctggacaagatcgacggctacgagtgcgcctgcgagcccggctacaccggcagcatgtgcaacatcaacatcgacgagtgcgccggcaacccctgccacaacggcggcacctgcgaggacggcatcaacggcttcacctgcagatgccccgagggctaccacgaccccacctgcctgagcgaggtgaacgagtgcaacagcaacccctgcgtgcacggcgcctgcagagacagcctgaacggctacaagtgcgactgcgaccccggctggagcggcaccaactgcgacatcaacaacaacgagtgcgagagcaacccctgcgtgaacggcggcacctgcaaggacatgaccagcggctacgtgtgcacctgcagagagggcttcagcggccccaactgccagaccaacatcaacgagtgcgccagcaacccctgcctgaaccagggcacctgcatcgacgacgtggccggctacaagtgcaactgcctgctgccctacaccggcgccacctgcgaggtggtgctggccccctgcgcccccagcccctgcagaaacggcggcgagtgcagacagagcgaggactacgagagcttcagctgcgtgtgccccaccggctggcagggccagacctgcgaggtggacatcaacgagtgcgtgctgagcccctgcagacacggcgccagctgccagaacacccacggcggctacagatgccactgccaggccggctacagcggcagaaactgcgagaccgacatcgacgactgcagacccaacccctgccacaacggcggcagctgcaccgacggcatcaacaccgccttctgcgactgcctgcccggcttcagaggcaccttctgcgaggaggacatcaacgagtgcgccagcgacccctgcagaaacggcgccaactgcaccgactgcgtggacagctacacctgcacctgccccgccggcttcagcggcatccactgcgagaacaacacccccgactgcaccgagagcagctgcttcaacggcggcacctgcgtggacggcatcaacagcttcacctgcctgtgcccccccggcttcaccggcagctactgccagcacgacgtgaacgagtgcgacagccagccctgcctgcacggcggcacctgccaggacggctgcggcagctacagatgcacctgcccccagggctacaccggccccaactgccagaacctggtgcactggtgcgacagcagcccctgcaagaacggcggcaagtgctggcagacccacacccagtacagatgcgagtgccccagcggctggaccggcctgtactgcgacgtgcccagcgtgagctgcgaggtggccgcccagagacagggcgtggacgtggccagactgtgccagcacggcggcctgtgcgtggacgccggcaacacccaccactgcagatgccaggccggctacaccggcagctactgcgaggacctggtggacgagtgcagccccagcccctgccagaacggcgccacctgcaccgactacctgggcggctacagctgcaagtgcgtggccggctaccacggcgtgaactgcagcgaggagatcgacgagtgcctgagccacccctgccagaacggcggcacctgcctggacctgcccaacacctacaagtgcagctgccccagaggcacccagggcgtgcactgcgagatcaacgtggacgactgcaacccccccgtggaccccgtgagcagaagccccaagtgcttcaacaacggcacctgcgtggaccaggtgggcggctacagctgcacctgcccccccggcttcgtgggcgagagatgcgagggcgacgtgaacgagtgcctgagcaacccctgcgacgccagaggcacccagaactgcgtgcagagagtgaacgacttccactgcgagtgcagagccggccacaccggcagaagatgcgagagcgtgatcaacggctgcaagggcaagccctgcaagaacggcggcacctgcgccgtggccagcaacaccgccagaggcttcatctgcaagtgccccgccggcttcgagggcgccacctgcgagaacgacgccagaacctgcggcagcctgagatgcctgaacggcggcacctgcatcagcggccccagaagccccacctgcctgtgcctgggccccttcaccggccccgagtgccagttccccgccagcagcccctgcctgggcggcaacccctgctacaaccagggcacctgcgagcccaccagcgagagccccttctacagatgcctgtgccccgccaagttcaacggcctgctgtgccacatcctggactacagcttcggcggcggcgccggcagagacatccccccccccctgatcgaggaggcctgcgagctgcccgagtgccaggaggacgccggcaacaaggtgtgcagcctgcagtgcaacaaccacgcctgcggctgggacggcggcgactgcagcctgaacttcaacgacccctggaagaactgcacccagagcctgcagtgctggaagtacttcagcgacggccactgcgacagccagtgcaacagcgccggctgcctgttcgacggcttcgactgccagagagccgagggccagtgcaaccccctgtacgaccagtactgcaaggaccacttcagcgacggccactgcgaccagggctgcaacagcgccgagtgcgagtgggacggcctggactgcgccgagcacgtgcccgagagactggccgccggcaccctggtggtggtggtgctgatgccccccgagcagctgagaaacagcagcttccacttcctgagagagctgagcagagtgctgcacaccaacgtggtgttcaagagagacgcccacggccagcagatgatcttcccctactacggcagagaggaggagctgagaaagcaccccatcaagagagccgccgagggctgggccgcccccgacgccctgctgggccaggtgaaggccagcctgctgcccggcggcagcgagggcggcagaagaagaagagagctggaccccatggacgtgagaggcagcatcgtgtacctggagatcgacaacagacagtgcgtgcaggccagcagccagtgcttccagagcgccaccgacgtggccgccttcctgggcgccctggccagcctgggcagcctgaacatcccctacaagatcgaggccgtgcagagcgagaccgtggagccccccccccccgcccagctgcacttcatgtacgtggccgccgccgccttcgtgctgctgttcttcgtgggctgcggcgtgctgctgagcagaaagagaagaagacagcacggccagctgtggttccccgagggcttcaaggtgagcgaggccagcaagaagaagagaagagagcccctgggcgaggacagcgtgggcctgaagcccctgaagaacgccagcgacggcgccctgatggacgacaaccagaacgagtggggcgacgaggacctggagaccaagaagttcagattcgaggagcccgtggtgctgcccgacctggacgaccagaccgaccacagacagtggacccagcagcacctggacgccgccgacctgagaatgagcgccatggcccccacccccccccagggcgaggtggacgccgactgcatggacgtgaacgtgagaggccccgacggcttcacccccctgatgatcgccagctgcagcggcggcggcctggagaccggcaacagcgaggaggaggaggacgcccccgccgtgatcagcgacttcatctaccagggcgccagcctgcacaaccagaccgacagaaccggcgagaccgccctgcacctggccgccagatacagcagaagcgacgccgccaagagactgctggaggccagcgccgacgccaacatccaggacaacatgggcagaacccccctgcacgccgccgtgagcgccgacgcccagggcgtgttccagatcctgatcagaaacagagccaccgacctggacgccagaatgcacgacggcaccacccccctgatcctggccgccagactggccgtggagggcatgctggaggacctgatcaacagccacgccgacgtgaacgccgtggacgacctgggcaagagcgccctgcactgggccgccgccgtgaacaacgtggacgccgccgtggtgctgctgaagaacggcgccaacaaggacatgcagaacaacagagaggagacccccctgttcctggccgccagagagggcagctacgagaccgccaaggtgctgctggaccacttcgccaacagagacatcaccgaccacatggacagactgcccagagacatcgcccaggagagaatgcaccacgacatcgtgagactgctggacgagtacaacctggtgagaagcccccagctgcacggcgcccccctgggcggcacccccaccctgagcccccccctgtgcagccccaacggctacctgggcagcctgaagcccggcgtgcagggcaagaaggtgagaaagcccagcagcaagggcctggcctgcggcagcaaggaggccaaggacctgaaggccagaagaaagaagagccaggacggcaagggctgcctgctggacagcagcggcatgctgagccccgtggacagcctggagagcccccacggctacctgagcgacgtggccagcccccccctgctgcccagccccttccagcagagccccagcgtgcccctgaaccacctgcccggcatgcccgacacccacctgggcatcggccacctgaacgtggccgccaagcccgagatggccgccctgggcggcggcggcagactggccttcgagaccggcccccccagactgagccacctgcccgtggccagcggcaccagcaccgtgctgggcagcagcagcggcggcgccctgaacttcaccgtgggcggcagcaccagcctgaacggccagtgcgagtggctgagcagactgcagagcggcatggtgcccaaccagtacaaccccctgagaggcagcgtggcccccggccccctgagcacccaggcccccagcctgcagcacggcatggtgggccccctgcacagcagcctggccgccagcgccctgagccagatgatgagctaccagggcctgcccagcaccagactggccacccagccccacctggtgcagacccagcaggtgcagccccagaacctgcagatgcagcagcagaacctgcagcccgccaacatccagcagcagcagagcctgcagcccccccccccccccccccagccccacctgggcgtgagcagcgccgccagcggccacctgggcagaagcttcctgagcggcgagcccagccaggccgacgtgcagcccctgggccccagcagcctggccgtgcacaccatcctgccccaggagagccccgccctgcccaccagcctgcccagcagcctggtgccccccgtgaccgccgcccagttcctgaccccccccagccagcacagctacagcagccccgtggacaacacccccagccaccagctgcaggtgcccgagcaccccttcctgacccccagccccgagagccccgaccagtggagcagcagcagcccccacagcaacgtgagcgactggagcgagggcgtgagcagcccccccaccagcatgcagagccagatcgccagaatccccgaggccttcaagtag

SEQ ID NO: 11878 - DNA, 6012 bp, Artificial Sequence
  Description of Artificial Sequence: Synthetic coding sequence
atgcagccccccagcctgctgctgctgctgctgctgctgctgctgctgtgcgtgagcgtggtgagacccagaggcctgctgtgcggcagcttccccgagccctgcgccaacggcggcacctgcctgagcctgagcctgggccagggcacctgccagtgcgcccccggcttcctgggcgagacctgccagttccccgacccctgccagaacgcccagctgtgccagaacggcggcagctgccaggccctgctgcccgcccccctgggcctgcccagcagccccagccccctgacccccagcttcctgtgcacctgcctgcccggcttcaccggcgagagatgccaggccaagctggaggacccctgcccccccagcttctgcagcaagagaggcagatgccacatccaggccagcggcagaccccagtgcagctgcatgcccggctggaccggcgagcagtgccagctgagagacttctgcagcgccaacccctgcgtgaacggcggcgtgtgcctggccacctacccccagatccagtgccactgcccccccggcttcgagggccacgcctgcgagagagacgtgaacgagtgcttccaggaccccggcccctgccccaagggcaccagctgccacaacaccctgggcagcttccagtgcctgtgccccgtgggccaggagggccccagatgcgagctgagagccggcccctgcccccccagaggctgcagcaacggcggcacctgccagctgatgcccgagaaggacagcaccttccacctgtgcctgtgcccccccggcttcatcggccccgactgcgaggtgaaccccgacaactgcgtgagccaccagtgccagaacggcggcacctgccaggacggcctggacacctacacctgcctgtgccccgagacctggaccggctgggactgcagcgaggacgtggacgagtgcgagacccagggccccccccactgcagaaacggcggcacctgccagaacagcgccggcagcttccactgcgtgtgcgtgagcggctggggcggcaccagctgcgaggagaacctggacgactgcatcgccgccacctgcgcccccggcagcacctgcatcgacagagtgggcagcttcagctgcctgtgcccccccggcagaaccggcctgctgtgccacctggaggacatgtgcctgagccagccctgccacggcgacgcccagtgcagcaccaaccccctgaccggcagcaccctgtgcctgtgccagcccggctacagcggccccacctgccaccaggacctggacgagtgcctgatggcccagcagggccccagcccctgcgagcacggcggcagctgcctgaacacccccggcagcttcaactgcctgtgcccccccggctacaccggcagcagatgcgaggccgaccacaacgagtgcctgagccagccctgccaccccggcagcacctgcctggacctgctggccaccttccactgcctgtgcccccccggcctggagggccagctgtgcgaggtggagaccaacgagtgcgccagcgccccctgcctgaaccacgccgactgccacgacctgctgaacggcttccagtgcatctgcctgcccggcttcagcggcaccagatgcgaggaggacatcgacgagtgcagaagcagcccctgcgccaacggcggccagtgccaggaccagcccggcgccttccactgcaagtgcctgcccggcttcgagggccccagatgccagaccgaggtggacgagtgcctgagcgacccctgccccgtgggcgccagctgcctggacctgcccggcgccttcttctgcctgtgccccagcggcttcaccggccagctgtgcgaggtgcccctgtgcgcccccaacctgtgccagcccaagcagatctgcaaggaccagaaggacaaggccaactgcctgtgccccgacggcagccccggctgcgccccccccgaggacaactgcacctgccaccacggccactgccagagaagcagctgcgtgtgcgacgtgggctggaccggccccgagtgcgaggccgagctgggcggctgcatcagcgccccctgcgcccacggcggcacctgctacccccagcccagcggctacaactgcacctgccccaccggctacaccggccccacctgcagcgaggagatgaccgcctgccacagcggcccctgcctgaacggcggcagctgcaaccccagccccggcggctactactgcacctgcccccccagccacaccggcccccagtgccagaccagcaccgactactgcgtgagcgccccctgcttcaacggcggcacctgcgtgaacagacccggcaccttcagctgcctgtgcgccatgggcttccagggccccagatgcgagggcaagctgagacccagctgcgccgacagcccctgcagaaacagagccacctgccaggacagcccccagggccccagatgcctgtgccccaccgtgtacaccggcggcagctgccagaccctgatggacctgtgcgcccagaagccctgccccagaaacagccactgcctgcagaccggccccagcttccactgcctgtgcctgcagggctggaccggccccctgtgcaacctgcccctgagcagctgccagaaggccgccctgagccagggcatcgacgtgagcagcctgtgccacaacggcggcctgtgcgtggacagcggccccagctacttctgccactgcccccccggcttccagggcagcctgtgccaggaccacgtgaacccctgcgagagcagaccctgccagaacggcgccacctgcatggcccagcccagcggctacctgtgccagtgcgcccccggctacgacggccagaactgcagcaaggagctggacgcctgccagagccagccctgccacaaccacggcacctgcacccccaagcccggcggcttccactgcgcctgcccccccggcttcgtgggcctgagatgcgagggcgacgtggacgagtgcctggaccagccctgccaccccaccggcaccgccgcctgccacagcctggccaacgccttctactgccagtgcctgcccggccacaccggccagtggtgcgaggtggagatcgacccctgccacagccagccctgcttccacggcggcacctgcgaggccaccgccggcagccccctgggcttcatctgccactgccccaagggcttcgagggccccacctgcagccacagagcccccagctgcggcttccaccactgccaccacggcggcctgtgcctgcccagccccaagcccggcttcccccccagatgcgcctgcctgagcggctacggcggccccgactgcctgaccccccccgcccccaagggctgcggcccccccagcccctgcctgtacaacggcagctgcagcgagaccaccggcctgggcggccccggcttcagatgcagctgcccccacagcagccccggccccagatgccagaagcccggcgccaagggctgcgagggcagaagcggcgacggcgcctgcgacgccggctgcagcggccccggcggcaactgggacggcggcgactgcagcctgggcgtgcccgacccctggaagggctgccccagccacagcagatgctggctgctgttcagagacggccagtgccacccccagtgcgacagcgaggagtgcctgttcgacggctacgactgcgagaccccccccgcctgcacccccgcctacgaccagtactgccacgaccacttccacaacggccactgcgagaagggctgcaacaccgccgagtgcggctgggacggcggcgactgcagacccgaggacggcgaccccgagtggggccccagcctggccctgctggtggtgctgagcccccccgccctggaccagcagctgttcgccctggccagagtgctgagcctgaccctgagagtgggcctgtgggtgagaaaggacagagacggcagagacatggtgtacccctaccccggcgccagagccgaggagaagctgggcggcaccagagaccccacctaccaggagagagccgccccccagacccagcccctgggcaaggagaccgacagcctgagcgccggcttcgtggtggtgatgggcgtggacctgagcagatgcggccccgaccaccccgccagcagatgcccctgggaccccggcctgctgctgagattcctggccgccatggccgccgtgggcgccctggagcccctgctgcccggccccctgctggccgtgcacccccacgccggcaccgccccccccgccaaccagctgccctggcccgtgctgtgcagccccgtggccggcgtgatcctgctggccctgggcgccctgctggtgctgcagctgatcagaagaagaagaagagagcacggcgccctgtggctgccccccggcttcaccagaagacccagaacccagagcgccccccacagaagaagaccccccctgggcgaggacagcatcggcctgaaggccctgaagcccaaggccgaggtggacgaggacggcgtggtgatgtgcagcggccccgaggagggcgaggaggtgggccaggccgaggagaccggcccccccagcacctgccagctgtggagcctgagcggcggctgcggcgccctgccccaggccgccatgctgacccccccccaggagagcgagatggaggcccccgacctggacaccagaggccccgacggcgtgacccccctgatgagcgccgtgtgctgcggcgaggtgcagagcggcaccttccagggcgcctggctgggctgccccgagccctgggagcccctgctggacggcggcgcctgcccccaggcccacaccgtgggcaccggcgagacccccctgcacctggccgccagattcagcagacccaccgccgccagaagactgctggaggccggcgccaaccccaaccagcccgacagagccggcagaacccccctgcacgccgccgtggccgccgacgccagagaggtgtgccagctgctgctgagaagcagacagaccgccgtggacgccagaaccgaggacggcaccacccccctgatgctggccgccagactggccgtggaggacctggtggaggagctgatcgccgcccaggccgacgtgggcgccagagacaagtggggcaagaccgccctgcactgggccgccgccgtgaacaacgccagagccgccagaagcctgctgcaggccggcgccgacaaggacgcccaggacaacagagagcagacccccctgttcctggccgccagagagggcgccgtggaggtggcccagctgctgctgggcctgggcgccgccagagagctgagagaccaggccggcctggcccccgccgacgtggcccaccagagaaaccactgggacctgctgaccctgctggagggcgccggcccccccgaggccagacacaaggccacccccggcagagaggccggccccttccccagagccagaaccgtgagcgtgagcgtgcccccccacggcggcggcgccctgcccagatgcagaaccctgagcgccggcgccggccccagaggcggcggcgcctgcctgcaggccagaacctggagcgtggacctggccgccagaggcggcggcgcctacagccactgcagaagcctgagcggcgtgggcgccggcggcggccccacccccagaggcagaagattcagcgccggcatgagaggccccagacccaaccccgccatcatgagaggcagatacggcgtggccgccggcagaggcggcagagtgagcaccgacgactggccctgcgactgggtggccctgggcgcctgcggcagcgccagcaacatccccatcccccccccctgcctgacccccagccccgagagaggcagcccccagctggactgcggcccccccgccctgcaggagatgcccatcaaccagggcggcgagggcaagaagtag

SEQ ID NO: 11879 - DNA, 561 bp, Artificial Sequence
  Description of Artificial Sequence: Synthetic coding sequence
atgagcgccgtgtgctgcggcgaggtgcagagcggcaccttccagggcgcctggctgggctgccccgagccctgggagcccctgctggacggcggcgcctgcccccaggcccacaccgtgggcaccggcgagacccccctgcacctggccgccagattcagcagacccaccgccgccagaagactgctggaggccggcgccaaccccaaccagcccgacagagccggcagaacccccctgcacgccgccgtggccgccgacgccagagaggtgtgccagctgctgctgagaagcagacagaccgccgtggacgccagaaccgaggacggcaccacccccctgatgctggccgccagactggccgtggaggacctggtggaggagctgatcgccgcccaggccgacgtgggcgccagagacaagtggggcgccgacgccgccatccccggcggcgccggcagaagcggcggcagcagccccgccaccgccggcgccggcggcagccccagagccgccggccccggctgggccagcgccggcggcagaagaagccccacctag

SEQ ID NO: 11880 - DNA, 1734 bp, Artificial Sequence
  Description of Artificial Sequence: Synthetic coding sequence
atgcactggctgagaaaggtgcagggcctgtgcaccctgtggggcacccagatgagcagcagaaccctgtacatcaacagcagacagctggtgagcctgcagtggggccaccaggaggtgcccgccaagttcaacttcgccagcgacgtgctggaccactgggccgacatggagaaggccggcaagagactgcccagccccgccctgtggtgggtgaacggcaagggcaaggagctgatgtggaacttcagagagctgagcgagaacagccagcaggccgccaacgtgctgagcggcgcctgcggcctgcagagaggcgacagagtggccgtggtgctgcccagagtgcccgagtggtggctggtgatcctgggctgcatcagagccggcctgatcttcatgcccggcaccatccagatgaagagcaccgacatcctgtacagactgcagatgagcaaggccaaggccatcgtggccggcgacgaggtgatccaggaggtggacaccgtggccagcgagtgccccagcctgagaatcaagctgctggtgagcgagaagagctgcgacggctggctgaacttcaagaagctgctgaacgaggccagcaccacccaccactgcgtggagaccggcagccaggaggccagcgccatctacttcaccagcggcaccagcggcctgcccaagatggccgagcacagctacagcagcctgggcctgaaggccaagatggacgccggctggaccggcctgcaggccagcgacatcatgtggaccatcagcgacaccggctggatcctgaacatcctgtgcagcctgatggagccctgggccctgggcgcctgcaccttcgtgcacctgctgcccaagttcgaccccctggtgatcctgaagaccctgagcagctaccccatcaagagcatgatgggcgcccccatcgtgtacagaatgctgctgcagcaggacctgagcagctacaagttcccccacctgcagaactgcgtgaccgtgggcgagagcctgctgcccgagaccctggagaactggagagcccagaccggcctggacatcagagagagctacggccagaccgagaccggcctgacctgcatggtgagcaagaccatgaagatcaagcccggctacatgggcaccgccgccagctgctacgacgtgcagatcatcgacgacaagggcaacgtgctgccccccggcaccgagggcgacatcggcatcagagtgaagcccatcagacccatcggcatcttcagcggctacgtggacaaccccgacaagaccgccgccaacatcagaggcgacttctggctgctgggcgacagaggcatcaaggacgaggacggctacttccagttcatgggcagagccaacgacatcatcaacagcagcggctacagaatcggccccagcgaggtggagaacgccctgatggagcaccccgccgtggtggagaccgccgtgatcagcagccccgaccccgtgagaggcgaggtggtgaaggccttcgtggtgctggccagccagttcctgagccacgaccccgagcagctgaccaaggagctgcagcagcacgtgaagagcgtgaccgccccctacaagtaccccagaaagatcgagttcgtgctgaacctgcccaagaccgtgaccggcaagatccagagagccaagctgagagacaaggagtggaagatgagcggcaaggccagagcccagtag

SEQ ID NO: 11881 - DNA, 4368 bp, Artificial Sequence
  Description of Artificial Sequence: Synthetic coding sequence
atgggcggcgcctgcagcagcttcaccaccagcagcagccccaccatctacagcaccagcgtgaccgacagcaaggccatgcaggtggagagctgcagcagcgccgtgggcgtgagcaacagaggcgtgagcgagaagcagctgaccagcaacaccgtgcagcagcaccccagcacccccaagagacacaccgtgctgtacatcagccccccccccgaggacctgctggacaacagcagaatgagctgccaggacgagggctgcggcctggagagcgagcagagctgcagcatgtggatggaggacagccccagcaacttcagcaacatgagcaccagcagctacaacgacaacaccgaggtgcccagaaagagcagaaagagaaaccccaagcagagacccggcgtgaagagaagagactgcgaggagagcaacatggacatcttcgacgccgacagcgccaaggccccccactacgtgctgagccagctgaccaccgacaacaagggcaacagcaaggccggcaacggcaccctggagaaccagaagggcaccggcgtgaagaagagccccatgctgtgcggccagtaccccgtgaagagcgagggcaaggagctgaagatcgtggtgcagcccgagacccagcacagagccagatacctgaccgagggcagcagaggcagcgtgaaggacagaacccagcagggcttccccaccgtgaagctggagggccacaacgagcccgtggtgctgcaggtgttcgtgggcaacgacagcggcagagtgaagccccacggcttctaccaggcctgcagagtgaccggcagaaacaccaccccctgcaaggaggtggacatcgagggcaccaccgtgatcgaggtgggcctggaccccagcaacaacatgaccctggccgtggactgcgtgggcatcctgaagctgagaaacgccgacgtggaggccagaatcggcatcgccggcagcaagaagaagagcaccagagccagactggtgttcagagtgaacatcatgagaaaggacggcagcaccctgaccctgcagacccccagcagccccatcctgtgcacccagcccgccggcgtgcccgagatcctgaagaagagcctgcacagctgcagcgtgaagggcgaggaggaggtgttcctgatcggcaagaacttcctgaagggcaccaaggtgatcttccaggagaacgtgagcgacgagaacagctggaagagcgaggccgagatcgacatggagctgttccaccagaaccacctgatcgtgaaggtgcccccctaccacgaccagcacatcaccctgcccgtgagcgtgggcatctacgtggtgaccaacgccggcagaagccacgacgtgcagcccttcacctacacccccgaccccgccgccgccggcgccctgaacgtgaacgtgaagaaggagatcagcagccccgccagaccctgcagcttcgaggaggccatgaaggccatgaagaccaccggctgcaacctggacaaggtgaacatcatccccaacgccctgatgacccccctgatccccagcagcatgatcaagagcgaggacgtgacccccatggaggtgaccgccgagaagagaagcagcaccatcttcaagaccaccaagagcgtgggcagcacccagcagaccctggagaacatcagcaacatcgccggcaacggcagcttcagcagccccagcagcagccacctgcccagcgagaacgagaagcagcagcagatccagcccaaggcctacaaccccgagaccctgaccaccatccagacccaggacatcagccagcccggcaccttccccgccgtgagcgccagcagccagctgcccaacagcgacgccctgctgcagcaggccacccagttccagaccagagagacccagagcagagagatcctgcagagcgacggcaccgtggtgaacctgagccagctgaccgaggccagccagcagcagcagcagagccccctgcaggagcaggcccagaccctgcagcagcagatcagcagcaacatcttccccagccccaacagcgtgagccagctgcagaacaccatccagcagctgcaggccggcagcttcaccggcagcaccgccagcggcagcagcggcagcgtggacctggtgcagcaggtgctggaggcccagcagcagctgagcagcgtgctgttcagcgcccccgacggcaacgagaacgtgcaggagcagctgagcgccgacatcttccagcaggtgagccagatccagagcggcgtgagccccggcatgttcagcagcaccgagcccaccgtgcacaccagacccgacaacctgctgcccggcagagccgagagcgtgcacccccagagcgagaacaccctgagcaaccagcagcagcagcagcagcagcagcagcaggtgatggagagcagcgccgccatggtgatggagatgcagcagagcatctgccaggccgccgcccagatccagagcgagctgttccccagcaccgccagcgccaacggcaacctgcagcagagccccgtgtaccagcagaccagccacatgatgagcgccctgagcaccaacgaggacatgcagatgcagtgcgagctgttcagcagcccccccgccgtgagcggcaacgagaccagcaccaccaccacccagcaggtggccacccccggcaccaccatgttccagaccagcagcagcggcgacggcgaggagaccggcacccaggccaagcagatccagaacagcgtgttccagaccatggtgcagatgcagcacagcggcgacaaccagccccaggtgaacctgttcagcagcaccaagagcatgatgagcgtgcagaacagcggcacccagcagcagggcaacggcctgttccagcagggcaacgagatgatgagcctgcagagcggcaacttcctgcagcagagcagccacagccaggcccagctgttccacccccagaaccccatcgccgacgcccagaacctgagccaggagacccagggcagcctgttccacagccccaaccccatcgtgcacagccagaccagcaccaccagcagcgagcagatgcagccccccatgttccacagccagagcaccatcgccgtgctgcagggcagcagcgtgccccaggaccagcagagcaccaacatcttcctgagccagagccccatgaacaacctgcagaccaacaccgtggcccaggaggccttcttcgccgcccccaacagcatcagccccctgcagagcaccagcaacagcgagcagcaggccgccttccagcagcaggcccccatcagccacatccagacccccatgctgagccaggagcaggcccagcccccccagcagggcctgttccagccccaggtggccctgggcagcctgccccccaaccccatgccccagagccagcagggcaccatgttccagagccagcacagcatcgtggccatgcagagcaacagccccagccaggagcagcagcagcagcagcagcagcagcagcagcagcagcagcagcagcagcagagcatcctgttcagcaaccagaacaccatggccaccatggccagccccaagcagcccccccccaacatgatcttcaaccccaaccagaaccccatggccaaccaggagcagcagaaccagagcatcttccaccagcagagcaacatggcccccatgaaccaggagcagcagcccatgcagttccagagccagagcaccgtgagcagcctgcagaaccccggccccacccagagcgagagcagccagacccccctgttccacagcagcccccagatccagctggtgcagggcagccccagcagccaggagcagcaggtgaccctgttcctgagccccgccagcatgagcgccctgcagaccagcatcaaccagcaggacatgcagcagagccccctgtacagcccccagaacaacatgcccggcatccagggcgccaccagcagcccccagccccaggccaccctgttccacaacaccgccggcggcaccatgaaccagctgcagaacagccccggcagcagccagcagaccagcggcatgttcctgttcggcatccagaacaactgcagccagctgctgaccagcggccccgccaccctgcccgaccagctgatggccatcagccagcccggccagccccagaacgagggccagccccccgtgaccaccctgctgagccagcagatgcccgagaacagccccctggccagcagcatcaacaccaaccagaacatcgagaagatcgacctgctggtgagcctgcagaaccagggcaacaacctgaccggcagcttctag

SEQ ID NO: 11882 - DNA, 4647 bp, Artificial Sequence
  Description of Artificial Sequence: Synthetic coding sequence
atgcccagcgacttcatcagcctgctgagcgccgacctggacctggagagccccaagagcctgtacagcagagacagcctgaagctgcaccccagccagaacttccacagagccggcctgctggaggagagcgtgtacgacctgctgcccaaggagctgcagctgccccccagcagagagaccagcgtggccagcatgagccagaccagcggcggcgaggccggcagccccccccccgccgtggtggccgccgacgccagcagcgcccccagcagcagcagcatgggcggcgcctgcagcagcttcaccaccagcagcagccccaccatctacagcaccagcgtgaccgacagcaaggccatgcaggtggagagctgcagcagcgccgtgggcgtgagcaacagaggcgtgagcgagaagcagctgaccagcaacaccgtgcagcagcaccccagcacccccaagagacacaccgtgctgtacatcagccccccccccgaggacctgctggacaacagcagaatgagctgccaggacgagggctgcggcctggagagcgagcagagctgcagcatgtggatggaggacagccccagcaacttcagcaacatgagcaccagcagctacaacgacaacaccgaggtgcccagaaagagcagaaagagaaaccccaagcagagacccggcgtgaagagaagagactgcgaggagagcaacatggacatcttcgacgccgacagcgccaaggccccccactacgtgctgagccagctgaccaccgacaacaagggcaacagcaaggccggcaacggcaccctggagaaccagaagggcaccggcgtgaagaagagccccatgctgtgcggccagtaccccgtgaagagcgagggcaaggagctgaagatcgtggtgcagcccgagacccagcacagagccagatacctgaccgagggcagcagaggcagcgtgaaggacagaacccagcagggcttccccaccgtgaagctggagggccacaacgagcccgtggtgctgcaggtgttcgtgggcaacgacagcggcagagtgaagccccacggcttctaccaggcctgcagagtgaccggcagaaacaccaccccctgcaaggaggtggacatcgagggcaccaccgtgatcgaggtgggcctggaccccagcaacaacatgaccctggccgtggactgcgtgggcatcctgaagctgagaaacgccgacgtggaggccagaatcggcatcgccggcagcaagaagaagagcaccagagccagactggtgttcagagtgaacatcatgagaaaggacggcagcaccctgaccctgcagacccccagcagccccatcctgtgcacccagcccgccggcgtgcccgagatcctgaagaagagcctgcacagctgcagcgtgaagggcgaggaggaggtgttcctgatcggcaagaacttcctgaagggcaccaaggtgatcttccaggagaacgtgagcgacgagaacagctggaagagcgaggccgagatcgacatggagctgttccaccagaaccacctgatcgtgaaggtgcccccctaccacgaccagcacatcaccctgcccgtgagcgtgggcatctacgtggtgaccaacgccggcagaagccacgacgtgcagcccttcacctacacccccgaccccgccgccggcgccctgaacgtgaacgtgaagaaggagatcagcagccccgccagaccctgcagcttcgaggaggccatgaaggccatgaagaccaccggctgcaacctggacaaggtgaacatcatccccaacgccctgatgacccccctgatccccagcagcatgatcaagagcgaggacgtgacccccatggaggtgaccgccgagaagagaagcagcaccatcttcaagaccaccaagagcgtgggcagcacccagcagaccctggagaacatcagcaacatcgccggcaacggcagcttcagcagccccagcagcagccacctgcccagcgagaacgagaagcagcagcagatccagcccaaggcctacaaccccgagaccctgaccaccatccagacccaggacatcagccagcccggcaccttccccgccgtgagcgccagcagccagctgcccaacagcgacgccctgctgcagcaggccacccagttccagaccagagagacccagagcagagagatcctgcagagcgacggcaccgtggtgaacctgagccagctgaccgaggccagccagcagcagcagcagagccccctgcaggagcaggcccagaccctgcagcagcagatcagcagcaacatcttccccagccccaacagcgtgagccagctgcagaacaccatccagcagctgcaggccggcagcttcaccggcagcaccgccagcggcagcagcggcagcgtggacctggtgcagcaggtgctggaggcccagcagcagctgagcagcgtgctgttcagcgcccccgacggcaacgagaacgtgcaggagcagctgagcgccgacatcttccagcaggtgagccagatccagagcggcgtgagccccggcatgttcagcagcaccgagcccaccgtgcacaccagacccgacaacctgctgcccggcagagccgagagcgtgcacccccagagcgagaacaccctgagcaaccagcagcagcagcagcagcagcagcagcaggtgatggagagcagcgccgccatggtgatggagatgcagcagagcatctgccaggccgccgcccagatccagagcgagctgttccccagcaccgccagcgccaacggcaacctgcagcagagccccgtgtaccagcagaccagccacatgatgagcgccctgagcaccaacgaggacatgcagatgcagtgcgagctgttcagcagcccccccgccgtgagcggcaacgagaccagcaccaccaccacccagcaggtggccacccccggcaccaccatgttccagaccagcagcagcggcgacggcgaggagaccggcacccaggccaagcagatccagaacagcgtgttccagaccatggtgcagatgcagcacagcggcgacaaccagccccaggtgaacctgttcagcagcaccaagagcatgatgagcgtgcagaacagcggcacccagcagcagggcaacggcctgttccagcagggcaacgagatgatgagcctgcagagcggcaacttcctgcagcagagcagccacagccaggcccagctgttccacccccagaaccccatcgccgacgcccagaacctgagccaggagacccagggcagcctgttccacagccccaaccccatcgtgcacagccagaccagcaccaccagcagcgagcagatgcagccccccatgttccacagccagagcaccatcgccgtgctgcagggcagcagcgtgccccaggaccagcagagcaccaacatcttcctgagccagagccccatgaacaacctgcagaccaacaccgtggcccaggaggccttcttcgccgcccccaacagcatcagccccctgcagagcaccagcaacagcgagcagcaggccgccttccagcagcaggcccccatcagccacatccagacccccatgctgagccaggagcaggcccagcccccccagcagggcctgttccagccccaggtggccctgggcagcctgccccccaaccccatgccccagagccagcagggcaccatgttccagagccagcacagcatcgtggccatgcagagcaacagccccagccaggagcagcagcagcagcagcagcagcagcagcagcagcagcagcagcagcagcagagcatcctgttcagcaaccagaacaccatggccaccatggccagccccaagcagcccccccccaacatgatcttcaaccccaaccagaaccccatggccaaccaggagcagcagaaccagagcatcttccaccagcagagcaacatggcccccatgaaccaggagcagcagcccatgcagttccagagccagagcaccgtgagcagcctgcagaaccccggccccacccagagcgagagcagccagacccccctgttccacagcagcccccagatccagctggtgcagggcagccccagcagccaggagcagcaggtgaccctgttcctgagccccgccagcatgagcgccctgcagaccagcatcaaccagcaggacatgcagcagagccccctgtacagcccccagaacaacatgcccggcatccagggcgccaccagcagcccccagccccaggccaccctgttccacaacaccgccggcggcaccatgaaccagctgcagaacagccccggcagcagccagcagaccagcggcatgttcctgttcggcatccagaacaactgcagccagctgctgaccagcggccccgccaccctgcccgaccagctgatggccatcagccagcccggccagccccagaacgagggccagccccccgtgaccaccctgctgagccagcagatgcccgagaacagccccctggccagcagcatcaacaccaaccagaacatcgagaagatcgacctgctggtgagcctgcagaaccagggcaacaacctgaccggcagcttctag

SEQ ID NO: 11883 - DNA, 4368 bp, Artificial Sequence; identical to SEQ ID NO: 11881
  Description of Artificial Sequence: Synthetic coding sequence

SEQ ID NO: 11884 - DNA, 4596 bp, Artificial Sequence
  Description of Artificial Sequence: Synthetic coding sequence
atgcccagcgacttcatcagcctgctgagcgccgacctggacctggagagccccaagagcctgtacagcagagagagcgtgtacgacctgctgcccaaggagctgcagctgccccccagcagagagaccagcgtggccagcatgagccagaccagcggcggcgaggccggcagccccccccccgccgtggtggccgccgacgccagcagcgcccccagcagcagcagcatgggcggcgcctgcagcagcttcaccaccagcagcagccccaccatctacagcaccagcgtgaccgacagcaaggccatgcaggtggagagctgcagcagcgccgtgggcgtgagcaacagaggcgtgagcgagaagcagctgaccagcaacaccgtgcagcagcaccccagcacccccaagagacacaccgtgctgtacatcagccccccccccgaggacctgctggacaacagcagaatgagctgccaggacgagggctgcggcctggagagcgagcagagctgcagcatgtggatggaggacagccccagcaacttcagcaacatgagcaccagcagctacaacgacaacaccgaggtgcccagaaagagcagaaagagaaaccccaagcagagacccggcgtgaagagaagagactgcgaggagagcaacatggacatcttcgacgccgacagcgccaaggccccccactacgtgctgagccagctgaccaccgacaacaagggcaacagcaaggccggcaacggcaccctggagaaccagaagggcaccggcgtgaagaagagccccatgctgtgcggccagtaccccgtgaagagcgagggcaaggagctgaagatcgtggtgcagcccgagacccagcacagagccagatacctgaccgagggcagcagaggcagcgtgaaggacagaacccagcagggcttccccaccgtgaagctggagggccacaacgagcccgtggtgctgcaggtgttcgtgggcaacgacagcggcagagtgaagccccacggcttctaccaggcctgcagagtgaccggcagaaacaccaccccctgcaaggaggtggacatcgagggcaccaccgtgatcgaggtgggcctggaccccagcaacaacatgaccctggccgtggactgcgtgggcatcctgaagctgagaaacgccgacgtggaggccagaatcggcatcgccggcagcaagaagaagagcaccagagccagactggtgttcagagtgaacatcatgagaaaggacggcagcaccctgaccctgcagacccccagcagccccatcctgtgcacccagcccgccggcgtgcccgagatcctgaagaagagcctgcacagctgcagcgtgaagggcgaggaggaggtgttcctgatcggcaagaacttcctgaagggcaccaaggtgatcttccaggagaacgtgagcgacgagaacagctggaagagcgaggccgagatcgacatggagctgttccaccagaaccacctgatcgtgaaggtgcccccctaccacgaccagcacatcaccctgcccgtgagcgtgggcatctacgtggtgaccaacgccggcagaagccacgacgtgcagcccttcacctacacccccgaccccgccgccgccggcgccctgaacgtgaacgtgaagaaggagatcagcagccccgccagaccctgcagcttcgaggaggccatgaaggccatgaagaccaccggctgcaacctggacaaggtgaacatcatccccaacgccctgatgacccccctgatccccagcagcatgatcaagagcgaggacgtgacccccatggaggtgaccgccgagaagagaagcagcaccatcttcaagaccaccaagagcgtgggcagcacccagcagaccctggagaacatcagcaacatcgccggcaacggcagcttcagcagccccagcagcagccacctgcccagcgagaacgagaagcagcagcagatccagcccaaggcctacaaccccgagaccctgaccaccatccagacccaggacatcagccagcccggcaccttccccgccgtgagcgccagcagccagctgcccaacagcgacgccctgctgcagcaggccacccagttccagaccagagagacccagagcagagagatcctgcagagcgacggcaccgtggtgaacctgagccagctgaccgaggccagccagcagcagcagcagagccccctgcaggagcaggcccagaccctgcagcagcagatcagcagcaacatcttccccagccccaacagcgtgagccagctgcagaacaccatccagcagctgcaggccggcagcttcaccggcagcaccgccagcggcagcagcggcagcgtggacctggtgcagcaggtgctggaggcccagcagcagctgagcagcgtgctgttcagcgcccccgacggcaacgagaacgtgcaggagcagctgagcgccgacatcttccagcaggtgagccagatccagagcggcgtgagccccggcatgttcagcagcaccgagcccaccgtgcacaccagacccgacaacctgctgcccggcagagccgagagcgtgcacccccagagcgagaacaccctgagcaaccagcagcagcagcagcagcagcagcagcaggtgatggagagcagcgccgccatggtgatggagatgcagcagagcatctgccaggccgccgcccagatccagagcgagctgttccccagcaccgccagcgccaacggcaacctgcagcagagccccgtgtaccagcagaccagccacatgatgagcgccctgagcaccaacgaggacatgcagatgcagtgcgagctgttcagcagcccccccgccgtgagcggcaacgagaccagcaccaccaccacccagcaggtggccacccccggcaccaccatgttccagaccagcagcagcggcgacggcgaggagaccggcacccaggccaagcagatccagaacagcgtgttccagaccatggtgcagatgcagcacagcggcgacaaccagccccaggtgaacctgttcagcagcaccaagagcatgatgagcgtgcagaacagcggcacccagcagcagggcaacggcctgttccagcagggcaacgagatgatgagcctgcagagcggcaacttcctgcagcagagcagccacagccaggcccagctgttccacccccagaaccccatcgccgacgcccagaacctgagccaggagacccagggcagcctgttccacagccccaaccccatcgtgcacagccagaccagcaccaccagcagcgagcagatgcagccccccatgttccacagccagagcaccatcgccgtgctgcagggcagcagcgtgccccaggaccagcagagcaccaacatcttcctgagccagagccccatgaacaacctgcagaccaacaccgtggcccaggaggccttcttcgccgcccccaacagcatcagccccctgcagagcaccagcaacagcgagcagcaggccgccttccagcagcaggcccccatcagccacatccagacccccatgctgagccaggagcaggcccagcccccccagcagggcctgttccagccccaggtggccctgggcagcctgccccccaaccccatgccccagagccagcagggcaccatgttccagagccagcacagcatcgtggccatgcagagcaacagccccagccaggagcagcagcagcagcagcagcagcagcagcagcagcagcagcagcagcagcagagcatcctgttcagcaaccagaacaccatggccaccatggccagccccaagcagcccccccccaacatgatcttcaaccccaaccagaaccccatggccaaccaggagcagcagaaccagagcatcttccaccagcagagcaacatggcccccatgaaccaggagcagcagcccatgcagttccagagccagagcaccgtgagcagcctgcagaaccccggccccacccagagcgagagcagccagacccccctgttccacagcagcccccagatccagctggtgcagggcagccccagcagccaggagcagcaggtgaccctgttcctgagccccgccagcatgagcgccctgcagaccagcatcaaccagcaggacatgcagcagagccccctgtacagcccccagaacaacatgcccggcatccagggcgccaccagcagcccccagccccaggccaccctgttccacaacaccgccggcggcaccatgaaccagctgcagaacagccccggcagcagccagcagaccagcggcatgttcctgttcggcatccagaacaactgcagccagctgctgaccagcggccccgccaccctgcccgaccagctgatggccatcagccagcccggccagccccagaacgagggccagccccccgtgaccaccctgctgagccagcagatgcccgagaacagccccctggccagcagcatcaacaccaaccagaacatcgagaagatcgacctgctggtgagcctgcagaaccagggcaacaacctgaccggcagcttctag

SEQ ID NO: 11885 - DNA, 4368 bp, Artificial Sequence; identical to SEQ ID NO: 11881
  Description of Artificial Sequence: Synthetic coding sequence

SEQ ID NO: 11886 - DNA, 4647 bp, Artificial Sequence; identical to SEQ ID NO: 11882
  Description of Artificial Sequence: Synthetic coding sequence

SEQ ID NO: 11887 - DNA, 4650 bp, Artificial Sequence
  Description of Artificial Sequence: Synthetic coding sequence
atgcccagcgacttcatcagcctgctgagcgccgacctggacctggagagccccaagagcctgtacagcagagacagcctgaagctgcaccccagccagaacttccacagagccggcctgctggaggagagcgtgtacgacctgctgcccaaggagctgcagctgccccccagcagagagaccagcgtggccagcatgagccagaccagcggcggcgaggccggcagccccccccccgccgtggtggccgccgacgccagcagcgcccccagcagcagcagcatgggcggcgcctgcagcagcttcaccaccagcagcagccccaccatctacagcaccagcgtgaccgacagcaaggccatgcaggtggagagctgcagcagcgccgtgggcgtgagcaacagaggcgtgagcgagaagcagctgaccagcaacaccgtgcagcagcaccccagcacccccaagagacacaccgtgctgtacatcagccccccccccgaggacctgctggacaacagcagaatgagctgccaggacgagggctgcggcctggagagcgagcagagctgcagcatgtggatggaggacagccccagcaacttcagcaacatgagcaccagcagctacaacgacaacaccgaggtgcccagaaagagcagaaagagaaaccccaagcagagacccggcgtgaagagaagagactgcgaggagagcaacatggacatcttcgacgccgacagcgccaaggccccccactacgtgctgagccagctgaccaccgacaacaagggcaacagcaaggccggcaacggcaccctggagaaccagaagggcaccggcgtgaagaagagccccatgctgtgcggccagtaccccgtgaagagcgagggcaaggagctgaagatcgtggtgcagcccgagacccagcacagagccagatacctgaccgagggcagcagaggcagcgtgaaggacagaacccagcagggcttccccaccgtgaagctggagggccacaacgagcccgtggtgctgcaggtgttcgtgggcaacgacagcggcagagtgaagccccacggcttctaccaggcctgcagagtgaccggcagaaacaccaccccctgcaaggaggtggacatcgagggcaccaccgtgatcgaggtgggcctggaccccagcaacaacatgaccctggccgtggactgcgtgggcatcctgaagctgagaaacgccgacgtggaggccagaatcggcatcgccggcagcaagaagaagagcaccagagccagactggtgttcagagtgaacatcatgagaaaggacggcagcaccctgaccctgcagacccccagcagccccatcctgtgcacccagcccgccggcgtgcccgagatcctgaagaagagcctgcacagctgcagcgtgaagggcgaggaggaggtgttcctgatcggcaagaacttcctgaagggcaccaaggtgatcttccaggagaacgtgagcgacgagaacagctggaagagcgaggccgagatcgacatggagctgttccaccagaaccacctgatcgtgaaggtgcccccctaccacgaccagcacatcaccctgcccgtgagcgtgggcatctacgtggtgaccaacgccggcagaagccacgacgtgcagcccttcacctacacccccgaccccgccgccgccggcgccctgaacgtgaacgtgaagaaggagatcagcagccccgccagaccctgcagcttcgaggaggccatgaaggccatgaagaccaccggctgcaacctggacaaggtgaacatcatccccaacgccctgatgacccccctgatccccagcagcatgatcaagagcgaggacgtgacccccatggaggtgaccgccgagaagagaagcagcaccatcttcaagaccaccaagagcgtgggcagcacccagcagaccctggagaacatcagcaacatcgccggcaacggcagcttcagcagccccagcagcagccacctgcccagcgagaacgagaagcagcagcagatccagcccaaggcctacaaccccgagaccctgaccaccatccagacccaggacatcagccagcccggcaccttccccgccgtgagcgccagcagccagctgcccaacagcgacgccctgctgcagcaggccacccagttccagaccagagagacccagagcagagagatcctgcagagcgacggcaccgtggtgaacctgagccagctgaccgaggccagccagcagcagcagcagagccccctgcaggagcaggcccagaccctgcagcagcagatcagcagcaacatcttccccagccccaacagcgtgagccagctgcagaacaccatccagcagctgcaggccggcagcttcaccggcagcaccgccagcggcagcagcggcagcgtggacctggtgcagcaggtgctggaggcccagcagcagctgagcagcgtgctgttcagcgcccccgacggcaacgagaacgtgcaggagcagctgagcgccgacatcttccagcaggtgagccagatccagagcggcgtgagccccggcatgttcagcagcaccgagcccaccgtgcacaccagacccgacaacctgctgcccggcagagccgagagcgtgcacccccagagcgagaacaccctgagcaaccagcagcagcagcagcagcagcagcagcaggtgatggagagcagcgccgccatggtgatggagatgcagcagagcatctgccaggccgccgcccagatccagagcgagctgttccccagcaccgccagcgccaacggcaacctgcagcagagccccgtgtaccagcagaccagccacatgatgagcgccctgagcaccaacgaggacatgcagatgcagtgcgagctgttcagcagcccccccgccgtgagcggcaacgagaccagcaccaccaccacccagcaggtggccacccccggcaccaccatgttccagaccagcagcagcggcgacggcgaggagaccggcacccaggccaagcagatccagaacagcgtgttccagaccatggtgcagatgcagcacagcggcgacaaccagccccaggtgaacctgttcagcagcaccaagagcatgatgagcgtgcagaacagcggcacccagcagcagggcaacggcctgttccagcagggcaacgagatgatgagcctgcagagcggcaacttcctgcagcagagcagccacagccaggcccagctgttccacccccagaaccccatcgccgacgcccagaacctgagccaggagacccagggcagcctgttccacagccccaaccccatcgtgcacagccagaccagcaccaccagcagcgagcagatgcagccccccatgttccacagccagagcaccatcgccgtgctgcagggcagcagcgtgccccaggaccagcagagcaccaacatcttcctgagccagagccccatgaacaacctgcagaccaacaccgtggcccaggaggccttcttcgccgcccccaacagcatcagccccctgcagagcaccagcaacagcgagcagcaggccgccttccagcagcaggcccccatcagccacatccagacccccatgctgagccaggagcaggcccagcccccccagcagggcctgttccagccccaggtggccctgggcagcctgccccccaaccccatgccccagagccagcagggcaccatgttccagagccagcacagcatcgtggccatgcagagcaacagccccagccaggagcagcagcagcagcagcagcagcagcagcagcagcagcagcagcagcagcagagcatcctgttcagcaaccagaacaccatggccaccatggccagccccaagcagcccccccccaacatgatcttcaaccccaaccagaaccccatggccaaccaggagcagcagaaccagagcatcttccaccagcagagcaacatggcccccatgaaccaggagcagcagcccatgcagttccagagccagagcaccgtgagcagcctgcagaaccccggccccacccagagcgagagcagccagacccccctgttccacagcagcccccagatccagctggtgcagggcagccccagcagccaggagcagcaggtgaccctgttcctgagccccgccagcatgagcgccctgcagaccagcatcaaccagcaggacatgcagcagagccccctgtacagcccccagaacaacatgcccggcatccagggcgccaccagcagcccccagccccaggccaccctgttccacaacaccgccggcggcaccatgaaccagctgcagaacagccccggcagcagccagcagaccagcggcatgttcctgttcggcatccagaacaactgcagccagctgctgaccagcggccccgccaccctgcccgaccagctgatggccatcagccagcccggccagccccagaacgagggccagccccccgtgaccaccctgctgagccagcagatgcccgagaacagccccctggccagcagcatcaacaccaaccagaacatcgagaagatcgacctgctggtgagcctgcagaaccagggcaacaacctgaccggcagcttctag

SEQ ID NO: 11888 - DNA, 2151 bp, Artificial Sequence
  Description of Artificial Sequence: Synthetic coding sequence
atgcccagcaccagcttccccgtgcccagcaagttccccctgggccccgccgccgccgtgttcggcagaggcgagaccctgggccccgcccccagagccggcggcaccatgaagagcgccgaggaggagcactacggctacgccagcagcaacgtgagccccgccctgcccctgcccaccgcccacagcaccctgcccgccccctgccacaacctgcagaccagcacccccggcatcatcccccccgccgaccaccccagcggctacggcgccgccctggacggcggccccgccggctacttcctgagcagcggccacaccagacccgacggcgcccccgccctggagagccccagaatcgagatcaccagctgcctgggcctgtaccacaacaacaaccagttcttccacgacgtggaggtggaggacgtgctgcccagcagcaagagaagccccagcaccgccaccctgagcctgcccagcctggaggcctacagagaccccagctgcctgagccccgccagcagcctgagcagcagaagctgcaacagcgaggccagcagctacgagagcaactacagctacccctacgccagcccccagaccagcccctggcagagcccctgcgtgagccccaagaccaccgaccccgaggagggcttccccagaggcctgggcgcctgcaccctgctgggcagccccagacacagccccagcaccagccccagagccagcgtgaccgaggagagctggctgggcgccagaagcagcagacccgccagcccctgcaacaagagaaagtacagcctgaacggcagacagcccccctacagcccccaccacagccccacccccagcccccacggcagccccagagtgagcgtgaccgacgacagctggctgggcaacaccacccagtacaccagcagcgccatcgtggccgccatcaacgccctgaccaccgacagcagcctggacctgggcgacggcgtgcccgtgaagagcagaaagaccaccctggagcagccccccagcgtggccctgaaggtggagcccgtgggcgaggacctgggcagcccccccccccccgccgacttcgcccccgaggactacagcagcttccagcacatcagaaagggcggcttctgcgaccagtacctggccgtgccccagcacccctaccagtgggccaagcccaagcccctgagccccaccagctacatgagccccaccctgcccgccctggactggcagctgcccagccacagcggcccctacgagctgagaatcgaggtgcagcccaagagccaccacagagcccactacgagaccgagggcagcagaggcgccgtgaaggccagcgccggcggccaccccatcgtgcagctgcacggctacctggagaacgagcccctgatgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacggcaacgccatcttcctgaccgtgagcagagagcacgagagagtgggctgcttcttctag

SEQ ID NO: 11889 - DNA, 2478 bp, Artificial Sequence
  Description of Artificial Sequence: Synthetic coding sequence
atgcccagcaccagcttccccgtgcccagcaagttccccctgggccccgccgccgccgtgttcggcagaggcgagaccctgggccccgcccccagagccggcggcaccatgaagagcgccgaggaggagcactacggctacgccagcagcaacgtgagccccgccctgcccctgcccaccgcccacagcaccctgcccgccccctgccacaacctgcagaccagcacccccggcatcatcccccccgccgaccaccccagcggctacggcgccgccctggacggcggccccgccggctacttcctgagcagcggccacaccagacccgacggcgcccccgccctggagagccccagaatcgagatcaccagctgcctgggcctgtaccacaacaacaaccagttcttccacgacgtggaggtggaggacgtgctgcccagcagcaagagaagccccagcaccgccaccctgagcctgcccagcctggaggcctacagagaccccagctgcctgagccccgccagcagcctgagcagcagaagctgcaacagcgaggccagcagctacgagagcaactacagctacccctacgccagcccccagaccagcccctggcagagcccctgcgtgagccccaagaccaccgaccccgaggagggcttccccagaggcctgggcgcctgcaccctgctgggcagccccagacacagccccagcaccagccccagagccagcgtgaccgaggagagctggctgggcgccagaagcagcagacccgccagcccctgcaacaagagaaagtacagcctgaacggcagacagcccccctacagcccccaccacagccccacccccagcccccacggcagccccagagtgagcgtgaccgacgacagctggctgggcaacaccacccagtacaccagcagcgccatcgtggccgccatcaacgccctgaccaccgacagcagcctggacctgggcgacggcgtgcccgtgaagagcagaaagaccaccctggagcagccccccagcgtggccctgaaggtggagcccgtgggcgaggacctgggcagcccccccccccccgccgacttcgcccccgaggactacagcagcttccagcacatcagaaagggcggcttctgcgaccagtacctggccgtgccccagcacccctaccagtgggccaagcccaagcccctgagccccaccagctacatgagccccaccctgcccgccctggactggcagctgcccagccacagcggcccctacgagctgagaatcgaggtgcagcccaagagccaccacagagcccactacgagaccgagggcagcagaggcgccgtgaaggccagcgccggcggccaccccatcgtgcagctgcacggctacctggagaacgagcccctgatgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacgtgcccatcatcaagaccgagcccaccgacgactacgagcccgcccccacctgcggccccgtgagccagggcctgagccccctgcccagaccctactacagccagcagctggccatgccccccgaccccagcagctgcctggtggccggcttccccccctgcccccagagaagcaccctgatgcccgccgcccccggcgtgagccccaagctgcacgacctgagccccgccgcctacaccaagggcgtggccagccccggccactgccacctgggcctgccccagcccgccggcgaggcccccgccgtgcaggacgtgcccagacccgtggccacccaccccggcagccccggccagcccccccccgccctgctgccccagcagtag

SEQ ID NO: 11890 - DNA, 2832 bp, Artificial Sequence
  Description of Artificial Sequence: Synthetic coding sequence
atgcccagcaccagcttccccgtgcccagcaagttccccctgggccccgccgccgccgtgttcggcagaggcgagaccctgggccccgcccccagagccggcggcaccatgaagagcgccgaggaggagcactacggctacgccagcagcaacgtgagccccgccctgcccctgcccaccgcccacagcaccctgcccgccccctgccacaacctgcagaccagcacccccggcatcatcccccccgccgaccaccccagcggctacggcgccgccctggacggcggccccgccggctacttcctgagcagcggccacaccagacccgacggcgcccccgccctggagagccccagaatcgagatcaccagctgcctgggcctgtaccacaacaacaaccagttcttccacgacgtggaggtggaggacgtgctgcccagcagcaagagaagccccagcaccgccaccctgagcctgcccagcctggaggcctacagagaccccagctgcctgagccccgccagcagcctgagcagcagaagctgcaacagcgaggccagcagctacgagagcaactacagctacccctacgccagcccccagaccagcccctggcagagcccctgcgtgagccccaagaccaccgaccccgaggagggcttccccagaggcctgggcgcctgcaccctgctgggcagccccagacacagccccagcaccagccccagagccagcgtgaccgaggagagctggctgggcgccagaagcagcagacccgccagcccctgcaacaagagaaagtacagcctgaacggcagacagcccccctacagcccccaccacagccccacccccagcccccacggcagccccagagtgagcgtgaccgacgacagctggctgggcaacaccacccagtacaccagcagcgccatcgtggccgccatcaacgccctgaccaccgacagcagcctggacctgggcgacggcgtgcccgtgaagagcagaaagaccaccctggagcagccccccagcgtggccctgaaggtggagcccgtgggcgaggacctgggcagcccccccccccccgccgacttcgcccccgaggactacagcagcttccagcacatcagaaagggcggcttctgcgaccagtacctggccgtgccccagcacccctaccagtgggccaagcccaagcccctgagccccaccagctacatgagccccaccctgcccgccctggactggcagctgcccagccacagcggcccctacgagctgagaatcgaggtgcagcccaagagccaccacagagcccactacgagaccgagggcagcagaggcgccgtgaaggccagcgccggcggccaccccatcgtgcagctgcacggctacctggagaacgagcccctgatgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacgtgcccatcatcaagaccgagcccaccgacgactacgagcccgcccccacctgcggccccgtgagccagggcctgagccccctgcccagaccctactacagccagcagctggccatgccccccgaccccagcagctgcctggtggccggcttccccccctgcccccagagaagcaccctgatgcccgccgcccccggcgtgagccccaagctgcacgacctgagccccgccgcctacaccaagggcgtggccagccccggccactgccacctgggcctgccccagcccgccggcgaggcccccgccgtgcaggacgtgcccagacccgtggccacccaccccggcagccccggccagcccccccccgccctgctgccccagcaggtgagcgccccccccagcagcagctgcccccccggcctggagcacagcctgtgccccagcagccccagcccccccctgccccccgccacccaggagcccacctgcctgcagccctgcagccccgcctgcccccccgccaccggcagaccccagcacctgcccagcaccgtgagaagagacgagagccccaccgccggccccagactgctgcccgaggtgcacgaggacggcagccccaacctggcccccatccccgtgaccgtgaagagagagcccgaggagctggaccagctgtacctggacgacgtgaacgagatcatcagaaacgacctgagcagcaccagcacccacagctag

SEQ ID NO: 11891 - DNA, 2793 bp, Artificial Sequence
  Description of Artificial Sequence: Synthetic coding sequence
atgaccggcctggaggaccaggagttcgacttcgagttcctgttcgagttcaaccagagagacgagggcgccgccgccgccgcccccgagcactacggctacgccagcagcaacgtgagccccgccctgcccctgcccaccgcccacagcaccctgcccgccccctgccacaacctgcagaccagcacccccggcatcatcccccccgccgaccaccccagcggctacggcgccgccctggacggcggccccgccggctacttcctgagcagcggccacaccagacccgacggcgcccccgccctggagagccccagaatcgagatcaccagctgcctgggcctgtaccacaacaacaaccagttcttccacgacgtggaggtggaggacgtgctgcccagcagcaagagaagccccagcaccgccaccctgagcctgcccagcctggaggcctacagagaccccagctgcctgagccccgccagcagcctgagcagcagaagctgcaacagcgaggccagcagctacgagagcaactacagctacccctacgccagcccccagaccagcccctggcagagcccctgcgtgagccccaagaccaccgaccccgaggagggcttccccagaggcctgggcgcctgcaccctgctgggcagccccagacacagccccagcaccagccccagagccagcgtgaccgaggagagctggctgggcgccagaagcagcagacccgccagcccctgcaacaagagaaagtacagcctgaacggcagacagcccccctacagcccccaccacagccccacccccagcccccacggcagccccagagtgagcgtgaccgacgacagctggctgggcaacaccacccagtacaccagcagcgccatcgtggccgccatcaacgccctgaccaccgacagcagcctggacctgggcgacggcgtgcccgtgaagagcagaaagaccaccctggagcagccccccagcgtggccctgaaggtggagcccgtgggcgaggacctgggcagcccccccccccccgccgacttcgcccccgaggactacagcagcttccagcacatcagaaagggcggcttctgcgaccagtacctggccgtgccccagcacccctaccagtgggccaagcccaagcccctgagccccaccagctacatgagccccaccctgcccgccctggactggcagctgcccagccacagcggcccctacgagctgagaatcgaggtgcagcccaagagccaccacagagcccactacgagaccgagggcagcagaggcgccgtgaaggccagcgccggcggccaccccatcgtgcagctgcacggctacctggagaacgagcccctgatgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacgtgcccatcatcaagaccgagcccaccgacgactacgagcccgcccccacctgcggccccgtgagccagggcctgagccccctgcccagaccctactacagccagcagctggccatgccccccgaccccagcagctgcctggtggccggcttccccccctgcccccagagaagcaccctgatgcccgccgcccccggcgtgagccccaagctgcacgacctgagccccgccgcctacaccaagggcgtggccagccccggccactgccacctgggcctgccccagcccgccggcgaggcccccgccgtgcaggacgtgcccagacccgtggccacccaccccggcagccccggccagcccccccccgccctgctgccccagcaggtgagcgccccccccagcagcagctgcccccccggcctggagcacagcctgtgccccagcagccccagcccccccctgccccccgccacccaggagcccacctgcctgcagccctgcagccccgcctgcccccccgccaccggcagaccccagcacctgcccagcaccgtgagaagagacgagagccccaccgccggccccagactgctgcccgaggtgcacgaggacggcagccccaacctggcccccatccccgtgaccgtgaagagagagcccgaggagctggaccagctgtacctggacgacgtgaacgagatcatcagaaacgacctgagcagcaccagcacccacagctag

SEQ ID NO: 11892 - DNA, 1062 bp, Artificial Sequence
  Description of Artificial Sequence: Synthetic coding sequence
atgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacgtgcccatcatcaagaccgagcccaccgacgactacgagcccgcccccacctgcggccccgtgagccagggcctgagccccctgcccagaccctactacagccagcagctggccatgccccccgaccccagcagctgcctggtggccggcttccccccctgcccccagagaagcaccctgatgcccgccgcccccggcgtgagccccaagctgcacgacctgagccccgccgcctacaccaagggcgtggccagccccggccactgccacctgggcctgccccagcccgccggcgaggcccccgccgtgcaggacgtgcccagacccgtggccacccaccccggcagccccggccagcccccccccgccctgctgccccagcagtag

SEQ ID NO: 11893 - DNA, 2724 bp, Artificial Sequence
  Description of Artificial Sequence: Synthetic coding sequence
atgaagagcggcaccctggagcactacggctacgccagcagcaacgtgagccccgccctgcccctgcccaccgcccacagcaccctgcccgccccctgccacaacctgcagaccagcacccccggcatcatcccccccgccgaccaccccagcggctacggcgccgccctggacggcggccccgccggctacttcctgagcagcggccacaccagacccgacggcgcccccgccctggagagccccagaatcgagatcaccagctgcctgggcctgtaccacaacaacaaccagttcttccacgacgtggaggtggaggacgtgctgcccagcagcaagagaagccccagcaccgccaccctgagcctgcccagcctggaggcctacagagaccccagctgcctgagccccgccagcagcctgagcagcagaagctgcaacagcgaggccagcagctacgagagcaactacagctacccctacgccagcccccagaccagcccctggcagagcccctgcgtgagccccaagaccaccgaccccgaggagggcttccccagaggcctgggcgcctgcaccctgctgggcagccccagacacagccccagcaccagccccagagccagcgtgaccgaggagagctggctgggcgccagaagcagcagacccgccagcccctgcaacaagagaaagtacagcctgaacggcagacagcccccctacagcccccaccacagccccacccccagcccccacggcagccccagagtgagcgtgaccgacgacagctggctgggcaacaccacccagtacaccagcagcgccatcgtggccgccatcaacgccctgaccaccgacagcagcctggacctgggcgacggcgtgcccgtgaagagcagaaagaccaccctggagcagccccccagcgtggccctgaaggtggagcccgtgggcgaggacctgggcagcccccccccccccgccgacttcgcccccgaggactacagcagcttccagcacatcagaaagggcggcttctgcgaccagtacctggccgtgccccagcacccctaccagtgggccaagcccaagcccctgagccccaccagctacatgagccccaccctgcccgccctggactggcagctgcccagccacagcggcccctacgagctgagaatcgaggtgcagcccaagagccaccacagagcccactacgagaccgagggcagcagaggcgccgtgaaggccagcgccggcggccaccccatcgtgcagctgcacggctacctggagaacgagcccctgatgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacgtgcccatcatcaagaccgagcccaccgacgactacgagcccgcccccacctgcggccccgtgagccagggcctgagccccctgcccagaccctactacagccagcagctggccatgccccccgaccccagcagctgcctggtggccggcttccccccctgcccccagagaagcaccctgatgcccgccgcccccggcgtgagccccaagctgcacgacctgagccccgccgcctacaccaagggcgtggccagccccggccactgccacctgggcctgccccagcccgccggcgaggcccccgccgtgcaggacgtgcccagacccgtggccacccaccccggcagccccggccagcccccccccgccctgctgccccagcaggtgagcgccccccccagcagcagctgcccccccggcctggagcacagcctgtgccccagcagccccagcccccccctgccccccgccacccaggagcccacctgcctgcagccctgcagccccgcctgcccccccgccaccggcagaccccagcacctgcccagcaccgtgagaagagacgagagccccaccgccggccccagactgctgcccgaggtgcacgaggacggcagccccaacctggcccccatccccgtgaccgtgaagagagagcccgaggagctggaccagctgtacctggacgacgtgaacgagatcatcagaaacgacctgagcagcaccagcacccacagctag

SEQ ID NO: 11894 - DNA, 2745 bp, Artificial Sequence
  Description of Artificial Sequence: Synthetic coding sequence
atgaccggcctggaggaccaggagttcgacttcgagttcctgttcgagttcaaccagagagacgagggcgccgccgccgccgcccccgagcactacggctacgccagcagcaacgtgagccccgccctgcccctgcccaccgcccacagcaccctgcccgccccctgccacaacctgcagaccagcacccccggcatcatcccccccgccgaccaccccagcggctacggcgccgccctggacggcggccccgccggctacttcctgagcagcggccacaccagacccgacggcgcccccgccctggagagccccagaatcgagatcaccagctgcctgggcctgtaccacaacaacaaccagttcttccacgacgtggaggtggaggacgtgctgcccagcagcaagagaagccccagcaccgccaccctgagcctgcccagcctggaggcctacagagaccccagctgcctgagccccgccagcagcctgagcagcagaagctgcaacagcgaggccagcagctacgagagcaactacagctacccctacgccagcccccagaccagcccctggcagagcccctgcgtgagccccaagaccaccgaccccgaggagggcttccccagaggcctgggcgcctgcaccctgctgggcagccccagacacagccccagcaccagccccagagccagcgtgaccgaggagagctggctgggcgccagaagcagcagacccgccagcccctgcaacaagagaaagtacagcctgaacggcagacagcccccctacagcccccaccacagccccacccccagcccccacggcagccccagagtgagcgtgaccgacgacagctggctgggcaacaccacccagtacaccagcagcgccatcgtggccgccatcaacgccctgaccaccgacagcagcctggacctgggcgacggcgtgcccgtgaagagcagaaagaccaccctggagcagccccccagcgtggccctgaaggtggagcccgtgggcgaggacctgggcagcccccccccccccgccgacttcgcccccgaggactacagcagcttccagcacatcagaaagggcggcttctgcgaccagtacctggccgtgccccagcacccctaccagtgggccaagcccaagcccctgagccccaccagctacatgagccccaccctgcccgccctggactggcagctgcccagccacagcggcccctacgagctgagaatcgaggtgcagcccaagagccaccacagagcccactacgagaccgagggcagcagaggcgccgtgaaggccagcgccggcggccaccccatcgtgcagctgcacggctacctggagaacgagcccctgatgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacgtgcccatcatcaagaccgagcccaccgacgactacgagcccgcccccacctgcggccccgtgagccagggcctgagccccctgcccagaccctactacagccagcagctggccatgccccccgaccccagcagctgcctggtggccggcttccccccctgcccccagagaagcaccctgatgcccgccgcccccggcgtgagccccaagctgcacgacctgagccccgccgcctacaccaagggcgtggccagccccggccactgccacctgggcctgccccagcccgccggcgaggcccccgccgtgcaggacgtgcccagacccgtggccacccaccccggcagccccggccagcccccccccgccctgctgccccagcaggtgagcgccccccccagcagcagctgcccccccggcctggagcacagcctgtgccccagcagccccagcccccccctgccccccgccacccaggagcccacctgcctgcagccctgcagccccgcctgcccccccgccaccggcagaccccagcacctgcccagcaccgtgagaagagacgagagccccaccgccggccccagactgctgcccgaggtgcacgaggacggcagccccaacctggcccccatccccgtgaccgtgaagagagagcccgaggagctggaccagctgtacctggacgactag

SEQ ID NO: 11895 - DNA, 2142 bp, Artificial Sequence
  Description of Artificial Sequence: Synthetic coding sequence
atgcccagcaccagcttccccgtgcccagcaagttccccctgggccccgccgccgccgtgttcggcagaggcgagaccctgggccccgcccccagagccggcggcaccatgaagagcgccgaggaggagcactacggctacgccagcagcaacgtgagccccgccctgcccctgcccaccgcccacagcaccctgcccgccccctgccacaacctgcagaccagcacccccggcatcatcccccccgccgaccaccccagcggctacggcgccgccctggacggcggccccgccggctacttcctgagcagcggccacaccagacccgacggcgcccccgccctggagagccccagaatcgagatcaccagctgcctgggcctgtaccacaacaacaaccagttcttccacgacgtggaggtggaggacgtgctgcccagcagcaagagaagccccagcaccgccaccctgagcctgcccagcctggaggcctacagagaccccagctgcctgagccccgccagcagcctgagcagcagaagctgcaacagcgaggccagcagctacgagagcaactacagctacccctacgccagcccccagaccagcccctggcagagcccctgcgtgagccccaagaccaccgaccccgaggagggcttccccagaggcctgggcgcctgcaccctgctgggcagccccagacacagccccagcaccagccccagagccagcgtgaccgaggagagctggctgggcgccagaagcagcagacccgccagcccctgcaacaagagaaagtacagcctgaacggcagacagcccccctacagcccccaccacagccccacccccagcccccacggcagccccagagtgagcgtgaccgacgacagctggctgggcaacaccacccagtacaccagcagcgccatcgtggccgccatcaacgccctgaccaccgacagcagcctggacctgggcgacggcgtgcccgtgaagagcagaaagaccaccctggagcagccccccagcgtggccctgaaggtggagcccgtgggcgaggacctgggcagcccccccccccccgccgacttcgcccccgaggactacagcagcttccagcacatcagaaagggcggcttctgcgaccagtacctggccgtgccccagcacccctaccagtgggccaagcccaagcccctgagccccaccagctacatgagccccaccctgcccgccctggactggcagctgcccagccacagcggcccctacgagctgagaatcgaggtgcagcccaagagccaccacagagcccactacgagaccgagggcagcagaggcgccgtgaaggccagcgccggcggccaccccatcgtgcagctgcacggctacctggagaacgagcccctgatgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacgtgaacgagatcatcagaaacgacctgagcagcaccagcacccacagctag

SEQ ID NO: 11896 - DNA, 1416 bp, Artificial Sequence
  Description of Artificial Sequence: Synthetic coding sequence
atgctgcagctgttcatcggcaccgccgacgacagactgctgagaccccacgccttctaccaggtgcacagaatcaccggcaagaccgtgagcaccaccagccacgaggccatcctgagcaacaccaaggtgctggagatccccctgctgcccgagaacagcatgagagccgtgatcgactgcgccggcatcctgaagctgagaaacagcgacatcgagctgagaaagggcgagaccgacatcggcagaaagaacaccagagtgagactggtgttcagagtgcacgtgccccagcccagcggcagaaccctgagcctgcaggtggccagcaaccccatcgagtgcagccagagaagcgcccaggagctgcccctggtggagaagcagagcaccgacagctaccccgtggtgggcggcaagaagatggtgctgagcggccacaacttcctgcaggacagcaaggtgatcttcgtggagaaggcccccgacggccaccacgtgtgggagatggaggccaagaccgacagagacctgtgcaagcccaacagcctggtggtggagatcccccccttcagaaaccagagaatcaccagccccgtgcacgtgagcttctacgtgtgcaacggcaagagaaagagaagccagtaccagagattcacctacctgcccgccaacgtgcccatcatcaagaccgagcccaccgacgactacgagcccgcccccacctgcggccccgtgagccagggcctgagccccctgcccagaccctactacagccagcagctggccatgccccccgaccccagcagctgcctggtggccggcttccccccctgcccccagagaagcaccctgatgcccgccgcccccggcgtgagccccaagctgcacgacctgagccccgccgcctacaccaagggcgtggccagccccggccactgccacctgggcctgccccagcccgccggcgaggcccccgccgtgcaggacgtgcccagacccgtggccacccaccccggcagccccggccagcccccccccgccctgctgccccagcaggtgagcgccccccccagcagcagctgcccccccggcctggagcacagcctgtgccccagcagccccagcccccccctgccccccgccacccaggagcccacctgcctgcagccctgcagccccgcctgcccccccgccaccggcagaccccagcacctgcccagcaccgtgagaagagacgagagccccaccgccggccccagactgctgcccgaggtgcacgaggacggcagccccaacctggcccccatccccgtgaccgtgaagagagagcccgaggagctggaccagctgtacctggacgacgtgaacgagatcatcagaaacgacctgagcagcaccagcacccacagctag

SEQ ID NO: 11897 - DNA, 2766 bp, Artificial Sequence
  Description of Artificial Sequence: Synthetic coding sequence
atgaacgcccccgagagacagccccagcccgacggcggcgacgcccccggccacgagcccggcggcagcccccaggacgagctggacttcagcatcctgttcgactacgagtacctgaaccccaacgaggaggagcccaacgcccacaaggtggccagcccccccagcggccccgcctaccccgacgacgtgctggactacggcctgaagccctacagccccctggccagcctgagcggcgagccccccggcagattcggcgagcccgacagagtgggcccccagaagttcctgagcgccgccaagcccgccggcgccagcggcctgagccccagaatcgagatcacccccagccacgagctgatccaggccgtgggccccctgagaatgagagacgccggcctgctggtggagcagccccccctggccggcgtggccgccagccccagattcaccctgcccgtgcccggcttcgagggctacagagagcccctgtgcctgagccccgccagcagcggcagcagcgccagcttcatcagcgacaccttcagcccctacaccagcccctgcgtgagccccaacaacggcggccccgacgacctgtgcccccagttccagaacatccccgcccactacagccccagaaccagccccatcatgagccccagaaccagcctggccgaggacagctgcctgggcagacacagccccgtgcccagacccgccagcagaagcagcagccccggcgccaagagaagacacagctgcgccgaggccctggtggccctgccccccggcgccagcccccagagaagcagaagccccagcccccagcccagcagccacgtggccccccaggaccacggcagccccgccggctacccccccgtggccggcagcgccgtgatcatggacgccctgaacagcctggccaccgacagcccctgcggcatcccccccaagatgtggaagaccagccccgaccccagccccgtgagcgccgcccccagcaaggccggcctgcccagacacatctaccccgccgtggagttcctgggcccctgcgagcagggcgagagaagaaacagcgcccccgagagcatcctgctggtgccccccacctggcccaagcccctggtgcccgccatccccatctgcagcatccccgtgaccgccagcctgccccccctggagtggcccctgagcagccagagcggcagctacgagctgagaatcgaggtgcagcccaagccccaccacagagcccactacgagaccgagggcagcagaggcgccgtgaaggcccccaccggcggccaccccgtggtgcagctgcacggctacatggagaacaagcccctgggcctgcagatcttcatcggcaccgccgacgagagaatcctgaagccccacgccttctaccaggtgcacagaatcaccggcaagaccgtgaccaccaccagctacgagaagatcgtgggcaacaccaaggtgctggagatccccctggagcccaagaacaacatgagagccaccatcgactgcgccggcatcctgaagctgagaaacgccgacatcgagctgagaaagggcgagaccgacatcggcagaaagaacaccagagtgagactggtgttcagagtgcacatccccgagagcagcggcagaatcgtgagcctgcagaccgccagcaaccccatcgagtgcagccagagaagcgcccacgagctgcccatggtggagagacaggacaccgacagctgcctggtgtacggcggccagcagatgatcctgaccggccagaacttcaccagcgagagcaaggtggtgttcaccgagaagaccaccgacggccagcagatctgggagatggaggccaccgtggacaaggacaagagccagcccaacatgctgttcgtggagatccccgagtacagaaacaagcacatcagaacccccgtgaaggtgaacttctacgtgatcaacggcaagagaaagagaagccagccccagcacttcacctaccaccccgtgcccgccatcaagaccgagcccaccgacgagtacgaccccaccctgatctgcagccccacccacggcggcctgggcagccagccctactacccccagcaccccatggtggccgagagccccagctgcctggtggccaccatggccccctgccagcagttcagaaccggcctgagcagccccgacgccagataccagcagcagaaccccgccgccgtgctgtaccagagaagcaagagcctgagccccagcctgctgggctaccagcagcccgccctgatggccgcccccctgagcctggccgacgcccacagaagcgtgctggtgcacgccggcagccagggccagagcagcgccctgctgcaccccagccccaccaaccagcaggccagccccgtgatccactacagccccaccaaccagcagctgagatgcggcagccaccaggagttccagcacatcatgtactgcgagaacttcgcccccggcaccaccagacccggccccccccccgtgagccagggccagagactgagccccggcagctaccccaccgtgatccagcagcagaacgccaccagccagagagccgccaagaacggcccccccgtgagcgaccagaaggaggtgctgcccgccggcgtgaccatcaagcaggagcagaacctggaccagacctacctggacgacgagctgatcgacacccacctgagctggatccagaacatcctgtag

SEQ ID NO: 11898 - DNA, 978 bp, Artificial Sequence
  Description of Artificial Sequence: Synthetic coding sequence
atgagccccagaaccagcctggccgaggacagctgcctgggcagacacagccccgtgcccagacccgccagcagaagcagcagccccggcgccaagagaagacacagctgcgccgaggccctggtggccctgccccccggcgccagcccccagagaagcagaagccccagcccccagcccagcagccacgtggccccccaggaccacggcagccccgccggctacccccccgtggccggcagcgccgtgatcatggacgccctgaacagcctggccaccgacagcccctgcggcatcccccccaagatgtggaagaccagccccgaccccagccccgtgagcgccgcccccagcaaggccggcctgcccagacacatctaccccgccgtggagttcctgggcccctgcgagcagggcgagagaagaaacagcgcccccgagagcatcctgctggtgccccccacctggcccaagcccctggtgcccgccatccccatctgcagcatccccgtgaccgccagcctgccccccctggagtggcccctgagcagccagagcggcagctacgagctgagaatcgaggtgcagcccaagccccaccacagagcccactacgagaccgagggcagcagaggcgccgtgaaggcccccaccggcggccaccccgtggtgcagctgcacggctacatggagaacaagcccctgggcctgcagatcttcatcggcaccgccgacgagagaatcctgaagccccacgccttctaccaggtgcacagaatcaccggcaagaccgtgaccaccaccagctacgagaagatcgtgggcaacaccaaggtgctggagatccccctggagcccagcaccgccccccacctgctgagccccttcatgttcatcagccagcccggcgtgcacaccagaatcaacgtgtgggccctgagcggcctgagcctgaaggagctggccaccagcctgtag

SEQ ID NO: 11899 - DNA, 2778 bp, Artificial Sequence
  Description of Artificial Sequence: Synthetic coding sequence
atgaacgcccccgagagacagccccagcccgacggcggcgacgcccccggccacgagcccggcggcagcccccaggacgagctggacttcagcatcctgttcgactacgagtacctgaaccccaacgaggaggagcccaacgcccacaaggtggccagcccccccagcggccccgcctaccccgacgacgtgctggactacggcctgaagccctacagccccctggccagcctgagcggcgagccccccggcagattcggcgagcccgacagagtgggcccccagaagttcctgagcgccgccaagcccgccggcgccagcggcctgagccccagaatcgagatcacccccagccacgagctgatccaggccgtgggccccctgagaatgagagacgccggcctgctggtggagcagccccccctggccggcgtggccgccagccccagattcaccctgcccgtgcccggcttcgagggctacagagagcccctgtgcctgagccccgccagcagcggcagcagcgccagcttcatcagcgacaccttcagcccctacaccagcccctgcgtgagccccaacaacggcggccccgacgacctgtgcccccagttccagaacatccccgcccactacagccccagaaccagccccatcatgagccccagaaccagcctggccgaggacagctgcctgggcagacacagccccgtgcccagacccgccagcagaagcagcagccccggcgccaagagaagacacagctgcgccgaggccctggtggccctgccccccggcgccagcccccagagaagcagaagccccagcccccagcccagcagccacgtggccccccaggaccacggcagccccgccggctacccccccgtggccggcagcgccgtgatcatggacgccctgaacagcctggccaccgacagcccctgcggcatcccccccaagatgtggaagaccagccccgaccccagccccgtgagcgccgcccccagcaaggccggcctgcccagacacatctaccccgccgtggagttcctgggcccctgcgagcagggcgagagaagaaacagcgcccccgagagcatcctgctggtgccccccacctggcccaagcccctggtgcccgccatccccatctgcagcatccccgtgaccgccagcctgccccccctggagtggcccctgagcagccagagcggcagctacgagctgagaatcgaggtgcagcccaagccccaccacagagcccactacgagaccgagggcagcagaggcgccgtgaaggcccccaccggcggccaccccgtggtgcagctgcacggctacatggagaacaagcccctgggcctgcagatcttcatcggcaccgccgacgagagaatcctgaagccccacgccttctaccaggtgcacagaatcaccggcaagaccgtgaccaccaccagctacgagaagatcgtgggcaacaccaaggtgctggagatccccctggagcccaagaacaacatgagagccaccatcgactgcgccggcatcctgaagctgagaaacgccgacatcgagctgagaaagggcgagaccgacatcggcagaaagaacaccagagtgagactggtgttcagagtgcacatccccgagagcagcggcagaatcgtgagcctgcagaccgccagcaaccccatcgagtgcagccagagaagcgcccacgagctgcccatggtggagagacaggacaccgacagctgcctggtgtacggcggccagcagatgatcctgaccggccagaacttcaccagcgagagcaaggtggtgttcaccgagaagaccaccgacggccagcagatctgggagatggaggccaccgtggacaaggacaagagccagcccaacatgctgttcgtggagatccccgagtacagaaacaagcacatcagaacccccgtgaaggtgaacttctacgtgatcaacggcaagagaaagagaagccagccccagcacttcacctaccaccccgtgcccgccatcaagaccgagcccaccgacgagtacgaccccaccctgatctgcagccccacccacggcggcctgggcagccagccctactacccccagcaccccatggtggccgagagccccagctgcctggtggccaccatggccccctgccagcagttcagaaccggcctgagcagccccgacgccagataccagcagcagaaccccgccgccgtgctgtaccagagaagcaagagcctgagccccagcctgctgggctaccagcagcccgccctgatggccgcccccctgagcctggccgacgcccacagaagcgtgctggtgcacgccggcagccagggccagagcagcgccctgctgcaccccagccccaccaaccagcaggccagccccgtgatccactacagccccaccaaccagcagctgagatgcggcagccaccaggagttccagcacatcatgtactgcgagaacttcgcccccggcaccaccagacccggccccccccccgtgagccagggccagagactgagccccggcagctaccccaccgtgatccagcagcagaacgccaccagccagagagccgccaagaacggcccccccgtgagcgaccagaaggaggtgctgcccgccggcgtgaccatcaagcaggagcagaacctggaccagacctacctggacgacgtgaacgagatcatcagaaaggagttcagcggcccccccgccagaaaccagacctag

SEQ ID NO: 11900 - DNA, 2706 bp, Artificial Sequence
  Description of Artificial Sequence: Synthetic coding sequence
atgcagagagaggccgccttcagactgggccactgccaccccctgagaatcatgggcagcgtggaccaggaggagcccaacgcccacaaggtggccagcccccccagcggccccgcctaccccgacgacgtgctggactacggcctgaagccctacagccccctggccagcctgagcggcgagccccccggcagattcggcgagcccgacagagtgggcccccagaagttcctgagcgccgccaagcccgccggcgccagcggcctgagccccagaatcgagatcacccccagccacgagctgatccaggccgtgggccccctgagaatgagagacgccggcctgctggtggagcagccccccctggccggcgtggccgccagccccagattcaccctgcccgtgcccggcttcgagggctacagagagcccctgtgcctgagccccgccagcagcggcagcagcgccagcttcatcagcgacaccttcagcccctacaccagcccctgcgtgagccccaacaacggcggccccgacgacctgtgcccccagttccagaacatccccgcccactacagccccagaaccagccccatcatgagccccagaaccagcctggccgaggacagctgcctgggcagacacagccccgtgcccagacccgccagcagaagcagcagccccggcgccaagagaagacacagctgcgccgaggccctggtggccctgccccccggcgccagcccccagagaagcagaagccccagcccccagcccagcagccacgtggccccccaggaccacggcagccccgccggctacccccccgtggccggcagcgccgtgatcatggacgccctgaacagcctggccaccgacagcccctgcggcatcccccccaagatgtggaagaccagccccgaccccagccccgtgagcgccgcccccagcaaggccggcctgcccagacacatctaccccgccgtggagttcctgggcccctgcgagcagggcgagagaagaaacagcgcccccgagagcatcctgctggtgccccccacctggcccaagcccctggtgcccgccatccccatctgcagcatccccgtgaccgccagcctgccccccctggagtggcccctgagcagccagagcggcagctacgagctgagaatcgaggtgcagcccaagccccaccacagagcccactacgagaccgagggcagcagaggcgccgtgaaggcccccaccggcggccaccccgtggtgcagctgcacggctacatggagaacaagcccctgggcctgcagatcttcatcggcaccgccgacgagagaatcctgaagccccacgccttctaccaggtgcacagaatcaccggcaagaccgtgaccaccaccagctacgagaagatcgtgggcaacaccaaggtgctggagatccccctggagcccaagaacaacatgagagccaccatcgactgcgccggcatcctgaagctgagaaacgccgacatcgagctgagaaagggcgagaccgacatcggcagaaagaacaccagagtgagactggtgttcagagtgcacatccccgagagcagcggcagaatcgtgagcctgcagaccgccagcaaccccatcgagtgcagccagagaagcgcccacgagctgcccatggtggagagacaggacaccgacagctgcctggtgtacggcggccagcagatgatcctgaccggccagaacttcaccagcgagagcaaggtggtgttcaccgagaagaccaccgacggccagcagatctgggagatggaggccaccgtggacaaggacaagagccagcccaacatgctgttcgtggagatccccgagtacagaaacaagcacatcagaacccccgtgaaggtgaacttctacgtgatcaacggcaagagaaagagaagccagccccagcacttcacctaccaccccgtgcccgccatcaagaccgagcccaccgacgagtacgaccccaccctgatctgcagccccacccacggcggcctgggcagccagccctactacccccagcaccccatggtggccgagagccccagctgcctggtggccaccatggccccctgccagcagttcagaaccggcctgagcagccccgacgccagataccagcagcagaaccccgccgccgtgctgtaccagagaagcaagagcctgagccccagcctgctgggctaccagcagcccgccctgatggccgcccccctgagcctggccgacgcccacagaagcgtgctggtgcacgccggcagccagggccagagcagcgccctgctgcaccccagccccaccaaccagcaggccagccccgtgatccactacagccccaccaaccagcagctgagatgcggcagccaccaggagttccagcacatcatgtactgcgagaacttcgcccccggcaccaccagacccggccccccccccgtgagccagggccagagactgagccccggcagctaccccaccgtgatccagcagcagaacgccaccagccagagagccgccaagaacggcccccccgtgagcgaccagaaggaggtgctgcccgccggcgtgaccatcaagcaggagcagaacctggaccagacctacctggacgacgagctgatcgacacccacctgagctggatccagaacatcctgtag

SEQ ID NO: 11901 - DNA, 3207 bp, Artificial Sequence
  Description of Artificial Sequence: Synthetic coding sequence
atgaccaccgccaactgcggcgcccacgacgagctggacttcaagctggtgttcggcgaggacggcgcccccgccccccccccccccggcagcagacccgccgacctggagcccgacgactgcgccagcatctacatcttcaacgtggaccccccccccagcaccctgaccacccccctgtgcctgccccaccacggcctgcccagccacagcagcgtgctgagccccagcttccagctgcagagccacaagaactacgagggcacctgcgagatccccgagagcaagtacagccccctgggcggccccaagcccttcgagtgccccagcatccagatcaccagcatcagccccaactgccaccaggagctggacgcccacgaggacgacctgcagatcaacgaccccgagagagagttcctggagagacccagcagagaccacctgtacctgcccctggagcccagctacagagagagcagcctgagccccagccccgccagcagcatcagcagcagaagctggttcagcgacgccagcagctgcgagagcctgagccacatctacgacgacgtggacagcgagctgaacgaggccgccgccagattcaccctgggcagccccctgaccagccccggcggcagccccggcggctgccccggcgaggagacctggcaccagcagtacggcctgggccacagcctgagccccagacagagcccctgccacagccccagaagcagcgtgaccgacgagaactggctgagccccagacccgccagcggccccagcagcagacccaccagcccctgcggcaagagaagacacagcagcgccgaggtgtgctacgccggcagcctgagcccccaccacagccccgtgcccagccccggccacagccccagaggcagcgtgaccgaggacacctggctgaacgccagcgtgcacggcggcagcggcctgggccccgccgtgttccccttccagtactgcgtggagaccgacatccccctgaagaccagaaagaccagcgaggaccaggccgccatcctgcccggcaagctggagctgtgcagcgacgaccagggcagcctgagccccgccagagagaccagcatcgacgacggcctgggcagccagtaccccctgaagaaggacagctgcggcgaccagttcctgagcgtgcccagccccttcacctggagcaagcccaagcccggccacacccccatcttcagaaccagcagcctgccccccctggactggcccctgcccgcccacttcggccagtgcgagctgaagatcgaggtgcagcccaagacccaccacagagcccactacgagaccgagggcagcagaggcgccgtgaaggccagcaccggcggccaccccgtggtgaagctgctgggctacaacgagaagcccatcaacctgcagatgttcatcggcaccgccgacgacagatacctgagaccccacgccttctaccaggtgcacagaatcaccggcaagaccgtggccaccgccagccaggagatcatcatcgccagcaccaaggtgctggagatccccctgctgcccgagaacaacatgagcgccagcatcgactgcgccggcatcctgaagctgagaaacagcgacatcgagctgagaaagggcgagaccgacatcggcagaaagaacaccagagtgagactggtgttcagagtgcacatcccccagcccagcggcaaggtgctgagcctgcagatcgccagcatccccgtggagtgcagccagagaagcgcccaggagctgccccacatcgagaagtacagcatcaacagctgcagcgtgaacggcggccacgagatggtggtgaccggcagcaacttcctgcccgagagcaagatcatcttcctggagaagggccaggacggcagaccccagtgggaggtggagggcaagatcatcagagagaagtgccagggcgcccacatcgtgctggaggtgcccccctaccacaaccccgccgtgaccgccgccgtgcaggtgcacttctacctgtgcaacggcaagagaaagaagagccagagccagagattcacctacacccccgtgctgatgaagcaggagcacagagaggagatcgacctgagcagcgtgcccagcctgcccgtgccccaccccgcccagacccagagacccagcagcgacagcggctgcagccacgacagcgtgctgagcggccagagaagcctgatctgcagcatcccccagacctacgccagcatggtgaccagcagccacctgccccagctgcagtgcagagacgagagcgtgagcaaggagcagcacatgatccccagccccatcgtgcaccagcccttccaggtgacccccaccccccccgtgggcagcagctaccagcccatgcagaccaacgtggtgtacaacggccccacctgcctgcccatcaacgccgccagcagccaggagttcgacagcgtgctgttccagcaggacgccaccctgagcggcctggtgaacctgggctgccagcccctgagcagcatccccttccacagcagcaacagcggcagcaccggccacctgctggcccacaccccccacagcgtgcacaccctgccccacctgcagagcatgggctaccactgcagcaacaccggccagagaagcctgagcagccccgtggccgaccagatcaccggccagcccagcagccagctgcagcccatcacctacggccccagccacagcggcagcgccaccaccgccagccccgccgccagccaccccctggccagcagccccctgagcggcccccccagcccccagctgcagcccatgccctaccagagccccagcagcggcaccgccagcagccccagccccgccaccagaatgcacagcggccagcacagcacccaggcccagagcaccggccagggcggcctgagcgcccccagcagcctgatctgccacagcctgtgcgaccccgccagcttcccccccgacggcgccaccgtgagcatcaagcccgagcccgaggacagagagcccaacttcgccaccatcggcctgcaggacatcaccctggacgacgaccagttcatcagcgacctggagcaccagcccagcggcagcgccgagaagtggcccaaccacagcgtgctgagctgccccgcccccttctggagaatctag

SEQ ID NO: 11902 - DNA, 3228 bp, Artificial Sequence
  Description of Artificial Sequence: Synthetic coding sequence
atgaccaccgccaactgcggcgcccacgacgagctggacttcaagctggtgttcggcgaggacggcgcccccgccccccccccccccggcagcagacccgccgacctggagcccgacgactgcgccagcatctacatcttcaacgtggaccccccccccagcaccctgaccacccccctgtgcctgccccaccacggcctgcccagccacagcagcgtgctgagccccagcttccagctgcagagccacaagaactacgagggcacctgcgagatccccgagagcaagtacagccccctgggcggccccaagcccttcgagtgccccagcatccagatcaccagcatcagccccaactgccaccaggagctggacgcccacgaggacgacctgcagatcaacgaccccgagagagagttcctggagagacccagcagagaccacctgtacctgcccctggagcccagctacagagagagcagcctgagccccagccccgccagcagcatcagcagcagaagctggttcagcgacgccagcagctgcgagagcctgagccacatctacgacgacgtggacagcgagctgaacgaggccgccgccagattcaccctgggcagccccctgaccagccccggcggcagccccggcggctgccccggcgaggagacctggcaccagcagtacggcctgggccacagcctgagccccagacagagcccctgccacagccccagaagcagcgtgaccgacgagaactggctgagccccagacccgccagcggccccagcagcagacccaccagcccctgcggcaagagaagacacagcagcgccgaggtgtgctacgccggcagcctgagcccccaccacagccccgtgcccagccccggccacagccccagaggcagcgtgaccgaggacacctggctgaacgccagcgtgcacggcggcagcggcctgggccccgccgtgttccccttccagtactgcgtggagaccgacatccccctgaagaccagaaagaccagcgaggaccaggccgccatcctgcccggcaagctggagctgtgcagcgacgaccagggcagcctgagccccgccagagagaccagcatcgacgacggcctgggcagccagtaccccctgaagaaggacagctgcggcgaccagttcctgagcgtgcccagccccttcacctggagcaagcccaagcccggccacacccccatcttcagaaccagcagcctgccccccctggactggcccctgcccgcccacttcggccagtgcgagctgaagatcgaggtgcagcccaagacccaccacagagcccactacgagaccgagggcagcagaggcgccgtgaaggccagcaccggcggccaccccgtggtgaagctgctgggctacaacgagaagcccatcaacctgcagatgttcatcggcaccgccgacgacagatacctgagaccccacgccttctaccaggtgcacagaatcaccggcaagaccgtggccaccgccagccaggagatcatcatcgccagcaccaaggtgctggagatccccctgctgcccgagaacaacatgagcgccagcatcgactgcgccggcatcctgaagctgagaaacagcgacatcgagctgagaaagggcgagaccgacatcggcagaaagaacaccagagtgagactggtgttcagagtgcacatcccccagcccagcggcaaggtgctgagcctgcagatcgccagcatccccgtggagtgcagccagagaagcgcccaggagctgccccacatcgagaagtacagcatcaacagctgcagcgtgaacggcggccacgagatggtggtgaccggcagcaacttcctgcccgagagcaagatcatcttcctggagaagggccaggacggcagaccccagtgggaggtggagggcaagatcatcagagagaagtgccagggcgcccacatcgtgctggaggtgcccccctaccacaaccccgccgtgaccgccgccgtgcaggtgcacttctacctgtgcaacggcaagagaaagaagagccagagccagagattcacctacacccccgtgctgatgaagcaggagcacagagaggagatcgacctgagcagcgtgcccagcctgcccgtgccccaccccgcccagacccagagacccagcagcgacagcggctgcagccacgacagcgtgctgagcggccagagaagcctgatctgcagcatcccccagacctacgccagcatggtgaccagcagccacctgccccagctgcagtgcagagacgagagcgtgagcaaggagcagcacatgatccccagccccatcgtgcaccagcccttccaggtgacccccaccccccccgtgggcagcagctaccagcccatgcagaccaacgtggtgtacaacggccccacctgcctgcccatcaacgccgccagcagccaggagttcgacagcgtgctgttccagcaggacgccaccctgagcggcctggtgaacctgggctgccagcccctgagcagcatccccttccacagcagcaacagcggcagcaccggccacctgctggcccacaccccccacagcgtgcacaccctgccccacctgcagagcatgggctaccactgcagcaacaccggccagagaagcctgagcagccccgtggccgaccagatcaccggccagcccagcagccagctgcagcccatcacctacggccccagccacagcggcagcgccaccaccgccagccccgccgccagccaccccctggccagcagccccctgagcggcccccccagcccccagctgcagcccatgccctaccagagccccagcagcggcaccgccagcagccccagccccgccaccagaatgcacagcggccagcacagcacccaggcccagagcaccggccagggcggcctgagcgcccccagcagcctgatctgccacagcctgtgcgaccccgccagcttcccccccgacggcgccaccgtgagcatcaagcccgagcccgaggacagagagcccaacttcgccaccatcggcctgcaggacatcaccctggacgacgtgaacgagatcatcggcagagacatgagccagatcagcgtgagccagggcgccggcgtgagcagacaggcccccctgcccagccccgagagcctggacctgggcagaagcgacggcctgtag

SEQ ID NO: 11903 - DNA, 3198 bp, Artificial Sequence
  Description of Artificial Sequence: Synthetic coding sequence
atgaccaccgccaactgcggcgcccacgacgagctggacttcaagctggtgttcggcgaggacggcgcccccgccccccccccccccggcagcagacccgccgacctggagcccgacgactgcgccagcatctacatcttcaacgtggaccccccccccagcaccctgaccacccccctgtgcctgccccaccacggcctgcccagccacagcagcgtgctgagccccagcttccagctgcagagccacaagaactacgagggcacctgcgagatccccgagagcaagtacagccccctgggcggccccaagcccttcgagtgccccagcatccagatcaccagcatcagccccaactgccaccaggagctggacgcccacgaggacgacctgcagatcaacgaccccgagagagagttcctggagagacccagcagagaccacctgtacctgcccctggagcccagctacagagagagcagcctgagccccagccccgccagcagcatcagcagcagaagctggttcagcgacgccagcagctgcgagagcctgagccacatctacgacgacgtggacagcgagctgaacgaggccgccgccagattcaccctgggcagccccctgaccagccccggcggcagccccggcggctgccccggcgaggagacctggcaccagcagtacggcctgggccacagcctgagccccagacagagcccctgccacagccccagaagcagcgtgaccgacgagaactggctgagccccagacccgccagcggccccagcagcagacccaccagcccctgcggcaagagaagacacagcagcgccgaggtgtgctacgccggcagcctgagcccccaccacagccccgtgcccagccccggccacagccccagaggcagcgtgaccgaggacacctggctgaacgccagcgtgcacggcggcagcggcctgggccccgccgtgttccccttccagtactgcgtggagaccgacatccccctgaagaccagaaagaccagcgaggaccaggccgccatcctgcccggcaagctggagctgtgcagcgacgaccagggcagcctgagccccgccagagagaccagcatcgacgacggcctgggcagccagtaccccctgaagaaggacagctgcggcgaccagttcctgagcgtgcccagccccttcacctggagcaagcccaagcccggccacacccccatcttcagaaccagcagcctgccccccctggactggcccctgcccgcccacttcggccagtgcgagctgaagatcgaggtgcagcccaagacccaccacagagcccactacgagaccgagggcagcagaggcgccgtgaaggccagcaccggcggccaccccgtggtgaagctgctgggctacaacgagaagcccatcaacctgcagatgttcatcggcaccgccgacgacagatacctgagaccccacgccttctaccaggtgcacagaatcaccggcaagaccgtggccaccgccagccaggagatcatcatcgccagcaccaaggtgctggagatccccctgctgcccgagaacaacatgagcgccagcatcgactgcgccggcatcctgaagctgagaaacagcgacatcgagctgagaaagggcgagaccgacatcggcagaaagaacaccagagtgagactggtgttcagagtgcacatcccccagcccagcggcaaggtgctgagcctgcagatcgccagcatccccgtggagtgcagccagagaagcgcccaggagctgccccacatcgagaagtacagcatcaacagctgcagcgtgaacggcggccacgagatggtggtgaccggcagcaacttcctgcccgagagcaagatcatcttcctggagaagggccaggacggcagaccccagtgggaggtggagggcaagatcatcagagagaagtgccagggcgcccacatcgtgctggaggtgcccccctaccacaaccccgccgtgaccgccgccgtgcaggtgcacttctacctgtgcaacggcaagagaaagaagagccagagccagagattcacctacacccccgtgctgatgaagcaggagcacagagaggagatcgacctgagcagcgtgcccagcctgcccgtgccccaccccgcccagacccagagacccagcagcgacagcggctgcagccacgacagcgtgctgagcggccagagaagcctgatctgcagcatcccccagacctacgccagcatggtgaccagcagccacctgccccagctgcagtgcagagacgagagcgtgagcaaggagcagcacatgatccccagccccatcgtgcaccagcccttccaggtgacccccaccccccccgtgggcagcagctaccagcccatgcagaccaacgtggtgtacaacggccccacctgcctgcccatcaacgccgccagcagccaggagttcgacagcgtgctgttccagcaggacgccaccctgagcggcctggtgaacctgggctgccagcccctgagcagcatccccttccacagcagcaacagcggcagcaccggccacctgctggcccacaccccccacagcgtgcacaccctgccccacctgcagagcatgggctaccactgcagcaacaccggccagagaagcctgagcagccccgtggccgaccagatcaccggccagcccagcagccagctgcagcccatcacctacggccccagccacagcggcagcgccaccaccgccagccccgccgccagccaccccctggccagcagccccctgagcggcccccccagcccccagctgcagcccatgccctaccagagccccagcagcggcaccgccagcagccccagccccgccaccagaatgcacagcggccagcacagcacccaggcccagagcaccggccagggcggcctgagcgcccccagcagcctgatctgccacagcctgtgcgaccccgccagcttcccccccgacggcgccaccgtgagcatcaagcccgagcccgaggacagagagcccaacttcgccaccatcggcctgcaggacatcaccctggacgacgacctgttcaccagcaacaacttcgacctgctgcagctgagacccaccttctggcccgtgcccgccggcagatacctgagaaacctggagtag

SEQ ID NO: 11904 - DNA, 1770 bp, Artificial Sequence
  Description of Artificial Sequence: Synthetic coding sequence
atgttcatcggcaccgccgacgacagatacctgagaccccacgccttctaccaggtgcacagaatcaccggcaagaccgtggccaccgccagccaggagatcatcatcgccagcaccaaggtgctggagatccccctgctgcccgagaacaacatgagcgccagcatcgactgcgccggcatcctgaagctgagaaacagcgacatcgagctgagaaagggcgagaccgacatcggcagaaagaacaccagagtgagactggtgttcagagtgcacatcccccagcccagcggcaaggtgctgagcctgcagatcgccagcatccccgtggagtgcagccagagaagcgcccaggagctgccccacatcgagaagtacagcatcaacagctgcagcgtgaacggcggccacgagatggtggtgaccggcagcaacttcctgcccgagagcaagatcatcttcctggagaagggccaggacggcagaccccagtgggaggtggagggcaagatcatcagagagaagtgccagggcgcccacatcgtgctggaggtgcccccctaccacaaccccgccgtgaccgccgccgtgcaggtgcacttctacctgtgcaacggcaagagaaagaagagccagagccagagattcacctacacccccgtgctgatgaagcaggagcacagagaggagatcgacctgagcagcgtgcccagcctgcccgtgccccaccccgcccagacccagagacccagcagcgacagcggctgcagccacgacagcgtgctgagcggccagagaagcctgatctgcagcatcccccagacctacgccagcatggtgaccagcagccacctgccccagctgcagtgcagagacgagagcgtgagcaaggagcagcacatgatccccagccccatcgtgcaccagcccttccaggtgacccccaccccccccgtgggcagcagctaccagcccatgcagaccaacgtggtgtacaacggccccacctgcctgcccatcaacgccgccagcagccaggagttcgacagcgtgctgttccagcaggacgccaccctgagcggcctggtgaacctgggctgccagcccctgagcagcatccccttccacagcagcaacagcggcagcaccggccacctgctggcccacaccccccacagcgtgcacaccctgccccacctgcagagcatgggctaccactgcagcaacaccggccagagaagcctgagcagccccgtggccgaccagatcaccggccagcccagcagccagctgcagcccatcacctacggccccagccacagcggcagcgccaccaccgccagccccgccgccagccaccccctggccagcagccccctgagcggcccccccagcccccagctgcagcccatgccctaccagagccccagcagcggcaccgccagcagccccagccccgccaccagaatgcacagcggccagcacagcacccaggcccagagcaccggccagggcggcctgagcgcccccagcagcctgatctgccacagcctgtgcgaccccgccagcttcccccccgacggcgccaccgtgagcatcaagcccgagcccgaggacagagagcccaacttcgccaccatcggcctgcaggacatcaccctggacgacgaccagttcatcagcgacctggagcaccagcccagcggcagcgccgagaagtggcccaaccacagcgtgctgagctgccccgcccccttctggagaatctag

SEQ ID NO: 11905 - DNA, 2709 bp, Artificial Sequence
  Description of Artificial Sequence: Synthetic coding sequence
atgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggaggtgagcgagatcatcggcagagacctgagcggcttccccgccccccccggcgaggagccccccgcctag

SEQ ID NO: 11906 - DNA, 2895 bp, Artificial Sequence
  Description of Artificial Sequence: Synthetic coding sequence
atgatcaccaccctgcccagcctgctgcccgccagcctggccagcatcagccacagagtgaccaacctgcccagcaacagcctgagccacaaccccggcctgagcaagcccgacttccccggcaacagcagccccggcctgcccagcagcagcagccccggcagagacctgggcgcccccgccggcagcatgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggagggcggctgcggcaccggcggctgcgagtgcgagtgcgtgcaggagatcgccctgcacgtgtgctag

SEQ ID NO: 11907 - DNA, 2670 bp, Artificial Sequence
  Description of Artificial Sequence: Synthetic coding sequence
atgcccgccagcatcagcagcatcttccccggccccaccctgctgctgagctgcggcagcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggagggcggctgcggcaccggcggctgcgagtgcgagtgcgtgcaggagatcgccctgcacgtgtgctag

SEQ ID NO: 11908 - DNA, 2745 bp, Artificial Sequence
  Description of Artificial Sequence: Synthetic coding sequence
atgctgagcggcagagacctgggcgcccccgccggcagcatgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggagggcggctgcggcaccggcggctgcgagtgcgagtgcgtgcaggagatcgccctgcacgtgtgctag

SEQ ID NO: 11909 - DNA, 2802 bp, Artificial Sequence
  Description of Artificial Sequence: Synthetic coding sequence
atggccgacggcggcgccgacagcgccgcccagagactgcccgagggccccggcagagtggcccccggcagagacctgggcgcccccgccggcagcatgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggagggcggctgcggcaccggcggctgcgagtgcgagtgcgtgcaggagatcgccctgcacgtgtgctag

SEQ ID NO: 11910 - DNA, 2481 bp, Artificial Sequence
  Description of Artificial Sequence: Synthetic coding sequence
atggccgacggcggcgccgacagcgccgcccagagactgcccgagggccccggcagagtggcccccggcagagacctgggcgcccccgccggcagcatgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccgtgagcgagatcatcggcagagacctgagcggcttccccgccccccccggcgaggagccccccgcctag

SEQ ID NO: 11911 - DNA, 2706 bp, Artificial Sequence
  Description of Artificial Sequence: Synthetic coding sequence
atgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggagggcggctgcggcaccggcggctgcgagtgcgagtgcgtgcaggagatcgccctgcacgtgtgctag

SEQ ID NO: 11912 - DNA, 2499 bp, Artificial Sequence
  Description of Artificial Sequence: Synthetic coding sequence
atgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggaggtgagcgagatcatcggcagagacctgagcggcttccccgccccccccggcgaggagccccccgcctag

SEQ ID NO: 11913 - DNA, 2385 bp, Artificial Sequence
  Description of Artificial Sequence: Synthetic coding sequence
atgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccgtgagcgagatcatcggcagagacctgagcggcttccccgccccccccggcgaggagccccccgcctag

SEQ ID NO: 11914 - DNA, 2499 bp, Artificial Sequence; identical to SEQ ID NO: 11912
  Description of Artificial Sequence: Synthetic coding sequence

SEQ ID NO: 11915 - DNA, 990 bp, Artificial Sequence
  Description of Artificial Sequence: Synthetic coding sequence
atgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccgtgagcgagatcatcggcagagacctgagcggcttccccgccccccccggcgaggagccccccgcctag

SEQ ID NO: 11916 - DNA, 2574 bp, Artificial Sequence
  Description of Artificial Sequence: Synthetic coding sequence
atgatcaccaccctgcccagcctgctgcccgccagcctggccagcatcagccacagagtgaccaacctgcccagcaacagcctgagccacaaccccggcctgagcaagcccgacttccccggcaacagcagccccggcctgcccagcagcagcagccccggcagagacctgggcgcccccgccggcagcatgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccgtgagcgagatcatcggcagagacctgagcggcttccccgccccccccggcgaggagccccccgcctag

SEQ ID NO: 11917 - DNA, 2175 bp, Artificial Sequence
  Description of Artificial Sequence: Synthetic coding sequence
atgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccgtgagcgagatcatcggcagagacctgagcggcttccccgccccccccggcgaggagccccccgcctag

SEQ ID NO: 11918 - DNA, 432 bp, Artificial Sequence
  Description of Artificial Sequence: Synthetic coding sequence
atgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagcccctag

SEQ ID NO: 11919 - DNA, 2424 bp, Artificial Sequence
  Description of Artificial Sequence: Synthetic coding sequence
atgctgagcggcagagacctgggcgcccccgccggcagcatgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccgtgagcgagatcatcggcagagacctgagcggcttccccgccccccccggcgaggagccccccgcctag

SEQ ID NO: 11920 - DNA, 1311 bp, Artificial Sequence
  Description of Artificial Sequence: Synthetic coding sequence
atgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggagggcggctgcggcaccggcggctgcgagtgcgagtgcgtgcaggagatcgccctgcacgtgtgctag

SEQ ID NO: 11921 - DNA, 570 bp, Artificial Sequence
  Description of Artificial Sequence: Synthetic coding sequence
atggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggagggcggctgcggcaccggcggctgcgagtgcgagtgcgtgcaggagatcgccctgcacgtgtgctag

SEQ ID NO: 11922 - DNA, 2673 bp, Artificial Sequence
  Description of Artificial Sequence: Synthetic coding sequence
atgcccgccagcatcagcagcatcttccccggccccaccctgctgctgagctgcggcagcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggaggtgagcgagatcatcggcagagacctgagcggcttccccgccccccccggcgaggagccccccgcctag

SEQ ID NO: 11923 - DNA, 2748 bp, Artificial Sequence
  Description of Artificial Sequence: Synthetic coding sequence
atgctgagcggcagagacctgggcgcccccgccggcagcatgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggaggtgagcgagatcatcggcagagacctgagcggcttccccgccccccccggcgaggagccccccgcctag

SEQ ID NO: 11924 - DNA, 573 bp, Artificial Sequence
  Description of Artificial Sequence: Synthetic coding sequence
atggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggaggtgagcgagatcatcggcagagacctgagcggcttccccgccccccccggcgaggagccccccgcctag

SEQ ID NO: 11925 - DNA, 2349 bp, Artificial Sequence
  Description of Artificial Sequence: Synthetic coding sequence
atgcccgccagcatcagcagcatcttccccggccccaccctgctgctgagctgcggcagcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccgtgagcgagatcatcggcagagacctgagcggcttccccgccccccccggcgaggagccccccgcctag

SEQ ID NO: 11926 - DNA, 2805 bp, Artificial Sequence
  Description of Artificial Sequence: Synthetic coding sequence
atggccgacggcggcgccgacagcgccgcccagagactgcccgagggccccggcagagtggcccccggcagagacctgggcgcccccgccggcagcatgggcgccgccagctgcgaggacgaggagctggagttcaagctggtgttcggcgaggagaaggaggccccccccctgggcgccggcggcctgggcgaggagctggacagcgaggacgcccccccctgctgcagactggccctgggcgagccccccccctacggcgccgcccccatcggcatccccagaccccccccccccagacccggcatgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggaggtgagcgagatcatcggcagagacctgagcggcttccccgccccccccggcgaggagccccccgcctag

SEQ ID NO: 11927 - DNA, 1314 bp, Artificial Sequence
  Description of Artificial Sequence: Synthetic coding sequence
atgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggaggtgagcgagatcatcggcagagacctgagcggcttccccgccccccccggcgaggagccccccgcctag

SEQ ID NO: 11928 - DNA, 2496 bp, Artificial Sequence
  Description of Artificial Sequence: Synthetic coding sequence
atgcacagccccccccccagacccgcccccagccccggcacctgggagagccagcccgccagaagcgtgagactgggcggccccggcggcggcgccggcggcgccggcggcggcagagtgctggagtgccccagcatcagaatcaccagcatcagccccacccccgagccccccgccgccctggaggacaaccccgacgcctggggcgacggcagccccagagactaccccccccccgagggcttcggcggctacagagaggccggcggccagggcggcggcgccttcttcagccccagccccggcagcagcagcctgagcagctggagcttcttcagcgacgccagcgacgaggccgccctgtacgccgcctgcgacgaggtggagagcgagctgaacgaggccgccagcagattcggcctgggcagccccctgcccagccccagagccagccccagaccctggacccccgaggacccctggagcctgtacggccccagccccggcggcagaggccccgaggacagctggctgctgctgagcgcccccggccccacccccgccagccccagacccgccagcccctgcggcaagagaagatacagcagcagcggcacccccagcagcgccagccccgccctgagcagaagaggcagcctgggcgaggagggcagcgagccccccccccccccccccctgcccctggccagagaccccggcagccccggccccttcgactacgtgggcgccccccccgccgagagcatcccccagaagaccagaagaaccagcagcgagcaggccgtggccctgcccagaagcgaggagcccgccagctgcaacggcaagctgcccctgggcgccgaggagagcgtggccccccccggcggcagcagaaaggaggtggccggcatggactacctggccgtgcccagccccctggcctggagcaaggccagaatcggcggccacagccccatcttcagaaccagcgccctgccccccctggactggcccctgcccagccagtacgagcagctggagctgagaatcgaggtgcagcccagagcccaccacagagcccactacgagaccgagggcagcagaggcgccgtgaaggccgcccccggcggccaccccgtggtgaagctgctgggctacagcgagaagcccctgaccctgcagatgttcatcggcaccgccgacgagagaaacctgagaccccacgccttctaccaggtgcacagaatcaccggcaagatggtggccaccgccagctacgaggccgtggtgagcggcaccaaggtgctggagatgaccctgctgcccgagaacaacatggccgccaacatcgactgcgccggcatcctgaagctgagaaacagcgacatcgagctgagaaagggcgagaccgacatcggcagaaagaacaccagagtgagactggtgttcagagtgcacgtgccccagggcggcggcaaggtggtgagcgtgcaggccgccagcgtgcccatcgagtgcagccagagaagcgcccaggagctgccccaggtggaggcctacagccccagcgcctgcagcgtgagaggcggcgaggagctggtgctgaccggcagcaacttcctgcccgacagcaaggtggtgttcatcgagagaggccccgacggcaagctgcagtgggaggaggaggccaccgtgaacagactgcagagcaacgaggtgaccctgaccctgaccgtgcccgagtacagcaacaagagagtgagcagacccgtgcaggtgtacttctacgtgagcaacggcagaagaaagagaagccccacccagagcttcagattcctgcccgtgatctgcaaggaggagcccctgcccgacagcagcctgagaggcttccccagcgccagcgccacccccttcggcaccgacatggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccggctgcgcccagccccccgccgtgagcttcctgcccagacccttccccagcgacccctacggcggcagaggcagcagcttcagcctgggcctgcccttcagcccccccgcccccttcagacccccccccctgcccgccagcccccccctggagggccccttccccagccagagcgacgtgcaccccctgcccgccgagggctacaacaaggtgggccccggctacggccccggcgagggcgcccccgagcaggagaagagcagaggcggctacagcagcggcttcagagacagcgtgcccatccagggcatcaccctggaggagggcggctgcggcaccggcggctgcgagtgcgagtgcgtgcaggagatcgccctgcacgtgtgctag

SEQ ID NO: 11929 - DNA, 249 bp, Artificial Sequence
  Description of Artificial Sequence: Synthetic coding sequence
atggacttcagcccccccagacccccctaccccagctacccccacgaggaccccgcctgcgagaccccctacctgagcgagggcttcggctacggcatgccccccctgtacccccagaccggccccccccccagctacagacccggcctgagaatgttccccgagaccagaggcaccaccgtgagcgagatcatcggcagagacctgagcggcttccccgccccccccggcgaggagccccccgcctag

SEQ ID NO: 11930 - DNA, 315 bp, Artificial Sequence
  Description of Artificial Sequence: Synthetic coding sequence
atgagcagcgccgccagaagcagactgaccagagccaccagacaggagatgctgttcctggccctgctgctgctgcccgtggtggtggccttcgccagagccgaggccgaggaggacggcgacctgcagtgcctgtgcgtgaagaccaccagccaggtgagacccagacacatcaccagcctggaggtgatcaaggccggcccccactgccccaccgcccagctgatcgccaccctgaagaacggcagaaagatctgcctggacctgcaggccctgctgtacaagaagatcatcaaggagcacctggagagctag

SEQ ID NO: 11931 - DNA, 2907 bp, Artificial Sequence
  Description of Artificial Sequence: Synthetic coding sequence
atggccgaggacgacccctacctgggcagacccgagcagatgttccacctggaccccagcctgacccacaccatcttcaaccccgaggtgttccagccccagatggccctgcccaccgacggcccctacctgcagatcctggagcagcccaagcagagaggcttcagattcagatacgtgtgcgagggccccagccacggcggcctgcccggcgccagcagcgagaagaacaagaagagctacccccaggtgaagatctgcaactacgtgggccccgccaaggtgatcgtgcagctggtgaccaacggcaagaacatccacctgcacgcccacagcctggtgggcaagcactgcgaggacggcatctgcaccgtgaccgccggccccaaggacatggtggtgggcttcgccaacctgggcatcctgcacgtgaccaagaagaaggtgttcgagaccctggaggccagaatgaccgaggcctgcatcagaggctacaaccccggcctgctggtgcaccccgacctggcctacctgcaggccgagggcggcggcgacagacagctgggcgacagagagaaggagctgatcagacaggccgccctgcagcagaccaaggagatggacctgagcgtggtgagactgatgttcaccgccttcctgcccgacagcaccggcagcttcaccagaagactggagcccgtggtgagcgacgccatctacgacagcaaggcccccaacgccagcaacctgaagatcgtgagaatggacagaaccgccggctgcgtgaccggcggcgaggagatctacctgctgtgcgacaaggtgcagaaggacgacatccagatcagattctacgaggaggaggagaacggcggcgtgtgggagggcttcggcgacttcagccccaccgacgtgcacagacagttcgccatcgtgttcaagacccccaagtacaaggacatcaacatcaccaagcccgccagcgtgttcgtgcagctgagaagaaagagcgacctggagaccagcgagcccaagcccttcctgtactaccccgagatcaaggacaaggaggaggtgcagagaaagagacagaagctgatgcccaacttcagcgacagcttcggcggcggcagcggcgccggcgccggcggcggcggcatgttcggcagcggcggcggcggcggcggcaccggcagcaccggccccggctacagcttcccccactacggcttccccacctacggcggcatcaccttccaccccggcaccaccaagagcaacgccggcatgaagcacggcaccatggacaccgagagcaagaaggaccccgagggctgcgacaagagcgacgacaagaacaccgtgaacctgttcggcaaggtgatcgagaccaccgagcaggaccaggagcccagcgaggccaccgtgggcaacggcgaggtgaccctgacctacgccaccggcaccaaggaggagagcgccggcgtgcaggacaacctgttcctggagaaggccatgcagctggccaagagacacgccaacgccctgttcgactacgccgtgaccggcgacgtgaagatgctgctggccgtgcagagacacctgaccgccgtgcaggacgagaacggcgacagcgtgctgcacctggccatcatccacctgcacagccagctggtgagagacctgctggaggtgaccagcggcctgatcagcgacgacatcatcaacatgagaaacgacctgtaccagacccccctgcacctggccgtgatcaccaagcaggaggacgtggtggaggacctgctgagagccggcgccgacctgagcctgctggacagactgggcaacagcgtgctgcacctggccgccaaggagggccacgacaaggtgctgagcatcctgctgaagcacaagaaggccgccctgctgctggaccaccccaacggcgacggcctgaacgccatccacctggccatgatgagcaacagcctgccctgcctgctgctgctggtggccgccggcgccgacgtgaacgcccaggagcagaagagcggcagaaccgccctgcacctggccgtggagcacgacaacatcagcctggccggctgcctgctgctggagggcgacgcccacgtggacagcaccacctacgacggcaccacccccctgcacatcgccgccggcagaggcagcaccagactggccgccctgctgaaggccgccggcgccgaccccctggtggagaacttcgagcccctgtacgacctggacgacagctgggagaacgccggcgaggacgagggcgtggtgcccggcaccacccccctggacatggccaccagctggcaggtgttcgacatcctgaacggcaagccctacgagcccgagttcaccagcgacgacctgctggcccagggcgacatgaagcagctggccgaggacgtgaagctgcagctgtacaagctgctggagatccccgaccccgacaagaactgggccaccctggcccagaagctgggcctgggcatcctgaacaacgccttcagactgagccccgcccccagcaagaccctgatggacaactacgaggtgagcggcggcaccgtgagagagctggtggaggccctgagacagatgggctacaccgaggccatcgaggtgatccaggccgccagcagccccgtgaagaccaccagccaggcccacagcctgcccctgagccccgccagcaccagacagcagatcgacgagctgagagacagcgacagcgtgtgcgacagcggcgtggagaccagcttcagaaagctgagcttcaccgagagcctgaccagcggcgccagcctgctgaccctgaacaagatgccccacgactacggccaggagggccccctggagggcaagatctag

SEQ ID NO: 11932 - DNA, 2907 bp, Artificial Sequence; identical to SEQ ID NO: 11931
  Description of Artificial Sequence: Synthetic coding sequence

SEQ ID NO: 11933 - DNA, 438 bp, Artificial Sequence
  Description of Artificial Sequence: Synthetic coding sequence
atggccgaggacgacccctacctgggcagacccgagcagatgttccacctggaccccagcctgacccacaccatcttcaaccccgaggtgttccagccccagatggccctgcccaccgccgacggcccctacctgcagatcctggagcagcccaagcagagaggcttcagattcagatacgtgtgcgagggccccagccacggcggcctgcccggcgccagcagcgagaagaacaagaagagctacccccaggtgaagatctgcaactacgtgggccccgccaaggtgatcgtgcagctggtgaccaacggcaagaacatccacctgcacgcccacagcctggtgggcaagcactgcgaggacggcatctgcaccgtgaccgccggccccaaggacatggtggtgggcttcgccaacctgggcatcctgcacgtgtag

SEQ ID NO: 11934 - DNA, 225 bp, Artificial Sequence
  Description of Artificial Sequence: Synthetic coding sequence
atgaagagaaccaccagcttcagaatggccgaggacgacccctacctgggcagacccgagcagatgttccacctggaccccagcctgacccacaccatcttcaaccccgaggtgttccagccccagatggccctgcccaccgacggcccctacctgcagatcctggagcagcccaagcagagaggcttcagattcagatacgtgtgcgagggccccagccactag

SEQ ID NO: 11935 - DNA, 1923 bp, Artificial Sequence
  Description of Artificial Sequence: Synthetic coding sequence
atggccgccctgtacagacccggcctgagactgaactggcacggcctgagccccctgggctggcccagctgcagaagcatccagaccctgagagtgctgagcggcgacctgggccagctgcccaccggcatcagagacttcgtggagcacagcgccagactgtgccagcccgagggcatccacatctgcgacggcaccgaggccgagaacaccgccaccctgaccctgctggagcagcagggcctgatcagaaagctgcccaagtacaacaactgctggctggccagaaccgaccccaaggacgtggccagagtggagagcaagaccgtgatcgtgacccccagccagagagacaccgtgcagctgccccccggcggcgccagaggccagctgggcaactggatgagccccgccgacttccagagagccgtggacgagagattccccggctgcatgcagggcagaaccatgtacgtgctgcccttcagcatgggccccgtgggcagccccctgagcagaatcggcgtgcagctgaccgacagcgcctacgtggtggccagcatgagaatcatgaccagactgggcacccccgtgctgcaggccctgggcgacggcgacttcgtgaagtgcctgcacagcgtgggccagcccctgaccggccagggcgagcccgtgagccagtggccctgcaaccccgagaagaccctgatcggccacgtgcccgaccagagagagatcatcagcttcggcagcggctacggcggcaacagcctgctgggcaagaagtgcttcgccctgagaatcgccagcagactggccagagacgagggctggctggccgagcacatgctgatcctgggcatcaccagccccgccggcaagaagagatacgtggccgccgccttccccagcgcctgcggcaagaccaacctggccatgatgagacccgccctgcccggctggaaggtggagtgcgtgggcgacgacatcgcctggatgagattcgacagcgagggcagactgagagccatcaaccccgagaacggcttcttcggcgtggcccccggcaccagcgccaccaccaaccccaacgccatggccaccatccagagcaacaccatcttcaccaacgtggccgagaccagcgacggcggcgtgtactgggagggcatcgaccagcccctgccccccggcgtgaccgtgaccagctggctgggcaagccctggaagcccggcgacaaggagccctgcgcccaccccaacagcagattctgcgcccccgccagacagtgccccatcatggaccccgcctgggaggcccccgagggcgtgcccatcgacgccatcatcttcggcggcagaagacccaagggcgtgcccctggtgtacgaggccttcaactggagacacggcgtgttcgtgggcagcgccatgagaagcgagagcaccgccgccgccgagcacaagggcaagatcatcatgcacgaccccttcgccatgagacccttcttcggctacaacttcggccactacctggagcactggctgagcatggagggcagaaagggcgcccagctgcccagaatcttccacgtgaactggttcagaagagacgaggccggccacttcctgtggcccggcttcggcgagaacgccagagtgctggactggatctgcagaagactggagggcgaggacagcgccagagagacccccatcggcctggtgcccaaggagggcgccctggacctgagcggcctgagagccatcgacaccacccagctgttcagcctgcccaaggacttctgggagcaggaggtgagagacatcagaagctacctgaccgagcaggtgaaccaggacctgcccaaggaggtgctggccgagctggaggccctggagagaagagtgcacaagatgtag

SEQ ID NO: 11936 - DNA, 3477 bp, Artificial Sequence
  Description of Artificial Sequence: Synthetic coding sequence
atgacccacggcgaggagctgggcagcgacgtgcaccaggacagcatcgtgctgacctacctggagggcctgctgatgcaccaggccgccggcggcagcggcaccgccgtggacaagaagagcgccggccacaacgaggaggaccagaacttcaacatcagcggcagcgccttccccacctgccagagcaacggccccgtgctgaacacccacacctaccagggcagcggcatgctgcacctgaagaaggccagactgctgcagagcagcgaggactggaacgccgccaagagaaagagactgagcgacagcatcatgaacctgaacgtgaagaaggaggccctgctggccggcatggtggacagcgtgcccaagggcaagcaggacagcaccctgctggccagcctgctgcagagcttcagcagcagactgcagaccgtggccctgagccagcagatcagacagagcctgaaggagcagggctacgccctgagccacgacagcctgaaggtggagaaggacctgagatgctacggcgtggccagcagccacctgaagaccctgctgaagaagagcaaggtgaaggaccagaagcccgacaccaacctgcccgacgtgaccaagaacctgatcagagacagattcgccgagagcccccaccacgtgggccagagcggcaccaaggtgatgagcgagcccctgagctgcgccgccagactgcaggccgtggccagcatggtggagaagagagccagccccgccaccagccccaagcccagcgtggcctgcagccagctggccctgctgctgagcagcgaggcccacctgcagcagtacagcagagagcacgccctgaagacccagaacgccaaccaggccgccagcgagagactggccgccatggccagactgcaggagaacggccagaaggacgtgggcagctaccagctgcccaagggcatgagcagccacctgaacggccaggccagaaccagcagcagcaagctgatggccagcaagagcagcgccaccgtgttccagaaccccatgggcatcatccccagcagccccaagaacgccggctacaagaacagcctggagagaaacaacatcaagcaggccgccaacaacagcctgctgctgcacctgctgaagagccagaccatccccaagcccatgaacggccacagccacagcgagagaggcagcatcttcgaggagagcagcacccccaccaccatcgacgagtacagcgacaacaaccccagcttcaccgacgacagcagcggcgacgagagcagctacagcaactgcgtgcccatcgacctgagctgcaagcacagaaccgagaagagcgagagcgaccagcccgtgagcctggacaacttcacccagagcctgctgaacacctgggaccccaaggtgcccgacgtggacatcaaggaggaccaggacaccagcaagaacagcaagctgaacagccaccagaaggtgaccctgctgcagctgctgctgggccacaagaacgaggagaacgtggagaagaacaccagcccccagggcgtgcacaacgacgtgagcaagttcaacacccagaactacgccagaaccagcgtgatcgagagccccagcaccaacagaaccacccccgtgagcaccccccccctgctgaccagcagcaaggccggcagccccatcaacctgagccagcacagcctggtgatcaagtggaacagccccccctacgtgtgcagcacccagagcgagaagctgaccaacaccgccagcaaccacagcatggacctgaccaagagcaaggacccccccggcgagaagcccgcccagaacgagggcgcccagaacagcgccaccttcagcgccagcaagctgctgcagaacctggcccagtgcggcatgcagagcagcatgagcgtggaggagcagagacccagcaagcagctgctgaccggcaacaccgacaagcccatcggcatgatcgacagactgaacagccccctgctgagcaacaagaccaacgccgtggaggagaacaaggccttcagcagccagcccaccggccccgagcccggcctgagcggcagcgagatcgagaacctgctggagagaagaaccgtgctgcagctgctgctgggcaaccccaacaagggcaagagcgagaagaaggagaagacccccctgagagacgagagcacccaggagcacagcgagagagccctgagcgagcagatcctgatggtgaagatcaagagcgagccctgcgacgacctgcagatccccaacaccaacgtgcacctgagccacgacgccaagagcgcccccttcctgggcatggcccccgccgtgcagagaagcgcccccgccctgcccgtgagcgaggacttcaagagcgagcccgtgagcccccaggacttcagcttcagcaagaacggcctgctgagcagactgctgagacagaaccaggacagctacctggccgacgacagcgacagaagccacagaaacaacgagatggccctgctggagagcaagaacctgtgcatggtgcccaagaagagaaagctgtacaccgagcccctggagaaccccttcaagaagatgaagaacaacatcgtggacgccgccaacaaccacagcgcccccgaggtgctgtacggcagcctgctgaaccaggaggagctgaagttcagcagaaacgacctggagttcaagtaccccgccggccacggcagcgccagcgagagcgagcacagaagctgggccagagagagcaagagcttcaacgtgctgaagcagctgctgctgagcgagaactgcgtgagagacctgagcccccacagaagcaacagcgtggccgacagcaagaagaagggccacaagaacaacgtgaccaacagcaagcccgagttcagcatcagcagcctgaacggcctgatgtacagcagcacccagcccagcagctgcatggacaacagaaccttcagctaccccggcgtggtgaagacccccgtgagccccaccttccccgagcacctgggctgcgccggcagcagacccgagagcggcctgctgaacggctgcagcatgcccagcgagaagggccccatcaagtgggtgatcaccgacgccgagaagaacgagtacgagaaggacagccccagactgaccaagaccaaccccatcctgtactacatgctgcagaagggcggcaacagcgtgaccagcagagagacccaggacaaggacatctggagagaggccagcagcgccgagagcgtgagccaggtgaccgccaaggaggagctgctgcccaccgccgagaccaaggccagcttcttcaacctgagaagcccctacaacagccacatgggcaacaacgccagcagaccccacagcgccaacggcgaggtgtacggcctgctgggcagcgtgctgaccatcaagaaggagagcgagtag

SEQ ID NO: 11937 - DNA, 3477 bp, Artificial Sequence; identical to SEQ ID NO: 11936
  Description of Artificial Sequence: Synthetic coding sequence

SEQ ID NO: 11938 - DNA, 3477 bp, Artificial Sequence; identical to SEQ ID NO: 11936
  Description of Artificial Sequence: Synthetic coding sequence

SEQ ID NO: 11939 - DNA, 201 bp, Artificial Sequence
  Description of Artificial Sequence: Synthetic coding sequence
atgacccacggcgaggagctgggcagcgacgtgcaccaggacagcatcgtgctgacctacctggagggcctgctgatgcaccaggccgccggcggcagcggcaccgccgtggacaagaagagcgccggccacaacgaggaggaccagaacttcaacatcagcggcagcgccttccccacctgccagagcaacggcccctag

SEQ ID NO: 11940 - DNA, 4176 bp, Artificial Sequence
  Description of Artificial Sequence: Synthetic coding sequence
atgcccagcagcctgctgggcgccgccatgcccgccagcaccagcgccgccgccctgcaggaggccctggagaacgccggcagactgatcgacagacagctgcaggaggacagaatgtaccccgacctgagcgagctgctgatggtgagcgcccccaacaaccccaccgtgagcggcatgagcgacatggactaccccctgcagggccccggcctgctgagcgtgcccaacctgcccgagatcagcagcatcagaagagtgcccctgccccccgagctggtggagcagttcggccacatgcagtgcaactgcatgatgggcgtgttcccccccatcagcagagcctggctgaccatcgacagcgacatcttcatgtggaactacgaggacggcggcgacctggcctacttcgacggcctgagcgagaccatcctggccgtgggcctggtgaagcccaaggccggcatcttccagccccacgtgagacacctgctggtgctggccacccccgtggacatcgtgatcctgggcctgagctacgccaacctgcagaccggcagcggcgtgctgaacgacagcctgagcggcggcatgcagctgctgcccgaccccctgtacagcctgcccaccgacaacacctacctgctgaccatcaccagcaccgacaacggcagaatcttcctggccggcaaggacggctgcctgtacgaggtggcctaccaggccgaggccggctggttcagccagagatgcagaaagatcaaccacagcaagagcagcctgagcttcctggtgcccagcctgctgcagttcaccttcagcgaggacgaccccatcctgcagatcgccatcgacaacagcagaaacatcctgtacaccagaagcgagaagggcgtgatccaggtgtacgacctgggccaggacggccagggcatgagcagagtggccagcgtgagccagaacgccatcgtgagcgccgccggcaacatcgccagaaccatcgacagaagcgtgttcaagcccatcgtgcagatcgccgtgatcgagaacagcgagagcctggactgccagctgctggccgtgacccacgccggcgtgagactgtacttcagcacctgccccttcagacagcccctggccagacccaacaccctgaccctggtgcacgtgagactgccccccggcttcagcgccagcagcaccgtggagaagcccagcaaggtgcacagagccctgtacagcaagggcatcctgctgatggccgccagcgagaacgaggacaacgacatcctgtggtgcgtgaaccacgacaccttccccttccagaagcccatgatggagacccagatgaccgccggcgtggacggccacagctgggccctgagcgccatcgacgagctgaaggtggacaagatcatcacccccctgaacaaggaccacatccccatcaccgacagccccgtggtggtgcagcagcacatgctgccccccaagaagttcgtgctgctgagcgcccagggcagcctgatgttccacaagctgagacccgtggaccagctgagacacctgctggtgagcaacgtgggcggcgacggcgaggagatcgagagattcttcaagctgcaccaggaggaccaggcctgcgccacctgcctgatcctggcctgcagcaccgccgcctgcgacagagaggtgagcgcctgggccaccagagccttcttcagatacggcggcgaggcccagatgagattccccaccaccctgcccccccccagcaacgtgggccccatcctgggcagccccgtgtacagcagcagccccgtgcccagcggcagcccctaccccaaccccagcttcctgggcacccccagccacggcatccagccccccgccatgagcacccccgtgtgcgccctgggcaaccccgccacccaggccaccaacatgagctgcgtgaccggccccgagatcgtgtacagcggcaagcacaacggcatctgcatctacttcagcagaatcatgggcaacatctgggacgccagcctggtggtggagagaatcttcaagagcggcaacagagagatcaccgccatcgagagcagcgtgccctgccagctgctggagagcgtgctgcaggagctgaagggcctgcaggagttcctggacagaaacagccagttcgccggcggccccctgggcaaccccaacaccaccgccaaggtgcagcagagactgatcggcttcatgagacccgagaacggcaacccccagcagatgcagcaggagctgcagagaaagttccacgaggcccagctgagcgagaagatcagcctgcaggccatccagcagctggtgagaaagagctaccaggccctggccctgtggaagctgctgtgcgagcaccagttcaccatcatcgtggccgagctgcagaaggagctgcaggagcagctgaagatcaccaccttcaaggacctggtgatcagagacaaggagctgaccggcgccctgatcgccagcctgatcaactgctacatcagagacaacgccgccgtggacggcatcagcctgcacctgcaggacatctgccccctgctgtacagcaccgacgacgccatctgcagcaaggccaacgagctgctgcagagaagcagacaggtgcagaacaagaccgagaaggagagaatgctgagagagagcctgaaggagtaccagaagatcagcaaccaggtggacctgagcaacgtgtgcgcccagtacagacaggtgagattctacgagggcgtggtggagctgagcctgaccgccgccgagaagaaggacccccagggcctgggcctgcacttctacaagcacggcgagcccgaggaggacatcgtgggcctgcaggccttccaggagagactgaacagctacaagtgcatcaccgacaccctgcaggagctggtgaaccagagcaaggccgccccccagagccccagcgtgcccaagaagcccggcccccccgtgctgagcagcgaccccaacatgctgagcaacgaggaggccggccaccacttcgagcagatgctgaagctgagccagagaagcaaggacgagctgttcagcatcgccctgtacaactggctgatccaggtggacctggccgacaagctgctgcaggtggccagccccttcctggagccccacctggtgagaatggccaaggtggaccagaacagagtgagatacatggacctgctgtggagatactacgagaagaacagaagcttcagcaacgccgccagagtgctgagcagactggccgacatgcacagcaccgagatcagcctgcagcagagactggagtacatcgccagagccatcctgagcgccaagagcagcaccgccatcagcagcatcgccgccgacggcgagttcctgcacgagctggaggagaagatggaggtggccagaatccagctgcagatccaggagaccctgcagagacagtacagccaccacagcagcgtgcaggacgccgtgagccagctggacagcgagctgatggacatcaccaagctgtacggcgagttcgccgaccccttcaagctggccgagtgcaagctggccatcatccactgcgccggctacagcgaccccatcctggtgcagaccctgtggcaggacatcatcgagaaggagctgagcgacagcgtgaccctgagcagcagcgacagaatgcacgccctgagcctgaagatcgtgctgctgggcaagatctacgccggcacccccagattcttccccctggacttcatcgtgcagttcctggagcagcaggtgtgcaccctgaactgggacgtgggcttcgtgatccagaccatgaacgagatcggcgtgcccctgcccagactgctggaggtgtacgaccagctgttcaagagcagagaccccttctggaacagaatgaagaagcccctgcacctgctggactgcatccacgtgctgctgatcagatacgtggagaaccccagccaggtgctgaactgcgagagaagaagattcaccaacctgtgcctggacgccgtgtgcggctacctggtggagctgcagagcatgagcagcagcgtggccgtgcaggccatcaccggcaacttcaagagcctgcaggccaagctggagagactgcactag

SEQ ID NO: 11941 - DNA, 2334 bp, Artificial Sequence
  Description of Artificial Sequence: Synthetic coding sequence
atggacagcaaggagagcctgacccccggcagagaggagaaccccagcagcgtgctggcccaggagagaggcgacgtgatggacttctacaagaccctgagaggcggcgccaccgtgaaggtgagcgccagcagccccagcctggccgtggccagccagagcgacagcaagcagagaagactgctggtggacttccccaagggcagcgtgagcaacgcccagcagcccgacctgagcaaggccgtgagcctgagcatgggcctgtacatgggcgagaccgagaccaaggtgatgggcaacgacctgggcttcccccagcagggccagatcagcctgagcagcggcgagaccgacctgaagctgctggaggagagcatcgccaacctgaacagaagcaccagcgtgcccgagaaccccaagagcagcgccagcaccgccgtgagcgccgcccccaccgagaaggagttccccaagacccacagcgacgtgagcagcgagcagcagcacctgaagggccagaccggcaccaacggcggcaacgtgaagctgtacaccaccgaccagagcaccttcgacatcctgcaggacctggagttcagcagcggcagccccggcaaggagaccaacgagagcccctggagaagcgacctgctgatcgacgagaactgcctgctgagccccctggccggcgaggacgacagcttcctgctggagggcaacagcaacgaggactgcaagcccctgatcctgcccgacaccaagcccaagatcaaggacaacggcgacctggtgctgagcagccccagcaacgtgaccctgccccaggtgaagaccgagaaggaggacttcatcgagctgtgcacccccggcgtgatcaagcaggagaagctgggcaccgtgtactgccaggccagcttccccggcgccaacatcatcggcaacaagatgagcgccatcagcgtgcacggcgtgagcaccagcggcggccagatgtaccactacgacatgaacaccgccagcctgagccagcagcaggaccagaagcccatcttcaacgtgatcccccccatccccgtgggcagcgagaactggaacagatgccagggcagcggcgacgacaacctgaccagcctgggcaccctgaacttccccggcagaaccgtgttcagcaacggctacagcagccccagcatgagacccgacgtgagcagcccccccagcagcagcagcaccgccaccaccggccccccccccaagctgtgcctggtgtgcagcgacgaggccagcggctgccactacggcgtgctgacctgcggcagctgcaaggtgttcttcaagagagccgtggagggccagcacaactacctgtgcgccggcagaaacgactgcatcatcgacaagatcagaagaaagaactgccccgcctgcagatacagaaagtgcctgcaggccggcatgaacctggaggccagaaagaccaagaagaagatcaagggcatccagcaggccaccaccggcgtgagccaggagaccagcgagaaccccggcaacaagaccatcgtgcccgccaccctgccccagctgacccccaccctggtgagcctgctggaggtgatcgagcccgaggtgctgtacgccggctacgacagcagcgtgcccgacagcacctggagaatcatgaccaccctgaacatgctgggcggcagacaggtgatcgccgccgtgaagtgggccaaggccatccccggcttcagaaacctgcacctggacgaccagatgaccctgctgcagtacagctggatgttcctgatggccttcgccctgggctggagaagctacagacagagcagcgccaacctgctgtgcttcgcccccgacctgatcatcaacgagcagagaatgaccctgccctgcatgtacgaccagtgcaagcacatgctgtacgtgagcagcgagctgcacagactgcaggtgagctacgaggagtacctgtgcatgaagaccctgctgctgctgagcagcgtgcccaaggacggcctgaagagccaggagctgttcgacgagatcagaatgacctacatcaaggagctgggcaaggccatcgtgaagagagagggcaacagcagccagaactggcagagattctaccagctgaccaagctgctggacagcatgcacgaggtggtggagaacctgctgaactactgcttccagaccttcctggacaagaccatgagcatcgagttccccgagatgctggccgagatcatcaccaaccagatccccaagtacagcaacggcaacatcaagaagctgctgttccaccagaagtag

SEQ ID NO: 11942 - DNA, 1782 bp, Artificial Sequence
  Description of Artificial Sequence: Synthetic coding sequence
atggacagcaaggagagcctgacccccggcagagaggagaaccccagcagcgtgctggcccaggagagaggcgacgtgatggacttctacaagaccctgagaggcggcgccaccgtgaaggtgagcgccagcagccccagcctggccgtggccagccagagcgacagcaagcagagaagactgctggtggacttccccaagggcagcgtgagcaacgcccagcagcccgacctgagcaaggccgtgagcctgagcatgggcctgtacatgggcgagaccgagaccaaggtgatgggcaacgacctgggcttcccccagcagggccagatcagcctgagcagcggcgagaccgacctgaagctgctggaggagagcatcgccaacctgaacagaagcaccagcgtgcccgagaaccccaagagcagcgccagcaccgccgtgagcgccgcccccaccgagaaggagttccccaagacccacagcgacgtgagcagcgagcagcagcacctgaagggccagaccggcaccaacggcggcaacgtgaagctgtacaccaccgaccagagcaccttcgacatcctgcaggacctggagttcagcagcggcagccccggcaaggagaccaacgagagcccctggagaagcgacctgctgatcgacgagaactgcctgctgagccccctggccggcgaggacgacagcttcctgctggagggcaacagcaacgaggactgcaagcccctgatcctgcccgacaccaagcccaagatcaaggacaacggcgacctggtgctgagcagccccagcaacgtgaccctgccccaggtgaagaccgagaaggaggacttcatcgagctgtgcacccccggcgtgatcaagcaggagaagctgggcaccgtgtactgccaggccagcttccccggcgccaacatcatcggcaacaagatgagcgccatcagcgtgcacggcgtgagcaccagcggcggccagatgtaccactacgacatgaacaccgccagcctgagccagcagcaggaccagaagcccatcttcaacgtgatcccccccatccccgtgggcagcgagaactggaacagatgccagggcagcggcgacgacaacctgaccagcctgggcaccctgaacttccccggcagaaccgtgttcagcaacggctacagcagccccagcatgagacccgacgtgagcagcccccccagcagcagcagcaccgccaccaccggccccccccccaagctgtgcctggtgtgcagcgacgaggccagcggctgccactacggcgtgctgacctgcggcagctgcaaggtgttcttcaagagagccgtggagggccagcacaactacctgtgcgccggcagaaacgactgcatcatcgacaagatcagaagaaagaactgccccgcctgcagatacagaaagtgcctgcaggccggcatgaacctggaggtggtgcccaaggacggcctgaagagccaggagctgttcgacgagatcagaatgacctacatcaaggagctgggcaaggccatcgtgaagagagagggcaacagcagccagaactggcagagattctaccagctgaccaagctgctggacagcatgcacgaggtggtggagaacctgctgaactactgcttccagaccttcctggacaagaccatgagcatcgagttccccgagatgctggccgagatcatcaccaaccagatccccaagtacagcaacggcaacatcaagaagctgctgttccaccagaagtag

SEQ ID NO: 11943 - DNA, 2334 bp, Artificial Sequence; identical to SEQ ID NO: 11941
  Description of Artificial Sequence: Synthetic coding sequence

SEQ ID NO: 11944 - DNA, 2337 bp, Artificial Sequence
  Description of Artificial Sequence: Synthetic coding sequence
atggacagcaaggagagcctgacccccggcagagaggagaaccccagcagcgtgctggcccaggagagaggcgacgtgatggacttctacaagaccctgagaggcggcgccaccgtgaaggtgagcgccagcagccccagcctggccgtggccagccagagcgacagcaagcagagaagactgctggtggacttccccaagggcagcgtgagcaacgcccagcagcccgacctgagcaaggccgtgagcctgagcatgggcctgtacatgggcgagaccgagaccaaggtgatgggcaacgacctgggcttcccccagcagggccagatcagcctgagcagcggcgagaccgacctgaagctgctggaggagagcatcgccaacctgaacagaagcaccagcgtgcccgagaaccccaagagcagcgccagcaccgccgtgagcgccgcccccaccgagaaggagttccccaagacccacagcgacgtgagcagcgagcagcagcacctgaagggccagaccggcaccaacggcggcaacgtgaagctgtacaccaccgaccagagcaccttcgacatcctgcaggacctggagttcagcagcggcagccccggcaaggagaccaacgagagcccctggagaagcgacctgctgatcgacgagaactgcctgctgagccccctggccggcgaggacgacagcttcctgctggagggcaacagcaacgaggactgcaagcccctgatcctgcccgacaccaagcccaagatcaaggacaacggcgacctggtgctgagcagccccagcaacgtgaccctgccccaggtgaagaccgagaaggaggacttcatcgagctgtgcacccccggcgtgatcaagcaggagaagctgggcaccgtgtactgccaggccagcttccccggcgccaacatcatcggcaacaagatgagcgccatcagcgtgcacggcgtgagcaccagcggcggccagatgtaccactacgacatgaacaccgccagcctgagccagcagcaggaccagaagcccatcttcaacgtgatcccccccatccccgtgggcagcgagaactggaacagatgccagggcagcggcgacgacaacctgaccagcctgggcaccctgaacttccccggcagaaccgtgttcagcaacggctacagcagccccagcatgagacccgacgtgagcagcccccccagcagcagcagcaccgccaccaccggccccccccccaagctgtgcctggtgtgcagcgacgaggccagcggctgccactacggcgtgctgacctgcggcagctgcaaggtgttcttcaagagagccgtggagggcagacagcacaactacctgtgcgccggcagaaacgactgcatcatcgacaagatcagaagaaagaactgccccgcctgcagatacagaaagtgcctgcaggccggcatgaacctggaggccagaaagaccaagaagaagatcaagggcatccagcaggccaccaccggcgtgagccaggagaccagcgagaaccccggcaacaagaccatcgtgcccgccaccctgccccagctgacccccaccctggtgagcctgctggaggtgatcgagcccgaggtgctgtacgccggctacgacagcagcgtgcccgacagcacctggagaatcatgaccaccctgaacatgctgggcggcagacaggtgatcgccgccgtgaagtgggccaaggccatccccggcttcagaaacctgcacctggacgaccagatgaccctgctgcagtacagctggatgttcctgatggccttcgccctgggctggagaagctacagacagagcagcgccaacctgctgtgcttcgcccccgacctgatcatcaacgagcagagaatgaccctgccctgcatgtacgaccagtgcaagcacatgctgtacgtgagcagcgagctgcacagactgcaggtgagctacgaggagtacctgtgcatgaagaccctgctgctgctgagcagcgtgcccaaggacggcctgaagagccaggagctgttcgacgagatcagaatgacctacatcaaggagctgggcaaggccatcgtgaagagagagggcaacagcagccagaactggcagagattctaccagctgaccaagctgctggacagcatgcacgaggtggtggagaacctgctgaactactgcttccagaccttcctggacaagaccatgagcatcgagttccccgagatgctggccgagatcatcaccaaccagatccccaagtacagcaacggcaacatcaagaagctgctgttccaccagaagtag

SEQ ID NO: 11945 - DNA, 2229 bp, Artificial Sequence
  Description of Artificial Sequence: Synthetic coding sequence
atggacagcaaggagagcctgacccccggcagagaggagaaccccagcagcgtgctggcccaggagagaggcgacgtgatggacttctacaagaccctgagaggcggcgccaccgtgaaggtgagcgccagcagccccagcctggccgtggccagccagagcgacagcaagcagagaagactgctggtggacttccccaagggcagcgtgagcaacgcccagcagcccgacctgagcaaggccgtgagcctgagcatgggcctgtacatgggcgagaccgagaccaaggtgatgggcaacgacctgggcttcccccagcagggccagatcagcctgagcagcggcgagaccgacctgaagctgctggaggagagcatcgccaacctgaacagaagcaccagcgtgcccgagaaccccaagagcagcgccagcaccgccgtgagcgccgcccccaccgagaaggagttccccaagacccacagcgacgtgagcagcgagcagcagcacctgaagggccagaccggcaccaacggcggcaacgtgaagctgtacaccaccgaccagagcaccttcgacatcctgcaggacctggagttcagcagcggcagccccggcaaggagaccaacgagagcccctggagaagcgacctgctgatcgacgagaactgcctgctgagccccctggccggcgaggacgacagcttcctgctggagggcaacagcaacgaggactgcaagcccctgatcctgcccgacaccaagcccaagatcaaggacaacggcgacctggtgctgagcagccccagcaacgtgaccctgccccaggtgaagaccgagaaggaggacttcatcgagctgtgcacccccggcgtgatcaagcaggagaagctgggcaccgtgtactgccaggccagcttccccggcgccaacatcatcggcaacaagatgagcgccatcagcgtgcacggcgtgagcaccagcggcggccagatgtaccactacgacatgaacaccgccagcctgagccagcagcaggaccagaagcccatcttcaacgtgatcccccccatccccgtgggcagcgagaactggaacagatgccagggcagcggcgacgacaacctgaccagcctgggcaccctgaacttccccggcagaaccgtgttcagcaacggctacagcagccccagcatgagacccgacgtgagcagcccccccagcagcagcagcaccgccaccaccggccccccccccaagctgtgcctggtgtgcagcgacgaggccagcggctgccactacggcgtgctgacctgcggcagctgcaaggtgttcttcaagagagccgtggagggccagcacaactacctgtgcgccggcagaaacgactgcatcatcgacaagatcagaagaaagaactgccccgcctgcagatacagaaagtgcctgcaggccggcatgaacctggaggccagaaagaccaagaagaagatcaagggcatccagcaggccaccaccggcgtgagccaggagaccagcgagaaccccggcaacaagaccatcgtgcccgccaccctgccccagctgacccccaccctggtgagcctgctggaggtgatcgagcccgaggtgctgtacgccggctacgacagcagcgtgcccgacagcacctggagaatcatgaccaccctgaacatgctgggcggcagacaggtgatcgccgccgtgaagtgggccaaggccatccccggcttcagaaacctgcacctggacgaccagatgaccctgctgcagtacagctggatgttcctgatggccttcgccctgggctggagaagctacagacagagcagcgccaacctgctgtgcttcgcccccgacctgatcatcaacgagcagagaatgaccctgccctgcatgtacgaccagtgcaagcacatgctgtacgtgagcagcgagctgcacagactgcaggtgagctacgaggagtacctgtgcatgaagaccctgctgctgctgagcagcgtgcccaaggacggcctgaagagccaggagctgttcgacgagatcagaatgacctacatcaaggagctgggcaaggccatcgtgaagagagagggcaacagcagccagaactggcagagattctaccagctgaccaagctgctggacagcatgcacgagaacgtgatgtggctgaagcccgagagcaccagccacaccctgatctag

SEQ ID NO: 11946 - DNA, 1143 bp, Artificial Sequence
  Description of Artificial Sequence: Synthetic coding sequence
atgagacccgacgtgagcagcccccccagcagcagcagcaccgccaccaccggccccccccccaagctgtgcctggtgtgcagcgacgaggccagcggctgccactacggcgtgctgacctgcggcagctgcaaggtgttcttcaagagagccgtggagggccagcacaactacctgtgcgccggcagaaacgactgcatcatcgacaagatcagaagaaagaactgccccgcctgcagatacagaaagtgcctgcaggccggcatgaacctggaggccagaaagaccaagaagaagatcaagggcatccagcaggccaccaccggcgtgagccaggagaccagcgagaaccccggcaacaagaccatcgtgcccgccaccctgccccagctgacccccaccctggtgagcctgctggaggtgatcgagcccgaggtgctgtacgccggctacgacagcagcgtgcccgacagcacctggagaatcatgaccaccctgaacatgctgggcggcagacaggtgatcgccgccgtgaagtgggccaaggccatccccggcttcagaaacctgcacctggacgaccagatgaccctgctgcagtacagctggatgttcctgatggccttcgccctgggctggagaagctacagacagagcagcgccaacctgctgtgcttcgcccccgacctgatcatcaacgagcagagaatgaccctgccctgcatgtacgaccagtgcaagcacatgctgtacgtgagcagcgagctgcacagactgcaggtgagctacgaggagtacctgtgcatgaagaccctgctgctgctgagcagcgtgcccaaggacggcctgaagagccaggagctgttcgacgagatcagaatgacctacatcaaggagctgggcaaggccatcgtgaagagagagggcaacagcagccagaactggcagagattctaccagctgaccaagctgctggacagcatgcacgaggtggtggagaacctgctgaactactgcttccagaccttcctggacaagaccatgagcatcgagttccccgagatgctggccgagatcatcaccaaccagatccccaagtacagcaacggcaacatcaagaagctgctgttccaccagaagtag

SEQ ID NO: 11947 - DNA, 2256 bp, Artificial Sequence
  Description of Artificial Sequence: Synthetic coding sequence
atggacagcaaggagagcctgacccccggcagagaggagaaccccagcagcgtgctggcccaggagagaggcgacgtgatggacttctacaagaccctgagaggcggcgccaccgtgaaggtgagcgccagcagccccagcctggccgtggccagccagagcgacagcaagcagagaagactgctggtggacttccccaagggcagcgtgagcaacgcccagcagcccgacctgagcaaggccgtgagcctgagcatgggcctgtacatgggcgagaccgagaccaaggtgatgggcaacgacctgggcttcccccagcagggccagatcagcctgagcagcggcgagaccgacctgaagctgctggaggagagcatcgccaacctgaacagaagcaccagcgtgcccgagaaccccaagagcagcgccagcaccgccgtgagcgccgcccccaccgagaaggagttccccaagacccacagcgacgtgagcagcgagcagcagcacctgaagggccagaccggcaccaacggcggcaacgtgaagctgtacaccaccgaccagagcaccttcgacatcctgcaggacctggagttcagcagcggcagccccggcaaggagaccaacgagagcccctggagaagcgacctgctgatcgacgagaactgcctgctgagccccctggccggcgaggacgacagcttcctgctggagggcaacagcaacgaggactgcaagcccctgatcctgcccgacaccaagcccaagatcaaggacaacggcgacctggtgctgagcagccccagcaacgtgaccctgccccaggtgaagaccgagaaggaggacttcatcgagctgtgcacccccggcgtgatcaagcaggagaagctgggcaccgtgtactgccaggccagcttccccggcgccaacatcatcgccagcctgagccagcagcaggaccagaagcccatcttcaacgtgatcccccccatccccgtgggcagcgagaactggaacagatgccagggcagcggcgacgacaacctgaccagcctgggcaccctgaacttccccggcagaaccgtgttcagcaacggctacagcagccccagcatgagacccgacgtgagcagcccccccagcagcagcagcaccgccaccaccggccccccccccaagctgtgcctggtgtgcagcgacgaggccagcggctgccactacggcgtgctgacctgcggcagctgcaaggtgttcttcaagagagccgtggagggccagcacaactacctgtgcgccggcagaaacgactgcatcatcgacaagatcagaagaaagaactgccccgcctgcagatacagaaagtgcctgcaggccggcatgaacctggaggccagaaagaccaagaagaagatcaagggcatccagcaggccaccaccggcgtgagccaggagaccagcgagaaccccggcaacaagaccatcgtgcccgccaccctgccccagctgacccccaccctggtgagcctgctggaggtgatcgagcccgaggtgctgtacgccggctacgacagcagcgtgcccgacagcacctggagaatcatgaccaccctgaacatgctgggcggcagacaggtgatcgccgccgtgaagtgggccaaggccatccccggcttcagaaacctgcacctggacgaccagatgaccctgctgcagtacagctggatgttcctgatggccttcgccctgggctggagaagctacagacagagcagcgccaacctgctgtgcttcgcccccgacctgatcatcaacgagcagagaatgaccctgccctgcatgtacgaccagtgcaagcacatgctgtacgtgagcagcgagctgcacagactgcaggtgagctacgaggagtacctgtgcatgaagaccctgctgctgctgagcagcgtgcccaaggacggcctgaagagccaggagctgttcgacgagatcagaatgacctacatcaaggagctgggcaaggccatcgtgaagagagagggcaacagcagccagaactggcagagattctaccagctgaccaagctgctggacagcatgcacgaggtggtggagaacctgctgaactactgcttccagaccttcctggacaagaccatgagcatcgagttccccgagatgctggccgagatcatcaccaaccagatccccaagtacagcaacggcaacatcaagaagctgctgttccaccagaagtag

SEQ ID NO: 11948 - DNA, 435 bp, Artificial Sequence
  Description of Artificial Sequence: Synthetic coding sequence
atggacagcaaggagagcctgacccccggcagagaggagaaccccagcagcgtgctggcccaggagagaggcgacgtgatggacttctacaagaccctgagaggcggcgccaccgtgaaggtgagcgccagcagccccagcctggccgtggccagccagagcgacagcaagcagagaagactgctggtggacttccccaagggcagcgtgagcaacgcccagcagcccgacctgagcaaggccgtgagcctgagcatgggcctgtacatgggcgagaccgagaccaaggtgatgggcaacgacctgggcttcccccagcagggccagatcagcctgagcagcggcgagaccgacctgaagctgctggaggagagcatcgccaacctgaacagaagcaccagcgtgcccgagaaccccaagagcagcgccagctag

SEQ ID NO: 11949 - DNA, 438 bp, Artificial Sequence
  Description of Artificial Sequence: Synthetic coding sequence
atggacagcaaggagagcctgacccccggcagagaggagaaccccagcagcgtgctggcccaggagagaggcgacgtgatggacttctacaagaccctgagaggcggcgccaccgtgaaggtgagcgccagcagccccagcctggccgtggccagccagagcgacagcaagcagagaagactgctggtggacttccccaagggcagcgtgagcaacgcccagcagcccgacctgagcaaggccgtgagcctgagcatgggcctgtacatgggcgagaccgagaccaaggtgatgggcaacgacctgggcttcccccagcagggccagatcagcctgagcagcggcgagaccgacctgaagctgctggaggagagcatcgccaacctgaacagaagcaccagcgtgcccgagaaccccaagagcagcgccagcacctag

SEQ ID NO: 11950 - DNA, 2334 bp, Artificial Sequence; identical to SEQ ID NO: 11941
  Description of Artificial Sequence: Synthetic coding sequence

SEQ ID NO: 11951 - DNA, 2337 bp, Artificial Sequence; identical to SEQ ID NO: 11944
  Description of Artificial Sequence: Synthetic coding sequence

SEQ ID NO: 11952 - DNA, 438 bp, Artificial Sequence; identical to SEQ ID NO: 11949
  Description of Artificial Sequence: Synthetic coding sequence

SEQ ID NO: 11953 - DNA, 438 bp, Artificial Sequence; identical to SEQ ID NO: 11949
  Description of Artificial Sequence: Synthetic coding sequence

SEQ ID NO: 11954 - DNA, 438 bp, Artificial Sequence; identical to SEQ ID NO: 11949
  Description of Artificial Sequence: Synthetic coding sequence

SEQ ID NO: 11955 - DNA, 1914 bp, Artificial Sequence
  Description of Artificial Sequence: Synthetic coding sequence
atgcacgacagcatcagattcggcaacgtggacatgccctgcgtgcaggcccagtacagccccagcccccccggcagcagctacgccgcccagacctacagcagcgagtacaccaccgagatcatgaaccccgactacaccaagctgaccatggacctgggcagcaccgagatcaccgccaccgccaccaccagcctgcccagcatcagcaccttcgtggagggctacagcagcaactacgagctgaagcccagctgcgtgtaccagatgcagagacccctgatcaaggtggaggagggcagagcccccagctaccaccaccaccaccaccaccaccaccaccaccaccaccaccaccagcagcagcaccagcagcccagcatcccccccgccagcagccccgaggacgaggtgctgcccagcaccagcatgtacttcaagcagagcccccccagcacccccaccacccccgccttccccccccaggccggcgccctgtgggacgaggccctgcccagcgcccccggctgcatcgcccccggccccctgctggacccccccatgaaggccgtgcccaccgtggccggcgccagattccccctgttccacttcaagcccagccccccccacccccccgcccccagccccgccggcggccaccacctgggctacgaccccaccgccgccgccgccctgagcctgcccctgggcgccgccgccgccgccggcagccaggccgccgccctggagagccacccctacggcctgcccctggccaagagagccgcccccctggccttcccccccctgggcctgacccccagccccaccgccagcagcctgctgggcgagagccccagcctgcccagcccccccagcagaagcagcagcagcggcgagggcacctgcgccgtgtgcggcgacaacgccgcctgccagcactacggcgtgagaacctgcgagggctgcaagggcttcttcaagagaaccgtgcagaagaacgccaagtacgtgtgcctggccaacaagaactgccccgtggacaagagaagaagaaacagatgccagtactgcagattccagaagtgcctgagcgtgggcatggtgaaggaggtggtgagaaccgacagcctgaagggcagaagaggcagactgcccagcaagcccaagagccccctgcagcaggagcccagccagcccagcccccccagcccccccatctgcatgatgaacgccctggtgagagccctgaccgacagcacccccagagacctggactacagcagatactgccccaccgaccaggccgccgccggcaccgacgccgagcacgtgcagcagttctacaacctgctgaccgccagcatcgacgtgagcagaagctgggccgagaagatccccggcttcaccgacctgcccaaggaggaccagaccctgctgatcgagagcgccttcctggagctgttcgtgctgagactgagcatcagaagcaacaccgccgaggacaagttcgtgttctgcaacggcctggtgctgcacagactgcagtgcctgagaggcttcggcgagtggctggacagcatcaaggacttcagcctgaacctgcagagcctgaacctggacatccaggccctggcctgcctgagcgccctgagcatgatcaccgagagacacggcctgaaggagcccaagagagtggaggagctgtgcaacaagatcaccagcagcctgaaggaccaccagagcaagggccaggccctggagcccaccgagagcaaggtgctgggcgccctggtggagctgagaaagatctgcaccctgggcctgcagagaatcttctacctgaagctggaggacctggtgagcccccccagcatcatcgacaagctgttcctggacaccctgcccttctag

SEQ ID NO: 11956 - DNA, 1332 bp, Artificial Sequence
  Description of Artificial Sequence: Synthetic coding sequence
atgccctgcgtgcaggcccagtacagccccagcccccccggcagcagctacgccgcccagacctacagcagcgagtacaccaccgagatcatgaaccccgactacaccaagctgaccatggacctgggcagcaccgagatcaccgccaccgccaccaccagcctgcccagcatcagcaccttcgtggagggctacagcagcaactacgagctgaagcccagctgcgtgtaccagatgcagagacccctgatcaaggtggaggagggcagagcccccagctaccaccaccaccaccaccaccaccaccaccaccaccaccaccaccagcagcagcaccagcagcccagcatcccccccgccagcagccccgaggacgaggtgctgcccagcaccagcatgtacttcaagcagagcccccccagcacccccaccacccccgccttccccccccaggccggcgccctgtgggacgaggccctgcccagcgcccccggctgcatcgcccccggccccctgctggacccccccatgaaggccgtgcccaccgtggccggcgccagattccccctgttccacttcaagcccagccccccccacccccccgcccccagccccgccggcggccaccacctgggctacgaccccaccgccgccgccgccctgagcctgcccctgggcgccgccgccgccgccggcagccaggccgccgccctggagagccacccctacggcctgcccctggccaagagagccgcccccctggccttcccccccctgggcctgacccccagccccaccgccagcagcctgctgggcgagagccccagcctgcccagcccccccagcagaagcagcagcagcggcgagggcacctgcgccgtgtgcggcgacaacgccgcctgccagcactacggcgtgagaacctgcgagggctgcaagggcttcttcaagagaaccgtgcagaagaacgccaagtacgtgtgcctggccaacaagaactgccccgtggacaagagaagaagaaacagatgccagtactgcagattccagaagtgcctgagcgtgggcatggtgaaggaggtggtgagaaccgacagcctgaagggcagaagaggcagactgcccagcaagcccaagagccccctgcagcaggagcccagccagcccagcccccccagcccccccatctgcatgatgaacgccctggtgagagccctgaccgacagcacccccagagacctggactacagcagagtgagcttcatgatcagctgcttccagatgaacgaccagggcctgtacctgtggctgctggtgatcagagtggactag

SEQ ID NO: 11957 - DNA, 894 bp, Artificial Sequence
  Description of Artificial Sequence: Synthetic coding sequence
atgaaggccgtgcccaccgtggccggcgccagattccccctgttccacttcaagcccagccccccccacccccccgcccccagccccgccggcggccaccacctgggctacgaccccaccgccgccgccgccctgagcctgcccctgggcgccgccgccgccgccggcagccaggccgccgccctggagagccacccctacggcctgcccctggccaagagagccgcccccctggccttcccccccctgggcctgacccccagccccaccgccagcagcctgctgggcgagagccccagcctgcccagcccccccagcagaagcagcagcagcggcgagggcacctgcgccgtgtgcggcgacaacgccgcctgccagcactacggcgtgagaacctgcgagggctgcaagggcttcttcaagagaaccgtgcagaagaacgccaagtacgtgtgcctggccaacaagaactgccccgtggacaagagaagaagaaacagatgccagtactgcagattccagaagtgcctgagcgtgggcatggtgaaggaggtggtgagaaccgacagcctgaagggcagaagaggcagactgcccagcaagcccaagagccccctgcagcaggagcccagccagcccagcccccccagcccccccatctgcatgatgaacgccctggtgagagccctgaccgacagcacccccagagacctggactacagcagagtgagcttcatgatcagctgcttccagatgaacgaccagggcctgtacctgtggctgctggtgatcagagtgctggacagcttccacaccttcagcatcttcctggccagcttcagcaacagcgtgcaccccctgcagcagatcatcttcgccctgctgaacctgtag

SEQ ID NO: 11958 - DNA, 1881 bp, Artificial Sequence
  Description of Artificial Sequence: Synthetic coding sequence
atgccctgcgtgcaggcccagtacagccccagcccccccggcagcagctacgccgcccagacctacagcagcgagtacaccaccgagatcatgaaccccgactacaccaagctgaccatggacctgggcagcaccgagatcaccgccaccgccaccaccagcctgcccagcatcagcaccttcgtggagggctacagcagcaactacgagctgaagcccagctgcgtgtaccagatgcagagacccctgatcaaggtggaggagggcagagcccccagctaccaccaccaccaccaccaccaccaccaccaccaccaccaccaccagcagcagcaccagcagcccagcatcccccccgccagcagccccgaggacgaggtgctgcccagcaccagcatgtacttcaagcagagcccccccagcacccccaccacccccgccttccccccccaggccggcgccctgtgggacgaggccctgcccagcgcccccggctgcatcgcccccggccccctgctggacccccccatgaaggccgtgcccaccgtggccggcgccagattccccctgttccacttcaagcccagccccccccacccccccgcccccagccccgccggcggccaccacctgggctacgaccccaccgccgccgccgccctgagcctgcccctgggcgccgccgccgccgccggcagccaggccgccgccctggagagccacccctacggcctgcccctggccaagagagccgcccccctggccttcccccccctgggcctgacccccagccccaccgccagcagcctgctgggcgagagccccagcctgcccagcccccccagcagaagcagcagcagcggcgagggcacctgcgccgtgtgcggcgacaacgccgcctgccagcactacggcgtgagaacctgcgagggctgcaagggcttcttcaagagaaccgtgcagaagaacgccaagtacgtgtgcctggccaacaagaactgccccgtggacaagagaagaagaaacagatgccagtactgcagattccagaagtgcctgagcgtgggcatggtgaaggaggtggtgagaaccgacagcctgaagggcagaagaggcagactgcccagcaagcccaagagccccctgcagcaggagcccagccagcccagcccccccagcccccccatctgcatgatgaacgccctggtgagagccctgaccgacagcacccccagagacctggactacagcagatactgccccaccgaccaggccgccgccggcaccgacgccgagcacgtgcagcagttctacaacctgctgaccgccagcatcgacgtgagcagaagctgggccgagaagatccccggcttcaccgacctgcccaaggaggaccagaccctgctgatcgagagcgccttcctggagctgttcgtgctgagactgagcatcagaagcaacaccgccgaggacaagttcgtgttctgcaacggcctggtgctgcacagactgcagtgcctgagaggcttcggcgagtggctggacagcatcaaggacttcagcctgaacctgcagagcctgaacctggacatccaggccctggcctgcctgagcgccctgagcatgatcaccgagagacacggcctgaaggagcccaagagagtggaggagctgtgcaacaagatcaccagcagcctgaaggaccaccagagcaagggccaggccctggagcccaccgagagcaaggtgctgggcgccctggtggagctgagaaagatctgcaccctgggcctgcagagaatcttctacctgaagctggaggacctggtgagcccccccagcatcatcgacaagctgttcctggacaccctgcccttctag

SEQ ID NO: 11959 - DNA, 627 bp, Artificial Sequence
  Description of Artificial Sequence: Synthetic coding sequence
atgggcaacgcccaggagagacccagcgagaccatcgacagagagagaaagagactggtggagaccctgcaggccgacagcggcctgctgctggacgccctgctggccagaggcgtgctgaccggccccgagtacgaggccctggacgccctgcccgacgccgagagaagagtgagaagactgctgctgctggtgcagggcaagggcgaggccgcctgccaggagctgctgagatgcgcccagagaaccgccggcgcccccgaccccgcctgggactggcagcacgtgggccccggctacagagacagaagctacgaccccccctgccccggccactggacccccgaggcccccggcagcggcaccacctgccccggcctgcccagagccagcgaccccgacgaggccggcggccccgagggcagcgaggccgtgcagagcggcacccccgaggagcccgagcccgagctggaggccgaggccagcaaggaggccgagcccgagcccgagcccgagcccgagctggagcccgaggccgaggccgagcccgagcccgagctggagcccgagcccgaccccgagcccgagcccgacttcgaggagagagacgagagcgaggacagctag

SEQ ID NO: 11960 - DNA, 627 bp, Artificial Sequence; identical to SEQ ID NO: 11959
  Description of Artificial Sequence: Synthetic coding sequence

SEQ ID NO: 11961 - DNA, 2133 bp, Artificial Sequence
  Description of Artificial Sequence: Synthetic coding sequence
atggtgaagctggccaaggccggcaagaaccagggcgaccccaagaagatggcccccccccccaaggaggtggaggaggacagcgaggacgaggagatgagcgaggacgaggaggacgacagcagcggcgaggaggtggtgatcccccagaagaagggcaagaaggccgccgccaccagcgccaagaaggtggtggtgagccccaccaagaaggtggccgtggccacccccgccaagaaggccgccgtgacccccggcaagaaggccgccgccacccccgccaagaagaccgtgacccccgccaaggccgtgaccacccccggcaagaagggcgccacccccggcaaggccctggtggccacccccggcaagaagggcgccgccatccccgccaagggcgccaagaacggcaagaacgccaagaaggaggacagcgacgaggaggaggacgacgacagcgaggaggacgaggaggacgacgaggacgaggacgaggacgaggacgagatcgagcccgccgccatgaaggccgccgccgccgcccccgccagcgaggacgaggacgacgaggacgacgaggacgacgaggacgacgacgacgacgaggaggacgacagcgaggaggaggccatggagaccacccccgccaagggcaagaaggccgccaaggtggtgcccgtgaaggccaagaacgtggccgaggacgaggacgaggaggaggacgacgaggacgaggacgacgacgacgacgaggacgacgaggacgacgacgacgaggacgacgaggaggaggaggaggaggaggaggaggagcccgtgaaggaggcccccggcaagagaaagaaggagatggccaagcagaaggccgcccccgaggccaagaagcagaaggtggagggcaccgagcccaccaccgccttcaacctgttcgtgggcaacctgaacttcaacaagagcgcccccgagctgaagaccggcatcagcgacgtgttcgccaagaacgacctggccgtggtggacgtgagaatcggcatgaccagaaagttcggctacgtggacttcgagagcgccgaggacctggagaaggccctggagctgaccggcctgaaggtgttcggcaacgagatcaagctggagaagcccaagggcaaggacagcaagaaggagagagacgccagaaccctgctggccaagaacctgccctacaaggtgacccaggacgagctgaaggaggtgttcgaggacgccgccgagatcagactggtgagcaaggacggcaagagcaagggcatcgcctacatcgagttcaagaccgaggccgacgccgagaagaccttcgaggagaagcagggcaccgagatcgacggcagaagcatcagcctgtactacaccggcgagaagggccagaaccaggactacagaggcggcaagaacagcacctggagcggcgagagcaagaccctggtgctgagcaacctgagctacagcgccaccgaggagaccctgcaggaggtgttcgagaaggccaccttcatcaaggtgccccagaaccagaacggcaagagcaagggctacgccttcatcgagttcgccagcttcgaggacgccaaggaggccctgaacagctgcaacaagagagagatcgagggcagagccatcagactggagctgcagggccccagaggcagccccaacgccagaagccagcccagcaagaccctgttcgtgaagggcctgagcgaggacaccaccgaggagaccctgaaggagagcttcgacggcagcgtgagagccagaatcgtgaccgacagagagaccggcagcagcaagggcttcggcttcgtggacttcaacagcgaggaggacgccaaggccgccaaggaggccatggaggacggcgagatcgacggcaacaaggtgaccctggactgggccaagcccaagggcgagggcggcttcggcggcagaggcggcggcagaggcggcttcggcggcagaggcggcggcagaggcggcagaggcggcttcggcggcagaggcagaggcggcttcggcggcagaggcggcttcagaggcggcagaggcggcggcggcgaccacaagccccagggcaagaagaccaagttcgagtag

SEQ ID NO: 11962 - DNA, 1449 bp, Artificial Sequence
  Description of Artificial Sequence: Synthetic coding sequence
atggtgaagctggccaaggccggcaagaaccagggcgaccccaagaagatggcccccccccccaaggaggtggaggaggacagcgaggacgaggagatgagcgaggacgaggaggacgacagcagcggcgaggaggtggtgatcccccagaagaagggcaagaaggccgccgccaccagcgccaagaaggtggtggtgagccccaccaagaaggtggccgtggccacccccgccaagaaggccgccgtgacccccggcaagaaggccgccgccacccccgccaagaagaccgtgacccccgccaaggccgtgaccacccccggcaagaagggcgccacccccggcaaggccctggtggccacccccggcaagaagggcgccgccatccccgccaagggcgccaagaacggcaagaacgccaagaaggaggacagcgacgaggaggaggacgacgacagcgaggaggacgaggaggacgacgaggacgaggacgaggacgaggacgagatcgagcccgccgccatgaaggccgccgccgccgcccccgccagcgaggacgaggacgacgaggacgacgaggacgacgaggacggcaagagcaagggcatcgcctacatcgagttcaagaccgaggccgacgccgagaagaccttcgaggagaagcagggcaccgagatcgacggcagaagcatcagcctgtactacaccggcgagaagggccagaaccaggactacagaggcggcaagaacagcacctggagcggcgagagcaagaccctggtgctgagcaacctgagctacagcgccaccgaggagaccctgcaggaggtgttcgagaaggccaccttcatcaaggtgccccagaaccagaacggcaagagcaagggctacgccttcatcgagttcgccagcttcgaggacgccaaggaggccctgaacagctgcaacaagagagagatcgagggcagagccatcagactggagctgcagggccccagaggcagccccaacgccagaagccagcccagcaagaccctgttcgtgaagggcctgagcgaggacaccaccgaggagaccctgaaggagagcttcgacggcagcgtgagagccagaatcgtgaccgacagagagaccggcagcagcaagggcttcggcttcgtggacttcaacagcgaggaggacgccaaggccgccaaggaggccatggaggacggcgagatcgacggcaacaaggtgaccctggactgggccaagcccaagggcgagggcggcttcggcggcagaggcggcggcagaggcggcttcggcggcagaggcggcggcagaggcggcagaggcggcttcggcggcagaggcagaggcggcttcggcggcagaggcggcttcagaggcggcagaggcggcggcggcgaccacaagccccagggcaagaagaccaagttcgagtag

SEQ ID NO: 11963 - DNA, 1809 bp, Artificial Sequence
  Description of Artificial Sequence: Synthetic coding sequence
atggtgaagctggccaaggccggcaagaaccagggcgaccccaagaagatggcccccccccccaaggaggtggaggaggacagcgaggacgaggagatgagcgaggacgaggaggacgacagcagcggcgaggagctgaacgacgacttctaccagaccaccatgcacaccctgtggaagaagggcaagaaggccgccgccaccagcgccatccccgccaagggcgccaagaacggcaagaacgccaagaaggaggacagcgacgaggaggaggacgacgacagcgaggaggacgaggaggacgacgaggacgaggacgaggacgaggacgagatcgagcccgccgccatgaaggccgccgccgccgcccccgccagcgaggacgaggacgacgaggacgacgaggacgacgaggacgacgacgacgacgaggaggacgacgacgacgacgaggacgacgaggaggaggaggaggaggaggaggaggagcccgtgaaggaggcccccggcaagagaaagaaggagatggccaagcagaaggccgcccccgaggccaagaagcagaaggtggagggcaccgagcccaccaccgccttcaacctgttcgtgggcaacctgaacttcaacaagagcgcccccgagctgaagaccggcatcagcgacgtgttcgccaagaacgacctggccgtggtggacgtgagaatcggcatgaccagaaagttcggctacgtggacttcgagagcgccgaggacctggagaaggccctggagctgaccggcctgaaggtgttcggcaacgagatcaagctggagaagcccaagggcaaggacagcaagaaggagagagacgccagaaccctgctggccaagaacctgccctacaaggtgacccaggacgagctgaaggaggtgttcgaggacgccgccgagatcagactggtgagcaaggacggcaagagcaagggcatcgcctacatcgagttcaagaccgaggccgacgccgagaagaccttcgaggagaagcagggcaccgagatcgacggcagaagcatcagcctgtactacaccggcgagaagggccagaaccaggactacagaggcggcaagaacagcacctggagcggcgagagcaagaccctggtgctgagcaacctgagctacagcgccaccgaggagaccctgcaggaggtgttcgagaaggccaccttcatcaaggtgccccagaaccagaacggcaagagcaagggctacgccttcatcgagttcgccagcttcgaggacgccaaggaggccctgaacagctgcaacaagagagagatcgagggcagagccatcagactggagctgcagggccccagaggcagccccaacgccagaagccagcccagcaagaccctgttcgtgaagggcctgagcgaggacaccaccgaggagaccctgaaggagagcttcgacggcagcgtgagagccagaatcgtgaccgacagagagaccggcagcagcaagggcttcggcttcgtggacttcaacagcgaggaggacgccaaggccgccaaggaggccatggaggacggcgagatcgacggcaacaaggtgaccctggactgggccaagcccaagggcgagggcggcttcggcggcagaggcggcggcagaggcggcttcggcggcagaggcggcggcagaggcggcagaggcggcttcggcggcagaggcagaggcggcttcggcggcagaggcggcttcagaggcggcagaggcggcggcggcgaccacaagccccagggcaagaagaccaagttcgagtag

SEQ ID NO: 11964 - DNA, 885 bp, Artificial Sequence
  Description of Artificial Sequence: Synthetic coding sequence
atggaggacagcatggacatggacatgagccccctgagaccccagaactacctgttcggctgcgagctgaaggccgacaaggactaccacttcaaggtggacaacgacgagaacgagcaccagctgagcctgagaaccgtgagcctgggcgccggcgccaaggacgagctgcacatcgtggaggccgaggccatgaactacgagggcagccccatcaaggtgaccctggccaccctgaagatgagcgtgcagcccaccgtgagcctgggcggcttcgagatcaccccccccgtggtgctgagactgaagtgcggcagcggccccgtgcacatcagcggccagcacctggtggccgtggaggaggacgccgagagcgaggacgaggaggaggaggacgtgaagctgctgagcatcagcggcaagagaagcgcccccggcggcggcagcaaggtgccccagaagaaggtgaagctggccgccgacgaggacgacgacgacgacgacgaggaggacgacgacgaggacgacgacgacgacgacttcgacgacgaggaggccgaggagaaggcccccgtgaagaagagcatcagagacacccccgccaagaacgcccagaagagcaaccagaacggcaaggacagcaagcccagcagcacccccagaagcaagggccaggagagcttcaagaagcaggagaagacccccaagacccccaagggccccagcagcgtggaggacatcaaggccaagatgcaggccagcatcgagaagggcggcagcctgcccaaggtggaggccaagttcatcaactacgtgaagaactgcttcagaatgaccgaccaggaggccatccaggacctgtggcagtggagaaagagcctgtag

SEQ ID NO: 11965 - DNA, 798 bp, Artificial Sequence
  Description of Artificial Sequence: Synthetic coding sequence
atggaggacagcatggacatggacatgagccccctgagaccccagaactacctgttcggctgcgagctgaaggccgacaaggactaccacttcaaggtggacaacgacgagaacgagcaccagctgagcctgagaaccgtgagcctgggcgccggcgccaaggacgagctgcacatcgtggaggccgaggccatgaactacgagggcagccccatcaaggtgaccctggccaccctgaagatgagcgtgcagcccaccgtgagcctgggcggcttcgagatcaccccccccgtggtgctgagactgaagtgcggcagcggccccgtgcacatcagcggccagcacctggtggccgtggaggaggacgccgagagcgaggacgaggaggaggaggacgtgaagctgctgagcatcagcggcaagagaagcgcccccggcggcggcagcaaggtgccccagaagaaggtgaagctggccgccgacgaggacgacgacgacgacgacgaggaggacgacgacgaggacgacgacgacgacgacttcgacgacgaggaggccgaggagaaggcccccgtgaagaagggccaggagagcttcaagaagcaggagaagacccccaagacccccaagggccccagcagcgtggaggacatcaaggccaagatgcaggccagcatcgagaagggcggcagcctgcccaaggtggaggccaagttcatcaactacgtgaagaactgcttcagaatgaccgaccaggaggccatccaggacctgtggcagtggagaaagagcctgtag

SEQ ID NO: 11966 - DNA, 780 bp, Artificial Sequence
  Description of Artificial Sequence: Synthetic coding sequence
atggaggacagcatggacatggacatgagccccctgagaccccagaactacctgttcggctgcgagctgaaggccgacaaggactaccacttcaaggtggacaacgacgagaacgagcaccagctgagcctgagaaccgtgagcctgggcgccggcgccaaggacgagctgcacatcgtggaggccgaggccatgaactacgagggcagccccatcaaggtgaccctggccaccctgaagatgagcgtgcagcccaccgtgagcctgggcggcttcgagatcaccccccccgtggtgctgagactgaagtgcggcagcggccccgtgcacatcagcggccagcacctggtggccgtggaggaggacgccgagagcgaggacgaggaggaggaggacgtgaagctgctgagcatcagcggcaagagaagcgcccccggcggcggcagcaaggtgccccagaagaaggtgaagctggccgccgacgaggacgacgacgacgacgacgaggaggacgacgacgaggacgacgacgacgacgacttcgacgacgaggaggccgaggagaaggcccccgtgaagaagagcatcagagacacccccgccaagaacgcccagaagagcaaccagaacggcaaggacagcaagcccagcagcacccccagaagcaagggccaggagagcttcaagaagcaggagaagacccccaagacccccaagggccccagcagcgtggaggacatcaaggccaagatgcaggccagcatcgagaaggcccactag

SEQ ID NO: 11967 - DNA, 885 bp, Artificial Sequence; identical to SEQ ID NO: 11964
  Description of Artificial Sequence: Synthetic coding sequence

SEQ ID NO: 11968 - DNA, 867 bp, Artificial Sequence
  Description of Artificial Sequence: Synthetic coding sequence
atgaaggacagaacccaggagctgagaaccgccaaggacagcgacgacgacgacgacgtggccgtgaccgtggacagagacagattcatggacgagttcttcgagcaggtggaggagatcagaggcttcatcgacaagatcgccgagaacgtggaggaggtgaagagaaagcacagcgccatcctggccagccccaaccccgacgagaagaccaaggaggagctggaggagctgatgagcgacatcaagaagaccgccaacaaggtgagaagcaagctgaagagcatcgagcagagcatcgagcaggaggagggcctgaacagaagcagcgccgacctgagaatcagaaagacccagcacagcaccctgagcagaaagttcgtggaggtgatgagcgagtacaacgccacccagagcgactacagagagagatgcaagggcagaatccagagacagctggagatcaccggcagaaccaccaccagcgaggagctggaggacatgctggagagcggcaaccccgccatcttcgccagcggcatcatcatggacagcagcatcagcaagcaggccctgagcgagatcgagaccagacacagcgagatcatcaagctggagaacagcatcagagagctgcacgacatgttcatggacatggccatgctggtggagagccagggcgagatgatcgacagaatcgagtacaacgtggagcacgccgtggactacgtggagagagccgtgagcgacaccaagaaggccgtgaagtaccagagcaaggccagaagaaagaagatcatgatcatcatctgctgcgtgatcctgggcatcgtgatcgccagcaccgtgggcggcatcttcgcctag

SEQ ID NO: 11969 - DNA, 183 bp, Artificial Sequence
  Description of Artificial Sequence: Synthetic coding sequence
atggaggagcagggccacagcgagatggagatcatccccagcgagagccacccccacatccagctgctgaagagcaacagagagctgctggtgacccacatcagaaacacccagtgcctggtggacaacctgctgaagaacgactacttcagcgccgaggacgccgagatcgtgtgcgcctag

SEQ ID NO: 11970 - DNA, 183 bp, Artificial Sequence; identical to SEQ ID NO: 11969
  Description of Artificial Sequence: Synthetic coding sequence

SEQ ID NO: 11971 - DNA, 138 bp, Artificial Sequence
  Description of Artificial Sequence: Synthetic coding sequence
atggaggagcagggccacagcgagatggagatcatccccagcgagagccacccccacatccagctgctgaagagcaacagagagctgctggtgacccacatcagaaacacccagtgcctggtggacaacctgctgtag

SEQ ID NO: 11972 - DNA, 183 bp, Artificial Sequence; identical to SEQ ID NO: 11969
  Description of Artificial Sequence: Synthetic coding sequence

SEQ ID NO: 11973 - DNA, 750 bp, Artificial Sequence
  Description of Artificial Sequence: Synthetic coding sequence
atggaggagcagggccacagcgagatggagatcatccccagcgagagccacccccacatccagctgctgaagagcaacagagagctgctggtgacccacatcagaaacacccagtgcctggtggacaacctgctgaagaacgactacttcagcgccgaggacgccgagatcgtgtgcgcctgccccacccagcccgacaaggtgagaaagatcctggacctggtgcagagcaagggcgaggaggtgagcgagttcttcctgtacctgctgcagcagctggccgacgcctacgtggacctgagaccctggctgctggagatcggcttcagccccagcctgctgacccagagcaaggtggtggtgaacaccgaccccgtgagcagatacacccagcagctgagacaccacctgggcagagacagcaagttcgtgctgtgctacgcccagaaggaggagctgctgctggaggagatctacatggacaccatcatggagctggtgggcttcagcaacgagagcctgggcagcctgaacagcctggcctgcctgctggaccacaccaccggcatcctgaacgagcaggccgccagcagaaaggtgaccggctgcgtgtgcagaacctgcagcagcagcaccaccgccacccagagcggcacccccagaagatgcctgcccagctgctgcgccagccccacctggcccagcagccccagcatggcctggaccagctgcaccagaacctggacctag

SEQ ID NO: 11974 - DNA, 2340 bp, Artificial Sequence
  Description of Artificial Sequence: Synthetic coding sequence
atggaggagcagggccacagcgagatggagatcatccccagcgagagccacccccacatccagctgctgaagagcaacagagagctgctggtgacccacatcagaaacacccagtgcctggtggacaacctgctgaagaacgactacttcagcgccgaggacgccgagatcgtgtgcgcctgccccacccagcccgacaaggtgagaaagatcctggacctggtgcagagcaagggcgaggaggtgagcgagttcttcctgtacctgctgcagcagctggccgacgcctacgtggacctgagaccctggctgctggagatcggcttcagccccagcctgctgacccagagcaaggtggtggtgaacaccgaccccgtgagcagatacacccagcagctgagacaccacctgggcagagacagcaagttcgtgctgtgctacgcccagaaggaggagctgctgctggaggagatctacatggacaccatcatggagctggtgggcttcagcaacgagagcctgggcagcctgaacagcctggcctgcctgctggaccacaccaccggcatcctgaacgagcagggcgagaccatcttcatcctgggcgacgccggcgtgggcaagagcatgctgctgcagagactgcagagcctgtgggccaccggcagactggacgccggcgtgaagttcttcttccacttcagatgcagaatgttcagctgcttcaaggagagcgacagactgtgcctgcaggacctgctgttcaagcactactgctaccccgagagagaccccgaggaggtgttcgccttcctgctgagattcccccacgtggccctgttcaccttcgacggcctggacgagctgcacagcgacctggacctgagcagagtgcccgacagcagctgcccctgggagcccgcccaccccctggtgctgctggccaacctgctgagcggcaagctgctgaagggcgccagcaagctgctgaccgccagaaccggcatcgaggtgcccagacagttcctgagaaagaaggtgctgctgagaggcttcagccccagccacctgagagcctacgccagaagaatgttccccgagagagccctgcaggacagactgctgagccagctggaggccaaccccaacctgtgcagcctgtgcagcgtgcccctgttctgctggatcatcttcagatgcttccagcacttcagagccgccttcgagggcagcccccagctgcccgactgcaccatgaccctgaccgacgtgttcctgctggtgaccgaggtgcacctgaacagaatgcagcccagcagcctggtgcagagaaacaccagaagccccgtggagaccctgcacgccggcagagacaccctgtgcagcctgggccaggtggcccacagaggcatggagaagagcctgttcgtgttcacccaggaggaggtgcaggccagcggcctgcaggagagagacatgcagctgggcttcctgagagccctgcccgagctgggccccggcggcgaccagcagagctacgagttcttccacctgaccctgcaggccttcttcaccgccttcttcctggtgctggacgacagagtgggcacccaggagctgctgagattcttccaggagtggatgccccccgccggcgccgccaccaccagctgctacccccccttcctgcccttccagtgcctgcagggcagcggccccgccagagaggacctgttcaagaacaaggaccacttccagttcaccaacctgttcctgtgcggcctgctgagcaaggccaagcagaagctgctgagacacctggtgcccgccgccgccctgagaagaaagagaaaggccctgtgggcccacctgttcagcagcctgagaggctacctgaagagcctgcccagagtgcaggtggagagcttcaaccaggtgcaggccatgcccaccttcatctggatgctgagatgcatctacgagacccagagccagaaggtgggccagctggccgccagaggcatctgcgccaactacctgaagctgacctactgcaacgcctgcagcgccgactgcagcgccctgagcttcgtgctgcaccacttccccaagagactggccctggacctggacaacaacaacctgaacgactacggcgtgagagagctgcagccctgcttcagcagactgaccgtgctgagactgagcgtgaaccagatcaccgacggcggcgtgaaggtgctgagcgaggagctgaccaagtacaagatcgtgacctacctgggcctgtggaagagcgtggacaccatctgcttcaagaagcagggcctgctgaagtag

SEQ ID NO: 11975 - DNA, 495 bp, Artificial Sequence
  Description of Artificial Sequence: Synthetic coding sequence
atgaagtgcaagcccaaccagaccagaacctacgaccccgagggcttcaagaagagagccgcctgcctgtgcttcagaagcgagagagaggacgaggtgctgctggtgagcagcagcagataccccgacagatggatcgtgcccggcggcggcatggagcccgaggaggagcccggcggcgccgccgtgagagaggtgtacgaggaggccggcgtgaagggcaagctgggcagactgctgggcgtgttcgagcagaaccaggacagaaagcacagaacctacgtgtacgtgctgaccgtgaccgagctgctggaggactgggaggacagcgtgagcatcggcagaaagagagagtggttcaaggtggaggacgccatcaaggtgctgcagtgccacaagcccgtgcacgccgagtacctggagaagctgaagctgggcggcagccccaccaacggcaacagcatggcccccagcagccccgacagcgacccctag

SEQ ID NO: 11976 - DNA, 792 bp, Artificial Sequence
  Description of Artificial Sequence: Synthetic coding sequence
atgagcctgtactgcggcatcgcctgcagaagaaagttcttctggtgctacagactgctgagcacctacgtgaccaagaccagatacctgttcgagctgaaggaggacgacgacgcctgcaagaaggcccagcagaccggcgccttctacctgttccacagcctggcccccctgctgcagaccagcgcccaccagtacctggcccccagacacagcctgctggagctggagagactgctgggcaagttcggccaggacgcccagagaatcgaggacagcgtgctgatcggctgcagcgagcagcaggaggcctggttcgccctggacctgggcctggacagcagcttcagcatcagcgccagcctgcacaagcccgagatggagaccgagctgaagggcagcttcatcgagctgagaaaggccctgttccagctgaacgccagagacgccagcctgctgagcaccgcccaggccctgctgagatggcacgacgcccaccagttctgcagcagaagcggccagcccaccaagaagaacgtggccggcagcaagagagtgtgccccagcaacaacatcatctactacccccagatccaggtgaacctgagagagctggagaccgccgcctggttcagccacgacgaggtggccaccgccctgaagagaaagggcccctacacccagcagcagaacggcaccttccccttctggctgccccccaagctggccatcagccaccagctgatcaaggagtgggtggagaagcagacctgcagcagcctgcccgcctag

SEQ ID NO: 11977 - DNA, 1059 bp, Artificial Sequence
  Description of Artificial Sequence: Synthetic coding sequence
atgagcctgtactgcggcatcgcctgcagaagaaagttcttctggtgctacagactgctgagcacctacgtgaccaagaccagatacctgttcgagctgaaggaggacgacgacgcctgcaagaaggcccagcagaccggcgccttctacctgttccacagcctggcccccctgctgcagaccagcgcccaccagtacctggcccccagacacagcctgctggagctggagagactgctgggcaagttcggccaggacgcccagagaatcgaggacagcgtgctgatcggctgcagcgagcagcaggaggcctggttcgccctggacctgggcctggacagcagcttcagcatcagcgccagcctgcacaagcccgagatggagaccgagctgaagggcagcttcatcgagctgagaaaggccctgttccagctgaacgccagagacgccagcctgctgagcaccgcccaggccctgctgagatggcacgacgcccaccagttctgcagcagaagcggccagcccaccaagaagaacgtggccggcagcaagagagtgtgccccagcaacaacatcatctactacccccagatggcccccgtggccatcaccctggtgagcgacggcaccagatgcctgctggccagacagagcagcttccccaagggcatgtacagcgccctggccggcttctgcgacatcggcgagagcgtggaggagaccatcagaagagaggtggccgaggaggtgggcctggaggtggagagcctgcagtactacgccagccagcactggcccttccccagcggcagcctgatgatcgcctgccacgccaccgtgaagcccggccagaccgagatccaggtgaacctgagagagctggagaccgccgcctggttcagccacgacgaggtggccaccgccctgaagagaaagggcccctacacccagcagcagaacggcaccttccccttctggctgccccccaagctggccatcagccaccagctgatcaaggagtgggtggagaagcagacctgcagcagcctgcccgcctag

SEQ ID NO: 11978 - DNA, 708 bp, Artificial Sequence
  Description of Artificial Sequence: Synthetic coding sequence
atgagcctgtactgcggcatcgcctgcagaagaaagttcttctggtgctacagactgctgagcacctacgtgaccaagaccagatacctgttcgagctgaaggaggacgacgacgcctgcaagaaggcccagcagaccggcgccttctacctgttccacagcctggcccccctgctgcagaccagcgcccaccagtacctggcccccagacacagcctgctggagctggagagactgctgggcaagttcggccaggacgcccagagaatcgaggacagcgtgctgatcggctgcagcgagcagcaggaggcctggttcgccctggacctgggcctggacagcagcttcagcatcagcgccagcctgcacaagcccgagatggagaccgagctgaagggcagcttcatcgagctgagaaaggccctgttccagctgaacgccagagacgccagcctgctgagcaccgcccaggccctgctgagatggcacgacgcccaccagttctgcagcagaagcggccagcccaccaagaagaacgtggccggcagcaagagagtgtgccccagcaacaacatcatctactacccccaggtgaaggtgtggaagagacccagcgccgagaagctgcagaagagatgggactggagatggaaggcctgcagcaccatgcaccccagcatcggccccagcctggtggcccacagctag

SEQ ID NO: 11979 - DNA, 468 bp, Artificial Sequence
  Description of Artificial Sequence: Synthetic coding sequence
atggcccccgtggccatcaccctggtgagcgacggcaccagatgcctgctggccagacagagcagcttccccaagggcatgtacagcgccctggccggcttctgcgacatcggcgagagcgtggaggagaccatcagaagagaggtggccgaggaggtgggcctggaggtggagagcctgcagtactacgccagccagcactggcccttccccagcggcagcctgatgatcgcctgccacgccaccgtgaagcccggccagaccgagatccaggtgaacctgagagagctggagaccgccgcctggttcagccacgacgaggtggccaccgccctgaagagaaagggcccctacacccagcagcagaacggcaccttccccttctggctgccccccaagctggccatcagccaccagctgatcaaggagtgggtggagaagcagacctgcagcagcctgcccgcctag

SEQ ID NO: 11980 - DNA, 681 bp, Artificial Sequence
  Description of Artificial Sequence: Synthetic coding sequence
atggagaccgagctgaagggcagcttcatcgagctgagaaaggccctgttccagctgaacgccagagacgccagcctgctgagcaccgcccaggccctgctgagatggcacgacgcccaccagttctgcagcagaagcggccagcccaccaagaagaacgtggccggcagcaagagagtgtgccccagcaacaacatcatctactacccccagatggcccccgtggccatcaccctggtgagcgacggcaccagatgcctgctggccagacagagcagcttccccaagggcatgtacagcgccctggccggcttctgcgacatcggcgagagcgtggaggagaccatcagaagagaggtggccgaggaggtgggcctggaggtggagagcctgcagtactacgccagccagcactggcccttccccagcggcagcctgatgatcgcctgccacgccaccgtgaagcccggccagaccgagatccaggtgaacctgagagagctggagaccgccgcctggttcagccacgacgaggtggccaccgccctgaagagaaagggcccctacacccagcagcagaacggcaccttccccttctggctgccccccaagctggccatcagccaccagctgatcaaggagtgggtggagaagcagacctgcagcagcctgcccgcctag

SEQ ID NO: 11981 - DNA, 717 bp, Artificial Sequence
  Description of Artificial Sequence: Synthetic coding sequence
atgctgggccagcccgcccccctggagagattcgccagcagaagaccccaggtgctggccgtgagaaccgtgtgcgacctggtgctgggcaagatggacaaggactgcgagatgaagagaaccaccctggacagccccctgggcaagctggagctgagcggctgcgagcagggcctgcacgagatcaagctgctgggcaagggcaccagcgccgccgacgccgtggaggtgcccgcccccgccgccgtgctgggcggccccgagcccctgatgcagtgcaccgcctggctgaacgcctacttccaccagcccgaggccatcgaggagttccccgtgcccgccctgcaccaccccgtgttccagcaggagagcttcaccagacaggtgctgtggaagctgctgaaggtggtgaagttcggcgaggtgatcagctaccagcagctggccgccctggccggcaaccccaaggccgccagagccgtgggcggcgccatgagaggcaaccccgtgcccatcctgatcccctgccacagagtggtgtgcagcagcggcgccgtgggcaactacagcggcggcctggccgtgaaggagtggctgctggcccacgagggccacagactgggcaagcccggcctgggcggcagcagcggcctggccggcgcctggctgaagggcgccggcgccaccagcggcagcccccccgccggcagaaactag

SEQ ID NO: 11982 - DNA, 1569 bp, Artificial Sequence
  Description of Artificial Sequence: Synthetic coding sequence
atgagcagcagacccctggagagcccccccccctacagacccgacgagttcaagcccaaccactacgcccccagcaacgacatctacggcggcgagatgcacgtgagacccatgctgagccagcccgcctacagcttctaccccgaggacgagatcctgcacttctacaagtggaccagcccccccggcgtgatcagaatcctgagcatgctgatcatcgtgatgtgcatcgccatcttcgcctgcgtggccagcaccctggcctgggacagaggctacggcaccagcctgctgggcggcagcgtgggctacccctacggcggcagcggcttcggcagctacggcagcggctacggctacggctacggctacggctacggctacggcggctacaccgaccccagagccgccaagggcttcatgctggccatggccgccttctgcttcatcgccgccctggtgatcttcgtgaccagcgtgatcagaagcgagatgagcagaaccagaagatactacctgagcgtgatcatcgtgagcgccatcctgggcatcatggtgttcatcgccaccatcgtgtacatcatgggcgtgaaccccaccgcccagagcagcggcagcctgtacggcagccagatctacgccctgtgcaaccagttctacacccccgccgccaccggcctgtacgtggaccagtacctgtaccactactgcgtggtggacccccaggaggccatcgccatcgtgctgggcttcatgatcatcgtggccttcgccctgatcatcttcttcgccgtgaagaccagaagaaagatggacagatacgacaagagcaacatcctgtgggacaaggagcacatctacgacgagcagccccccaacgtggaggagtgggtgaagaacgtgagcgccggcacccaggacgtgcccagcccccccagcgactacgtggagagagtggacagccccatggcctacagcagcaacggcaaggtgaacgacaagagattctaccccgagagcagctacaagagcacccccgtgcccgaggtggtgcaggagctgcccctgaccagccccgtggacgacttcagacagcccagatacagcagcggcggcaacttcgagacccccagcaagagagcccccgccaagggcagagccggcagaagcaagagaaccgagcaggaccactacgagaccgactacaccaccggcggcgagagctgcgacgagctggaggaggactggatcagagagtacccccccatcaccagcgaccagcagagacagctgtacaagagaaacttcgacaccggcctgcaggagtacaagagcctgcagagcgagctggacgagatcaacaaggagctgagcagactggacaaggagctggacgactacagagaggagagcgaggagtacatggccgccgccgacgagtacaacagactgaagcaggtgaagggcagcgccgactacaagagcaagaagaaccactgcaagcagctgaagagcaagctgagccacatcaagaagatggtgggcgactacgacagacagaagacctag

SEQ ID NO: 11983 - DNA, 1407 bp, Artificial Sequence
  Description of Artificial Sequence: Synthetic coding sequence
atgagcagcagacccctggagagcccccccccctacagacccgacgagttcaagcccaaccactacgcccccagcaacgacatctacggcggcgagatgcacgtgagacccatgctgagccagcccgcctacagcttctaccccgaggacgagatcctgcacttctacaagtggaccagcccccccggcgtgatcagaatcctgagcatgctgatcatcgtgatgtgcatcgccatcttcgcctgcgtggccagcaccctggcctgggacagaggctacggcaccagcctgctgggcggcagcgtgggctacccctacggcggcagcggcttcggcagctacggcagcggctacggctacggctacggctacggctacggctacggcggctacaccgaccccagagccgccaagggcttcatgctggccatggccgccttctgcttcatcgccgccctggtgatcttcgtgaccagcgtgatcagaagcgagatgagcagaaccagaagatactacctgagcgtgatcatcgtgagcgccatcctgggcatcatggtgttcatcgccaccatcgtgtacatcatgggcgtgaaccccaccgcccagagcagcggcagcctgtacggcagccagatctacgccctgtgcaaccagttctacacccccgccgccaccggcctgtacgtggaccagtacctgtaccactactgcgtggtggacccccaggaggtgaagaacgtgagcgccggcacccaggacgtgcccagcccccccagcgactacgtggagagagtggacagccccatggcctacagcagcaacggcaaggtgaacgacaagagattctaccccgagagcagctacaagagcacccccgtgcccgaggtggtgcaggagctgcccctgaccagccccgtggacgacttcagacagcccagatacagcagcggcggcaacttcgagacccccagcaagagagcccccgccaagggcagagccggcagaagcaagagaaccgagcaggaccactacgagaccgactacaccaccggcggcgagagctgcgacgagctggaggaggactggatcagagagtacccccccatcaccagcgaccagcagagacagctgtacaagagaaacttcgacaccggcctgcaggagtacaagagcctgcagagcgagctggacgagatcaacaaggagctgagcagactggacaaggagctggacgactacagagaggagagcgaggagtacatggccgccgccgacgagtacaacagactgaagcaggtgaagggcagcgccgactacaagagcaagaagaaccactgcaagcagctgaagagcaagctgagccacatcaagaagatggtgggcgactacgacagacagaagacctag

SEQ ID NO: 11984 - DNA, 1569 bp, Artificial Sequence; identical to SEQ ID NO: 11982
  Description of Artificial Sequence: Synthetic coding sequence

SEQ ID NO: 11985 - DNA, 816 bp, Artificial Sequence
  Description of Artificial Sequence: Synthetic coding sequence
atgatcatcgtggccttcgccctgatcatcttcttcgccgtgaagaccagaagaaagatggacagatacgacaagagcaacatcctgtgggacaaggagcacatctacgacgagcagccccccaacgtggaggagtgggtgaagaacgtgagcgccggcacccaggacgtgcccagcccccccagcgactacgtggagagagtggacagccccatggcctacagcagcaacggcaaggtgaacgacaagagattctaccccgagagcagctacaagagcacccccgtgcccgaggtggtgcaggagctgcccctgaccagccccgtggacgacttcagacagcccagatacagcagcggcggcaacttcgagacccccagcaagagagcccccgccaagggcagagccggcagaagcaagagaaccgagcaggaccactacgagaccgactacaccaccggcggcgagagctgcgacgagctggaggaggactggatcagagagtacccccccatcaccagcgaccagcagagacagctgtacaagagaaacttcgacaccggcctgcaggagtacaagagcctgcagagcgagctggacgagatcaacaaggagctgagcagactggacaaggagctggacgactacagagaggagagcgaggagtacatggccgccgccgacgagtacaacagactgaagcaggtgaagggcagcgccgactacaagagcaagaagaaccactgcaagcagctgaagagcaagctgagccacatcaagaagatggtgggcgactacgacagacagaagacctag

SEQ ID NO: 11986 - DNA, 603 bp, Artificial Sequence
  Description of Artificial Sequence: Synthetic coding sequence
atggcctacagcagcaacggcaaggtgaacgacaagagattctaccccgagagcagctacaagagcacccccgtgcccgaggtggtgcaggagctgcccctgaccagccccgtggacgacttcagacagcccagatacagcagcggcggcaacttcgagacccccagcaagagagcccccgccaagggcagagccggcagaagcaagagaaccgagcaggaccactacgagaccgactacaccaccggcggcgagagctgcgacgagctggaggaggactggatcagagagtacccccccatcaccagcgaccagcagagacagctgtacaagagaaacttcgacaccggcctgcaggagtacaagagcctgcagagcgagctggacgagatcaacaaggagctgagcagactggacaaggagctggacgactacagagaggagagcgaggagtacatggccgccgccgacgagtacaacagactgaagcaggtgaagggcagcgccgactacaagagcaagaagaaccactgcaagcagctgaagagcaagctgagccacatcaagaagatggtgggcgactacgacagacagaagacctag

SEQ ID NO: 11987 - DNA, 3114 bp, Artificial Sequence
  Description of Artificial Sequence: Synthetic coding sequence
atgtggagatgcggcggcagacagggcctgtgcgtgctgagaagactgagcggcggccacgcccaccacagagcctggagatggaacagcaacagagcctgcgagagagccctgcagtacaagctgggcgacaagatccacggcttcaccgtgaaccaggtgaccagcgtgcccgagctgttcctgaccgccgtgaagctgacccacgacgacaccggcgccagatacctgcacctggccagagaggacaccaacaacctgttcagcgtgcagttcagaaccacccccatggacagcaccggcgtgccccacatcctggagcacaccgtgctgtgcggcagccagaagtacccctgcagagaccccttcttcaagatgctgaacagaagcctgagcaccttcatgaacgccttcaccgccagcgactacaccctgtaccccttcagcacccagaaccccaaggacttccagaacctgctgagcgtgtacctggacgccaccttcttcccctgcctgagagagctggacttctggcaggagggctggagactggagcacgagaaccccagcgacccccagacccccctggtgttcaagggcgtggtgttcaacgagatgaagggcgccttcgtgaacaacgagagaatcttcagccagcacctgcagaacagactgctgcccgaccacacctacagcgtggtgagcggcggcgaccccctgtgcatccccgagctgacctgggagcagctgaagcagttccacgccacccactaccaccccagcaacgccagattcttcacctacggcaacttccccctggagcagcacctgaagcagatccacgaggaggccctgagcaagttccagaagatcgagcccagcaccgtggtgcccgcccagaccccctgggacaagcccagagagttccagatcacctgcggccccgacagcttcgccaccgaccccagcaagcagaccaccatcagcgtgagcttcctgctgcccgacatcaccgacaccttcgaggccttcaccctgagcctgctgagcagcctgctgaccagcggccccaacagccccttctacaaggccctgatcgagagcggcctgggcaccgacttcagccccgacgtgggctacaacggctacaccagagaggcctacttcagcgtgggcctgcagggcatcgccgagaaggacatcgagaccgtgagaagcctgatcgacagaaccatcgacgaggtggtggagaagggcttcgaggacgacagaatcgaggccctgctgcacaagatcgagatccagatgaagcaccagagcaccagcttcggcctgatgctgaccagctacatcgccagctgctggaaccacgacggcgaccccgtggagctgctgaagctgggcaaccagctggccaagttcagacagtgcctgcaggagaaccccaagttcctgcaggagaaggtgaagcagtacttcaagaacaaccagcacaagctgaccctgagcatgagacccgacgacaagtaccacgagaagcaggcccaggtggaggccaccaagctgaagcagaaggtggaggccctgagccccggcgacagacagcagatctacgagaagggcctggagctgagaagccagcagagcaagccccaggacgccagctgcctgcccgccctgaaggtgagcgacatcgagcccaccatccccgtgaccgagctggacgtggtgctgaccgccggcgacatccccgtgcagtactgcgcccagcccaccaacggcatggtgtacttcagagccttcagcagcctgaacaccctgcccgaggagctgagaccctacgtgcccctgttctgcagcgtgctgaccaagctgggctgcggcctgctggactacagagagcaggcccagcagatcgagctgaagaccggcggcatgagcgccagcccccacgtgctgcccgacgacagccacatggacacctacgagcagggcgtgctgttcagcagcctgtgcctggacagaaacctgcccgacatgatgcagctgtggagcgagatcttcaacaacccctgcttcgaggaggaggagcacttcaaggtgctggtgaagatgaccgcccaggagctggccaacggcatccccgacagcggccacctgtacgccagcatcagagccggcagaaccctgacccccgccggcgacctgcaggagaccttcagcggcatggaccaggtgagactgatgaagagaatcgccgagatgaccgacatcaagcccatcctgagaaagctgcccagaatcaagaagcacctgctgaacggcgacaacatgagatgcagcgtgaacgccaccccccagcagatgccccagaccgagaaggccgtggaggacttcctgagaagcatcggcagaagcaagaaggagagaagacccgtgagaccccacaccgtggagaagcccgtgcccagcagcagcggcggcgacgcccacgtgccccacggcagccaggtgatcagaaagctggtgatggagcccaccttcaagccctggcagatgaagacccacttcctgatgcccttccccgtgaactacgtgggcgagtgcatcagaaccgtgccctacaccgaccccgaccacgccagcctgaagatcctggccagactgatgaccgccaagttcctgcacaccgagatcagagagaagggcggcgcctacggcggcggcgccaagctgagccacaacggcatcttcaccctgtacagctacagagaccccaacaccatcgagaccctgcagagcttcggcaaggccgtggactgggccaagagcggcaagttcacccagcaggacatcgacgaggccaagctgagcgtgttcagcaccgtggacgcccccgtggcccccagcgacaagggcatggaccacttcctgtacggcctgagcgacgagatgaagcaggcccacagagagcagctgttcgccgtgagccacgacaagctgctggccgtgagcgacagatacctgggcaccggcaagagcacccacggcctggccatcctgggccccgagaaccccaagatcgccaaggaccccagctggatcatccagtag

SEQ ID NO: 11988 - DNA, 1107 bp, Artificial Sequence
  Description of Artificial Sequence: Synthetic coding sequence
atgcagcccggcagcagcagatgcgaggaggagacccccagcctgctgtggggcctggaccccgtgttcctggccttcgccaagctgtacatcagagacatcctggacatgaaggagagcagacaggtgcccggcgtgttcctgtacaacggccaccccatcaagcaggtggacgtgctgggcaccgtgatcggcgtgagagagagagacgccttctacagctacggcgtggacgacagcaccggcgtgatcaactgcatctgctggaagaagctgaacaccgagagcgtgagcgccgcccccagcgccgccagagagctgagcctgaccagccagctgaagaagctgcaggagaccatcgagcagaagaccaagatcgagatcggcgacaccatcagagtgagaggcagcatcagaacctacagagaggagagagagatccacgccaccacctactacaaggtggacgaccccgtgtggaacatccagatcgccagaatgctggagctgcccaccatctacagaaaggtgtacgaccagcccttccacagcagcgccctggagaaggaggaggccctgagcaaccccggcgccctggacctgcccagcctgaccagcctgctgagcgagaaggccaaggagttcctgatggagaacagagtgcagagcttctaccagcaggagctggagatggtggagagcctgctgagcctggccaaccagcccgtgatccacagcgccagcagcgaccaggtgaacttcaagaaggacaccaccagcaaggccatccacagcatcttcaagaacgccatccagctgctgcaggagaagggcctggtgttccagaaggacgacggcttcgacaacctgtactacgtgaccagagaggacaaggacctgcacagaaagatccacagaatcatccagcaggactgccagaagcccaaccacatggagaagggctgccacttcctgcacatcctggcctgcgccagactgagcatcagacccggcctgagcgaggccgtgctgcagcaggtgctggagctgctggaggaccagagcgacatcgtgagcaccatggagcactactacaccgccttctag

SEQ ID NO: 11989 - DNA, 1038 bp, Artificial Sequence
  Description of Artificial Sequence: Synthetic coding sequence
atgggcgtgtgcggctacctgttcctgccctggaagtgcctggtggtggtgagcctgagactgctgttcctggtgcccaccggcgtgcccgtgagaagcggcgacgccaccttccccaaggccatggacaacgtgaccgtgagacagggcgagagcgccaccctgagatgcaccatcgacgacagagtgaccagagtggcctggctgaacagaagcaccatcctgtacgccggcaacgacaagtggagcatcgaccccagagtgatcatcctggtgaacacccccacccagtacagcatcatgatccagaacgtggacgtgtacgacgagggcccctacacctgcagcgtgcagaccgacaaccaccccaagaccagcagagtgcacctgatcgtgcaggtgcccccccagatcatgaacatcagcagcgacatcaccgtgaacgagggcagcagcgtgaccctgctgtgcctggccatcggcagacccgagcccaccgtgacctggagacacctgagcgtgaaggagggccagggcttcgtgagcgaggacgagtacctggagatcagcgacatcaagagagaccagagcggcgagtacgagtgcagcgccctgaacgacgtggccgcccccgacgtgagaaaggtgaagatcaccgtgaactaccccccctacatcagcaaggccaagaacaccggcgtgagcgtgggccagaagggcatcctgagctgcgaggccagcgccgtgcccatggccgagttccagtggttcaaggaggagaccagactggccaccggcctggacggcatgagaatcgagaacaagggcagaatgagcaccctgaccttcttcaacgtgagcgagaaggactacggcaactacacctgcgtggccaccaacaagctgggcaacaccaacgccagcatcaccctgtacggccccggcgccgtgatcgacggcgtgaacagcgccagcagagccctggcctgcctgtggctgagcggcaccctgctggcccacttcttcatcaagttctag

SEQ ID NO: 11990 - DNA, 939 bp, Artificial Sequence
  Description of Artificial Sequence: Synthetic coding sequence
atgtaccaccccgcctactgggtggtgttcagcgccaccaccgccctgctgttcatccccggcgtgcccgtgagaagcggcgacgccaccttccccaaggccatggacaacgtgaccgtgagacagggcgagagcgccaccctgagatgcaccatcgacgacagagtgaccagagtggcctggctgaacagaagcaccatcatgatccagaacgtggacgtgtacgacgagggcccctacacctgcagcgtgcagaccgacaaccaccccaagaccagcagagtgcacctgatcgtgcaggtgcccccccagatcatgaacatcagcagcgacatcaccgtgaacgagggcagcagcgtgaccctgctgtgcctggccatcggcagacccgagcccaccgtgacctggagacacctgagcgtgaaggagggccagggcttcgtgagcgaggacgagtacctggagatcagcgacatcaagagagaccagagcggcgagtacgagtgcagcgccctgaacgacgtggccgcccccgacgtgagaaaggtgaagatcaccgtgaactaccccccctacatcagcaaggccaagaacaccggcgtgagcgtgggccagaagggcatcctgagctgcgaggccagcgccgtgcccatggccgagttccagtggttcaaggaggagaccagactggccaccggcctggacggcatgagaatcgagaacaagggcagaatgagcaccctgaccttcttcaacgtgagcgagaaggactacggcaactacacctgcgtggccaccaacaagctgggcaacaccaacgccagcatcaccctgtacggccccggcgccgtgatcgacggcgtgaacagcgccagcagagccctggcctgcctgtggctgagcggcaccctgctggcccacttcttcatcaagttctag

SEQ ID NO: 11991 - DNA, 1017 bp, Artificial Sequence
  Description of Artificial Sequence: Synthetic coding sequence
atgtaccaccccgcctactgggtggtgttcagcgccaccaccgccctgctgttcatccccggcgtgcccgtgagaagcggcgacgccaccttccccaaggccatggacaacgtgaccgtgagacagggcgagagcgccaccctgagatgcaccatcgacgacagagtgaccagagtggcctggctgaacagaagcaccatcctgtacgccggcaacgacaagtggagcatcgaccccagagtgatcatcctggtgaacacccccacccagtacagcatcatgatccagaacgtggacgtgtacgacgagggcccctacacctgcagcgtgcagaccgacaaccaccccaagaccagcagagtgcacctgatcgtgcaggtgcccccccagatcatgaacatcagcagcgacatcaccgtgaacgagggcagcagcgtgaccctgctgtgcctggccatcggcagacccgagcccaccgtgacctggagacacctgagcgtgaaggagggccagggcttcgtgagcgaggacgagtacctggagatcagcgacatcaagagagaccagagcggcgagtacgagtgcagcgccctgaacgacgtggccgcccccgacgtgagaaaggtgaagatcaccgtgaactaccccccctacatcagcaaggccaagaacaccggcgtgagcgtgggccagaagggcatcctgagctgcgaggccagcgccgtgcccatggccgagttccagtggttcaaggaggagaccagactggccaccggcctggacggcatgagaatcgagaacaagggcagaatgagcaccctgaccttcttcaacgtgagcgagaaggactacggcaactacacctgcgtggccaccaacaagctgggcaacaccaacgccagcatcaccctgtacggccccggcgccgtgatcgacggcgtgaacagcgccagcagagccctggcctgcctgtggctgagcggcaccctgctggcccacttcttcatcaagttctag

SEQ ID NO: 11992 - DNA, 1065 bp, Artificial Sequence
  Description of Artificial Sequence: Synthetic coding sequence
atgggcgtgtgcggctacctgttcctgccctggaagtgcctggtggtggtgagcctgagactgctgttcctggtgcccaccggcgtgcccgtgagaagcggcgacgccaccttccccaaggccatggacaacgtgaccgtgagacagggcgagagcgccaccctgagatgcaccatcgacgacagagtgaccagagtggcctggctgaacagaagcaccatcctgtacgccggcaacgacaagtggagcatcgaccccagagtgatcatcctggtgaacacccccacccagtacagcatcatgatccagaacgtggacgtgtacgacgagggcccctacacctgcagcgtgcagaccgacaaccaccccaagaccagcagagtgcacctgatcgtgcaggtgcccccccagatcatgaacatcagcagcgacatcaccgtgaacgagggcagcagcgtgaccctgctgtgcctggccatcggcagacccgagcccaccgtgacctggagacacctgagcgtgaaggagggccagggcttcgtgagcgaggacgagtacctggagatcagcgacatcaagagagaccagagcggcgagtacgagtgcagcgccctgaacgacgtggccgcccccgacgtgagaaaggtgaagatcaccgtgaactaccccccctacatcagcaaggccaagaacaccggcgtgagcgtgggccagaagggcatcctgagctgcgaggccagcgccgtgcccatggccgagttccagtggttcaaggaggagaccagactggccaccggcctggacggcatgagaatcgagaacaagggcagaatgagcaccctgaccttcttcaacgtgagcgagaaggactacggcaactacacctgcgtggccaccaacaagctgggcaacaccaacgccagcatcaccctgtacgagatcagccccagcagcgccgtggccggccccggcgccgtgatcgacggcgtgaacagcgccagcagagccctggcctgcctgtggctgagcggcaccctgctggcccacttcttcatcaagttctag

SEQ ID NO: 11993 - DNA, 1662 bp, Artificial Sequence
  Description of Artificial Sequence: Synthetic coding sequence
atgagcaacaacggcctggacatccaggacaagccccccgccccccccatgagaaacaccagcaccatgatcggcgccggcagcaaggacgccggcaccctgaaccacggcagcaagcccctgccccccaaccccgaggagaagaagaagaaggacagattctacagaagcatcctgcccggcgacaagaccaacaagaagaaggagaaggagagacccgagatcagcctgcccagcgacttcgagcacaccatccacgtgggcttcgacgccgtgaccggcgagttcaccggcatgcccgagcagtgggccagactgctgcagaccagcaacatcaccaagagcgagcagaagaagaacccccaggccgtgctggacgtgctggagttctacaacagcaagaagaccagcaacagccagaagtacatgagcttcaccgacaagagcgccgaggactacaacagcagcaacgccctgaacgtgaaggccgtgagcgagacccccgccgtgccccccgtgagcgaggacgaggacgacgacgacgacgacgccacccccccccccgtgatcgcccccagacccgagcacaccaagagcgtgtacaccagaagcgtgatcgagcccctgcccgtgacccccaccagagacgtggccaccagccccatcagccccaccgagaacaacaccaccccccccgacgccctgaccagaaacaccgagaagcagaagaagaagcccaagatgagcgacgaggagatcctggagaagctgagaagcatcgtgagcgtgggcgaccccaagaagaagtacaccagattcgagaagatcggccagggcgccagcggcaccgtgtacaccgccatggacgtggccaccggccaggaggtggccatcaagcagatgaacctgcagcagcagcccaagaaggagctgatcatcaacgagatcctggtgatgagagagaacaagaaccccaacatcgtgaactacctggacagctacctggtgggcgacgagctgtgggtggtgatggagtacctggccggcggcagcctgaccgacgtggtgaccgagacctgcatggacgagggccagatcgccgccgtgtgcagagagtgcctgcaggccctggagttcctgcacagcaaccaggtgatccacagagacatcaagagcgacaacatcctgctgggcatggacggcagcgtgaagctgaccgacttcggcttctgcgcccagatcacccccgagcagagcaagagaagcaccatggtgggcaccccctactggatggcccccgaggtggtgaccagaaaggcctacggccccaaggtggacatctggagcctgggcatcatggccatcgagatgatcgagggcgagcccccctacctgaacgagaaccccctgagagccctgtacctgatcgccaccaacggcacccccgagctgcagaaccccgagaagctgagcgccatcttcagagacttcctgaacagatgcctggagatggacgtggagaagagaggcagcgccaaggagctgctgcaggtgagaaagctgagattccaggtgttcagcaacttcagcatgatcgccgccagcatccccgaggactgccaggcccccctgcagccccacagcaccgactgctgcagctag

SEQ ID NO: 11994 - DNA, 1638 bp, Artificial Sequence
  Description of Artificial Sequence: Synthetic coding sequence
atgagcaacaacggcctggacatccaggacaagccccccgccccccccatgagaaacaccagcaccatgatcggcgccggcagcaaggacgccggcaccctgaaccacggcagcaagcccctgccccccaaccccgaggagaagaagaagaaggacagattctacagaagcatcctgcccggcgacaagaccaacaagaagaaggagaaggagagacccgagatcagcctgcccagcgacttcgagcacaccatccacgtgggcttcgacgccgtgaccggcgagttcaccggcatgcccgagcagtgggccagactgctgcagaccagcaacatcaccaagagcgagcagaagaagaacccccaggccgtgctggacgtgctggagttctacaacagcaagaagaccagcaacagccagaagtacatgagcttcaccgacaagagcgccgaggactacaacagcagcaacgccctgaacgtgaaggccgtgagcgagacccccgccgtgccccccgtgagcgaggacgaggacgacgacgacgacgacgccacccccccccccgtgatcgcccccagacccgagcacaccaagagcgtgtacaccagaagcgtgatcgagcccctgcccgtgacccccaccagagacgtggccaccagccccatcagccccaccgagaacaacaccaccccccccgacgccctgaccagaaacaccgagaagcagaagaagaagcccaagatgagcgacgaggagatcctggagaagctgagaagcatcgtgagcgtgggcgaccccaagaagaagtacaccagattcgagaagatcggccagggcgccagcggcaccgtgtacaccgccatggacgtggccaccggccaggaggtggccatcaagcagatgaacctgcagcagcagcccaagaaggagctgatcatcaacgagatcctggtgatgagagagaacaagaaccccaacatcgtgaactacctggacagctacctggtgggcgacgagctgtgggtggtgatggagtacctggccggcggcagcctgaccgacgtggtgaccgagacctgcatggacgagggccagatcgccgccgtgtgcagagagtgcctgcaggccctggagttcctgcacagcaaccaggtgatccacagagacatcaagagcgacaacatcctgctgggcatggacggcagcgtgaagctgaccgacttcggcttctgcgcccagatcacccccgagcagagcaagagaagcaccatggtgggcaccccctactggatggcccccgaggtggtgaccagaaaggcctacggccccaaggtggacatctggagcctgggcatcatggccatcgagatgatcgagggcgagcccccctacctgaacgagaaccccctgagagccctgtacctgatcgccaccaacggcacccccgagctgcagaaccccgagaagctgagcgccatcttcagagacttcctgaacagatgcctggagatggacgtggagaagagaggcagcgccaaggagctgctgcagcaccagttcctgaagatcgccaagcccctgagcagcctgacccccctgatcgccgccgccaaggaggccaccaagaacaaccactag

SEQ ID NO: 11995 - DNA, 300 bp, Artificial Sequence
  Description of Artificial Sequence: Synthetic coding sequence
atgagcaacaacggcctggacatccaggacaagccccccgccccccccatgagaaacaccagcaccatgatcggcgccggcagcaaggacgccggcaccctgaaccacggcagcaagcccctgccccccaaccccgaggagaagaagaagaaggacagattctacagaagcatcctgcccggcgacaagaccaacaagaagaaggagaaggagagacccgagatcagcctgcccagcgacttcgagcacaccatccacgtgggcttcgacgccgtgaccggcgagttcaccggcatgtag

SEQ ID NO: 11996 - DNA, 81 bp, Artificial Sequence
  Description of Artificial Sequence: Synthetic coding sequence
atgagcaacaacggcctggacatccaggacaagccccccgccccccccatgagaaacaccagcaccatgatcggcgcctag

SEQ ID NO: 11997 - DNA, 270 bp, Artificial Sequence
  Description of Artificial Sequence: Synthetic coding sequence
atgagcaacaacggcctggacatccaggacaagccccccgccccccccatgagaaacaccagcaccatgatcggcgccggcagcaaggacgccggcaccctgaaccacggcagcaagcccctgccccccaaccccgaggagaagaagaagaaggacagattctacagaagcatcctgcccggcgacaagaccaacaagaagaaggagaaggagagacccgagatcagcctgcccagcgacttcgagcacaccatccacgtgggcttctag

SEQ ID NO: 11998 - DNA, 192 bp, Artificial Sequence
  Description of Artificial Sequence: Synthetic coding sequence
atgagcaacaacggcctggacatccaggacaagccccccgccccccccatgagaaacaccagcaccatgatcggcgccggcagcaaggacgccggcaccctgaaccacggcagcaagcccctgccccccaaccccgaggagaagaagaagaaggacagattctacagaagcatcctgcccggcgacaagtag

SEQ ID NO: 11999 - DNA, 321 bp, Artificial Sequence
  Description of Artificial Sequence: Synthetic coding sequence
atgagcaacaacggcctggacatccaggacaagccccccgccccccccatgagaaacaccagcaccatgatcggcgccggcagcaaggacgccggcaccctgaaccacggcagcaagcccctgccccccaaccccgaggagaagaagaagaaggacagattctacagaagcatcctgcccggcgacaagaccaacaagaagaaggagaaggagagacccgagatcagcctgcccagcgacttcgagcacaccatccacgtgggcttcgacgccgtgaccggcgagttcaccggcatgcccgagcagtgggccagactgtag

SEQ ID NO: 12000 - DNA, 1569 bp, Artificial Sequence
  Description of Artificial Sequence: Synthetic coding sequence
atgagcaacaacggcctggacatccaggacaagccccccgccccccccatgagaaacaccagcaccatgatcggcgccggcagcaaggacgccggcaccctgaaccacggcagcaagcccctgccccccaaccccgaggagaagaagaagaaggacagattctacagaagcatcctgcccggcgacaagaccaacaagaagaaggagaaggagagacccgagatcagcctgcccagcgacttcgagcacaccatccacgtgggcttcgacgccgtgaccggcgagttcaccggcatgcccgagcagtgggccagactgctgcagaccagcaacatcaccaagagcgagcagaagaagaacccccaggccgtgctggacgtgctggagttctacaacagcaagaagaccagcaacagccagaagtacatgagcttcaccgacaagagcgccgaggactacaacagcagcaacgccctgaacgtgaaggccgtgagcgagacccccgccgtgccccccgtgagcgaggacgaggacgacgacgacgacgacgccacccccccccccgtgatcgcccccagacccgagcacaccaagagcgtgtacaccagaagcgtgatcgagcccctgcccgtgacccccaccagagacgtggccaccagccccatcagccccaccgagaacaacaccaccccccccgacgccctgaccagaaacaccgagaagcagaagaagaagcccaagatgagcgacgaggagatcctggagaagctgagaagcatcgtgagcgtgggcgaccccaagaagaagtacaccagattcgagaagatcggccagggcgccagcggcaccgtgtacaccgccatggacgtggccaccggccaggaggtggccatcaagcagatgaacctgcagcagcagcccaagaaggagctgatcatcaacgagatcctggtgatgagagagaacaagaaccccaacatcgtgaactacctggacagctacctggtgggcgacgagctgtgggtggtgatggagtacctggccggcggcagcctgaccgacgtggtgaccgagacctgcatggacgagggccagatcgccgccgtgtgcagagagtgcctgcaggccctggagttcctgcacagcaaccaggtgatccacagagacatcaagagcgacaacatcctgctgggcatggacggcagcgtgaagctgaccgacttcggcttctgcgcccagatcacccccgagcagagcaagagaagcaccatggtgggcaccccctactggatggcccccgaggtggtgaccagaaaggcctacggccccaaggtggacatctggagcctgggcatcatggccatcgagatgatcgagggcgagcccccctacctgaacgagaaccccctgagagccctgtacctgatcgccaccaacggcacccccgagctgcagaaccccgagaagctgagcgccatcttcagagacttcctgaacagatgcctggagatggacgtggagaagagaggcagcgccaaggagctgctgcagcacagcagcagactgtag

SEQ ID NO: 12001 - DNA, 1317 bp, Artificial Sequence
  Description of Artificial Sequence: Synthetic coding sequence
atgttcggcaagagaaagaagagagtggagatcagcgcccccagcaacttcgagcacagagtgcacaccggcttcgaccagcacgagcagaagttcaccggcctgcccagacagtggcagagcctgatcgaggagagcgccagaagacccaagcccctggtggaccccgcctgcatcaccagcatccagcccggcgcccccaagggcgagccccacgacgtggcccccaacggccccagcgccggcggcctggccatcccccagagcagcagcagcagcagcagaccccccaccagagccagaggcgcccccagccccggcgtgctgggcccccacgccagcgagccccagctggccccccccgcctgcacccccgccgcccccgccgtgcccggcccccccggccccagaagcccccagagagagccccagagagtgagccacgagcagttcagagccgccctgcagctggtggtggaccccggcgaccccagaagctacctggacaacttcatcaagatcggcgagggcagcaccggcatcgtgtgcatcgccaccgtgagaagcagcggcaagctggtggccgtgaagaagatggacctgagaaagcagcagagaagagagctgctgttcaacgaggtggtgatcatgagagactaccagcacgagaacgtggtggagatgtacaacagctacctggtgggcgacgagctgtgggtggtgatggagttcctggagggcggcgccctgaccgacatcgtgacccacaccagaatgaacgaggagcagatcgccgccgtgtgcctggccgtgctgcaggccctgagcgtgctgcacgcccagggcgtgatccacagagacatcaagagcgacagcatcctgctgacccacgacggcagagtgaagctgagcgacttcggcttctgcgcccaggtgagcaaggaggtgcccagaagaaagagcctggtgggcaccccctactggatggcccccgagctgatcagcagactgccctacggccccgaggtggacatctggagcctgggcatcatggtgatcgagatggtggacggcgagcccccctacttcaacgagccccccctgaaggccatgaagatgatcagagacaacctgccccccagactgaagaacctgcacaaggtgagccccagcctgaagggcttcctggacagactgctggtgagagaccccgcccagagagccaccgccgccgagctgctgaagcaccccttcctggccaaggccggcccccccgccagcatcgtgcccctgatgagacagaacagaaccagatag

SEQ ID NO: 12002 - DNA, 1776 bp, Artificial Sequence
  Description of Artificial Sequence: Synthetic coding sequence
atgttcggcaagagaaagaagagagtggagatcagcgcccccagcaacttcgagcacagagtgcacaccggcttcgaccagcacgagcagaagttcaccggcctgcccagacagtggcagagcctgatcgaggagagcgccagaagacccaagcccctggtggaccccgcctgcatcaccagcatccagcccggcgcccccaagaccatcgtgagaggcagcaagggcgccaaggacggcgccctgaccctgctgctggacgagttcgagaacatgagcgtgaccagaagcaacagcctgagaagagacagcccccccccccccgccagagccagacaggagaacggcatgcccgaggagcccgccaccaccgccagaggcggccccggcaaggccggcagcagaggcagattcgccggccacagcgaggccggcggcggcagcggcgacagaagaagagccggccccgagaagagacccaagagcagcagagagggcagcggcggcccccaggagagcagcagagacaagagacccctgagcggccccgacgtgggcaccccccagcccgccggcctggccagcggcgccaagctggccgccggcagacccttcaacacctaccccagagccgacaccgaccaccccagcagaggcgcccagggcgagccccacgacgtggcccccaacggccccagcgccggcggcctggccatcccccagagcagcagcagcagcagcagaccccccaccagagccagaggcgcccccagccccggcgtgctgggcccccacgccagcgagccccagctggccccccccgcctgcacccccgccgcccccgccgtgcccggcccccccggccccagaagcccccagagagagccccagagagtgagccacgagcagttcagagccgccctgcagctggtggtggaccccggcgaccccagaagctacctggacaacttcatcaagatcggcgagggcagcaccggcatcgtgtgcatcgccaccgtgagaagcagcggcaagctggtggccgtgaagaagatggacctgagaaagcagcagagaagagagctgctgttcaacgaggtggtgatcatgagagactaccagcacgagaacgtggtggagatgtacaacagctacctggtgggcgacgagctgtgggtggtgatggagttcctggagggcggcgccctgaccgacatcgtgacccacaccagaatgaacgaggagcagatcgccgccgtgtgcctggccgtgctgcaggccctgagcgtgctgcacgcccagggcgtgatccacagagacatcaagagcgacagcatcctgctgacccacgacggcagagtgaagctgagcgacttcggcttctgcgcccaggtgagcaaggaggtgcccagaagaaagagcctggtgggcaccccctactggatggcccccgagctgatcagcagactgccctacggccccgaggtggacatctggagcctgggcatcatggtgatcgagatggtggacggcgagcccccctacttcaacgagccccccctgaaggccatgaagatgatcagagacaacctgccccccagactgaagaacctgcacaaggtgagccccagcctgaagggcttcctggacagactgctggtgagagaccccgcccagagagccaccgccgccgagctgctgaagcaccccttcctggccaaggccggcccccccgccagcatcgtgcccctgatgagacagaacagaaccagatag

SEQ ID NO: 12003 - DNA, 1188 bp, Artificial Sequence
  Description of Artificial Sequence: Synthetic coding sequence
atgggctgccagagaagcagacccttcaacacctaccccagagccgacaccgaccaccccagcagaggcgcccagggcgagccccacgacgtggcccccaacggccccagcgccggcggcctggccatcccccagagcagcagcagcagcagcagaccccccaccagagccagaggcgcccccagccccggcgtgctgggcccccacgccagcgagccccagctggccccccccgcctgcacccccgccgcccccgccgtgcccggcccccccggccccagaagcccccagagagagccccagagagtgagccacgagcagttcagagccgccctgcagctggtggtggaccccggcgaccccagaagctacctggacaacttcatcaagatcggcgagggcagcaccggcatcgtgtgcatcgccaccgtgagaagcagcggcaagctggtggccgtgaagaagatggacctgagaaagcagcagagaagagagctgctgttcaacgaggtggtgatcatgagagactaccagcacgagaacgtggtggagatgtacaacagctacctggtgggcgacgagctgtgggtggtgatggagttcctggagggcggcgccctgaccgacatcgtgacccacaccagaatgaacgaggagcagatcgccgccgtgtgcctggccgtgctgcaggccctgagcgtgctgcacgcccagggcgtgatccacagagacatcaagagcgacagcatcctgctgacccacgacggcagagtgaagctgagcgacttcggcttctgcgcccaggtgagcaaggaggtgcccagaagaaagagcctggtgggcaccccctactggatggcccccgagctgatcagcagactgccctacggccccgaggtggacatctggagcctgggcatcatggtgatcgagatggtggacggcgagcccccctacttcaacgagccccccctgaaggccatgaagatgatcagagacaacctgccccccagactgaagaacctgcacaaggtgagccccagcctgaagggcttcctggacagactgctggtgagagaccccgcccagagagccaccgccgccgagctgctgaagcaccccttcctggccaaggccggcccccccgccagcatcgtgcccctgatgagacagaacagaaccagatag

SEQ ID NO: 12004 - DNA, 1776 bp, Artificial Sequence; identical to SEQ ID NO: 12002
  Description of Artificial Sequence: Synthetic coding sequence

SEQ ID NO: 12005 - DNA, 1776 bp, Artificial Sequence; identical to SEQ ID NO: 12002
  Description of Artificial Sequence: Synthetic coding sequence

SEQ ID NO: 12006 - DNA, 1044 bp, Artificial Sequence
  Description of Artificial Sequence: Synthetic coding sequence
atgacctggcccctgaccggccaccagagaggcgcctggcccagccccagcccccccccccccccccccggcctgccccccgagcccgaggtgccccccgccctggagtgctgggaccccaccccccagagccccagaagcccccagagagagccccagagagtgagccacgagcagttcagagccgccctgcagctggtggtggaccccggcgaccccagaagctacctggacaacttcatcaagatcggcgagggcagcaccggcatcgtgtgcatcgccaccgtgagaagcagcggcaagctggtggccgtgaagaagatggacctgagaaagcagcagagaagagagctgctgttcaacgaggtggtgatcatgagagactaccagcacgagaacgtggtggagatgtacaacagctacctggtgggcgacgagctgtgggtggtgatggagttcctggagggcggcgccctgaccgacatcgtgacccacaccagaatgaacgaggagcagatcgccgccgtgtgcctggccgtgctgcaggccctgagcgtgctgcacgcccagggcgtgatccacagagacatcaagagcgacagcatcctgctgacccacgacggcagagtgaagctgagcgacttcggcttctgcgcccaggtgagcaaggaggtgcccagaagaaagagcctggtgggcaccccctactggatggcccccgagctgatcagcagactgccctacggccccgaggtggacatctggagcctgggcatcatggtgatcgagatggtggacggcgagcccccctacttcaacgagccccccctgaaggccatgaagatgatcagagacaacctgccccccagactgaagaacctgcacaaggtgagccccagcctgaagggcttcctggacagactgctggtgagagaccccgcccagagagccaccgccgccgagctgctgaagcaccccttcctggccaaggccggcccccccgccagcatcgtgcccctgatgagacagaacagaaccagatag

SEQ ID NO: 12007 - DNA, 1776 bp, Artificial Sequence; identical to SEQ ID NO: 12002
  Description of Artificial Sequence: Synthetic coding sequence

SEQ ID NO: 12008 - DNA, 1317 bp, Artificial Sequence; identical to SEQ ID NO: 12001
  Description of Artificial Sequence: Synthetic coding sequence

SEQ ID NO: 12009 - DNA, 1458 bp, Artificial Sequence
  Description of Artificial Sequence: Synthetic coding sequence
atggcccccaccatccagacccaggcccagagagaggacggccacagaagcggcgtggtgtgcagagtgaagtactgcaacagcctgcccgacatccccttcgaccccaagttcatcacctaccccttcgaccagaacagattcgtgcagtacaaggccaccagcctggagaagcagcacaagcacgacctgctgaccgagcccgacctgggcgtgaccatcgacctgatcaaccccgacacctacagaatcgaccccaacgtgctgctggaccccgccgacgagaagctgctggaggaggagatccaggcccccaccagcagcaagagaagccagcagcacgccaaggtggtgccctggatgagaaagaccgagtacatcagcaccgagttcaacagatacggcatcagcaacgagaagcccgaggtgaagatcggcgtgagcgtgaagcagcagttcaccgaggaggagatctacaaggacagagacagccagatcaccgccatcgagaagaccttcgaggacgcccagaagagcatcagccagcactacagcaagcccagagtgacccccgtggaggtgatgcccgtgttccccgacttcaagatgtggatcaacccctgcgcccaggtgatcttcgacagcgaccccgcccccaaggacaccagcggcgccgccgccctggagatgatgagccaggccatgatcagaggcatgatggacgaggagggcaaccagttcgtggcctacttcctgcccgtggaggagaccctgaagaagagaaagagagaccaggaggaggagatggactacgcccccgacgacgtgtacgactacaagatcgccagagagtacaactggaacgtgaagaacaaggccagcaagggctacgaggagaactacttcttcatcttcagagagggcgacggcgtgtactacaacgagctggagaccagagtgagactgagcaagagaagagccaaggccggcgtgcagagcggcaccaacgccctgctggtggtgaagcacagagacatgaacgagaaggagctggaggcccaggaggccagaaaggcccagctggagaaccacgagcccgaggaggaggaggaggaggagatggagaccgaggagaaggaggccggcggcagcgtgatgctgatcctgagaaccatgcccaccctgatgatgagaaccgaggacagacccaaggtggccgtgaccatgatccagaccgccgccgccatgggcgtggccagcggcgccggcgccaccgccgccgcccccgtgcccagccccgtggccgccagcaccagacccagaagaatggccgtgaagctgcagctgctgatccccgtgaagctgatcgtgaccgtgaccgagagccagggcatccagggctggttcagacaccactactgcgagcagcagagcaccttcctggtggtgtgcctgtag

SEQ ID NO: 12010 - DNA, 873 bp, Artificial Sequence
  Description of Artificial Sequence: Synthetic coding sequence
atgggccacccccccctgctgcccctgctgctgctgctgcacacctgcgtgcccgccagctggggcctgagatgcatgcagtgcaagaccaacggcgactgcagagtggaggagtgcgccctgggccaggacctgtgcagaaccaccatcgtgagactgtgggaggagggcgaggagctggagctggtggagaagagctgcacccacagcgagaagaccaacagaaccctgagctacagaaccggcctgaagatcaccagcctgaccgaggtggtgtgcggcctggacctgtgcaaccagggcaacagcggcagagccgtgacctacagcagaagcagatacctggagtgcatcagctgcggcagcagcgacatgagctgcgagagaggcagacaccagagcctgcagtgcagaagccccgaggagcagtgcctggacgtggtgacccactggatccaggagggcgaggaggtgctggagctggagaacctgccccagaacggcagacagtgctacagctgcaagggcaacagcacccacggctgcagcagcgaggagaccttcctgatcgactgcagaggccccatgaaccagtgcctggtggccaccggcacccacgagcccaagaaccagagctacatggtgagaggctgcgccaccgccagcatgtgccagcacgcccacctgggcgacgccttcagcatgaaccacatcgacgtgagctgctgcaccaagagcggctgcaaccaccccgacctggacgtgcagtacagaagcggcgccgccccccagcccggccccgcccacctgagcctgaccatcaccctgctgatgaccgccagactgtggggcggcaccctgctgtggacctag

SEQ ID NO: 12011 - DNA, 1596 bp, Artificial Sequence
  Description of Artificial Sequence: Synthetic coding sequence
atggcccccaccatccagacccaggcccagagagaggacggccacagacccaacagccacagaaccctgcccgagagaagcggcgtggtgtgcagagtgaagtactgcaacagcctgcccgacatccccttcgaccccaagttcatcacctaccccttcgaccagaacagattcgtgcagtacaaggccaccagcctggagaagcagcacaagcacgacctgctgaccgagcccgacctgggcgtgaccatcgacctgatcaaccccgacacctacagaatcgaccccaacgtgctgctggaccccgccgacgagaagctgctggaggaggagatccaggcccccaccagcagcaagagaagccagcagcacgccaaggtggtgccctggatgagaaagaccgagtacatcagcaccgagttcaacagatacggcatcagcaacgagaagcccgaggtgaagatcggcgtgagcgtgaagcagcagttcaccgaggaggagatctacaaggacagagacagccagatcaccgccatcgagaagaccttcgaggacgcccagaagagcatcagccagcactacagcaagcccagagtgacccccgtggaggtgatgcccgtgttccccgacttcaagatgtggatcaacccctgcgcccaggtgatcttcgacagcgaccccgcccccaaggacaccagcggcgccgccgccctggagatgatgagccaggccatgatcagaggcatgatggacgaggagggcaaccagttcgtggcctacttcctgcccgtggaggagaccctgaagaagagaaagagagaccaggaggaggagatggactacgcccccgacgacgtgtacgactacaagatcgccagagagtacaactggaacgtgaagaacaaggccagcaagggctacgaggagaactacttcttcatcttcagagagggcgacggcgtgtactacaacgagctggagaccagagtgagactgagcaagagaagagccaaggccggcgtgcagagcggcaccaacgccctgctggtggtgaagcacagagacatgaacgagaaggagctggaggcccaggaggccagaaaggcccagctggagaaccacgagcccgaggaggaggaggaggaggagatggagaccgaggagaaggaggccggcggcagcgacgaggagcaggagaagggcagcagcagcgagaaggagggcagcgaggacgagcacagcggcagcgagagcgagagagaggagggcgacagagacgaggccagcgacaagagcggcagcggcgaggacgagagcagcgaggacgaggccagagccgccagagacaaggaggagatcttcggcagcgacgccgacagcgaggacgacgccgacagcgacgacgaggacagaggccaggcccagggcggcagcgacaacgacagcgacagcggcagcaacggcggcggccagagaagcagaagccacagcagaagcgccagccccttccccagcggcagcgagcacagcgcccaggaggacggcagcgaggccgccgccagcgacagcagcgaggccgacagcgacagcgactag

SEQ ID NO: 12012 - DNA, 867 bp, Artificial Sequence
  Description of Artificial Sequence: Synthetic coding sequence
atggccaccggccccatccccaccggcctgtgcctgagaggcctggagtggagcgccgagagcagcaccgccatcgccagcctgatcagccccagcacccccagcagcagccccacccccagcaccagaaccgtgctgctggaccccgccgacgagaagctgctggaggaggagatccaggcccccaccagcagcaagagaagccagcagcacgccaaggtggtgccctggatgagaaagaccgagtacatcagcaccgagttcaacagatacggcatcagcaacgagaagcccgaggtgaagatcggcgtgagcgtgaagcagcagttcaccgaggaggagatctacaaggacagagacagccagatcaccgccatcgagaagaccttcgaggacgcccagaagagcatcagccagcactacagcaagcccagagtgacccccgtggaggtgatgcccgtgttccccgacttcaagatgtggatcaacccctgcgcccaggtgatcttcgacagcgaccccgcccccaaggacaccagcggcgccgccgccctggagatgatgagccaggccatgatcagaggcatgatggacgaggagggcaaccagttcgtggcctacttcctgcccgtggaggagaccctgaagaagagaaagagagaccaggaggaggagatggactacgcccccgacgacgtgtacgactacaagatcgccagagagtacaactggaacgtgaagaacaaggccagcaagggctacgaggagaactacttcttcatcttcagagagggcgacggcgtgtactacaacgagctggagaccagcatccagtacagccacatgctgtacaacctggtggcctag

SEQ ID NO: 12013 - DNA, 1176 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggagaagatcgccgagtacaagagacagaaccccaccatgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagaccaccgagtacagcgccatggccagcctggccggcggcctggacgacatgaaggccaacctggccagccccacccccgccgacatcggcagcagcgtgcccggcccccagagctaccccatcgtgaccggcagagacctggccagcaccaccctgcccggctaccccccccacgtgccccccgccggccagggcagctacagcgcccccaccctgaccggcatggtgcccggcagcgagttcagcggcagcccctacagccacccccagtacagcagctacaacgacagctggagattccccaaccccggcctgctgggcagcccctactactacagcgccgccgccagaggcgccgccccccccgccgccgccaccgcctacgacagacactag

SEQ ID NO: 12014 - DNA, 867 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggagaagatcgccgagtacaagagacagaaccccaccatgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcaggccgtgacctggagagccagacccagccccggcaccctgcacaccagcccccccctggacagagccgccacccagcacagaagatag

SEQ ID NO: 12015 - DNA, 987 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggagaagatcgccgagtacaagagacagaaccccaccatgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagaccaccgagtacagcgccatggccagcctggccggcggcctggacgacatgaaggccaacctggccagccccacccccgccgacatcggcagcagcgtgcccggcccccagagctaccccatcgtgaccggcagcccctactactacagcgccgccgccagaggcgccgccccccccgccgccgccaccgcctacgacagacactag

SEQ ID NO: 12016 - DNA, 909 bp, Artificial Sequence
  Description of Artificial Sequence: Synthetic coding sequence
atgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagtggtgccccgtgctgatgagacagtacctggtgcagccccaggccgtgctgttccagaccaccgagtacagcgccatggccagcctggccggcggcctggacgacatgaaggccaacctggccagccccacccccgccgacatcggcagcagcgtgcccggcccccagagctaccccatcgtgaccggcagagacctggccagcaccaccctgcccggctaccccccccacgtgccccccgccggccagggcagctacagcgcccccaccctgaccggcatggtgcccggcagcgagttcagcggcagcccctacagccacccccagtacagcagctacaacgacagctggagattccccaaccccggcctgctgggcagcccctactactacagcgccgccgccagaggcgccgccccccccgccgccgccaccgcctacgacagacactag

SEQ ID NO: 12017 - DNA, 1074 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggagaagatcgccgagtacaagagacagaaccccaccatgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagaccaccgagtacagcgccatggccagcctggccggcggcctggacgacatgaaggccaacctggccagccccacccccgccgacatcggcagcagcgtgcccggcccccagagctaccccatcgtgaccggcagcgagttcagcggcagcccctacagccacccccagtacagcagctacaacgacagctggagattccccaaccccggcctgctgggcagcccctactactacagcgccgccgccagaggcgccgccccccccgccgccgccaccgcctacgacagacactag

SEQ ID NO: 12018 - DNA, 1089 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggagaagatcgccgagtacaagagacagaaccccaccatgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagaccaccgagtacagcgccatggccagcctggccggcggcctggacgacatgaaggccaacctggccagccccacccccgccgacatcggcagcagcgtgcccggcccccagagctaccccatcgtgaccggcagagacctggccagcaccaccctgcccggctaccccccccacgtgccccccgccggccagggcagctacagcgcccccaccctgaccggcatggtgcccggcagcccctactactacagcgccgccgccagaggcgccgccccccccgccgccgccaccgcctacgacagacactag

SEQ ID NO: 12019 - DNA, 1047 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggagaagatcgccgagtacaagagacagaaccccaccatgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagaccaccgagtacagcgccatggccagcctggccggcggcctggacgacatgaaggccaacctggccagccccacccccgccgacatcggcagcagcgtgcccggcccccagagctaccccatcgtgaccggcagagacctggccagcaccaccctgcccggctaccccccccacgtgccccccgccggccagggcagctacagcgcccccaccctgaccggcatggtgcccggcagcgagttcagcggcagcccctacagccacccccagtacagcagctacaacgacagctggagattccccaaccccggcctgctgggcagcccctactactacagcgccgccgccagaggcgccgccccccccgccgccgccaccgcctacgacagacactag

SEQ ID NO: 12020 - DNA, 876 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagaccaccgagtacagcgccatggccagcctggccggcggcctggacgacatgaaggccaacctggccagccccacccccgccgacatcggcagcagcgtgcccggcccccagagctaccccatcgtgaccggcagcgagttcagcggcagcccctacagccacccccagtacagcagctacaacgacagctggagattccccaaccccggcctgctgggcagcccctactactacagcgccgccgccagaggcgccgccccccccgccgccgccaccgcctacgacagacactag

SEQ ID NO: 12021 - DNA, 960 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggagaagatcgccgagtacaagagacagaaccccaccatgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagaccaccgagtacagcgccatggccagcctggccggcggcctggacgacatgaaggccaacctggccagccccacccccgccgacatcggcagcagcgtgcccggcccccagagctaccccatcgtgaccggcagagacctggccagcaccaccctgcccggctaccccccccacgtgccccccgccggccagggcagctacagcgcccccaccctgaccggcatggtgcccggcagcccctactactacagcgccgccgccagaggcgccgccccccccgccgccgccaccgcctacgacagacactag

SEQ ID NO: 12022 - DNA, 852 bp, Artificial Sequence
  Description of Artificial Sequence: Synthetic coding sequence
atgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagaccaccgagtacagcgccatggccagcctggccggcggcctggacgacatgaaggccaacctggccagccccacccccgccgacatcggcagcagcgtgcccggcccccagagctaccccatcgtgaccggcagagacctggccagcaccaccctgcccggctaccccccccacgtgccccccgccggccagggcagctacagcgcccccaccctgaccggcatggtgcccggcagcgagttcagcggcagcccctacagccacccccagtacagcagctacaacgacagctggagattccccaaccccggcctgctgggcagcccctactactacagcgccgccgccagaggcgccgccccccccgccgccgccaccgcctacgacagacactag

SEQ ID NO: 12023 - DNA, 924 bp, Artificial Sequence
  Description of Artificial Sequence: Synthetic coding sequence
atggacctggagaagaactaccccacccccagaaccagcagaaccggccacggcggcgtgaaccagctgggcggcgtgttcgtgaacggcagacccctgcccgacgtggtgagacagagaatcgtggagctggcccaccagggcgtgagaccctgcgacatcagcagacagctgagagtgagccacggctgcgtgagcaagatcctgggcagatactacgagaccggcagcatcaagcccggcgtgatcggcggcagcaagcccaaggtggccacccccaaggtggtggagaagatcgccgagtacaagagacagaaccccaccatgttcgcctgggagatcagagacagactgctggccgagagagtgtgcgacaacgacaccgtgcccagcgtgagcagcatcaacagaatcatcagaaccaaggtgcagcagccccccaaccagcccgtgcccgccagcagccacagcatcgtgagcaccggcagcgtgacccaggtgagcagcgtgagcaccgacagcgccggcagcagctacagcatcagcggcatcctgggcatcaccagccccagcgccgacaccaacaagagaaagagagacgagggcatccaggagagccccgtgcccaacggccacagcctgcccggcagagacttcctgagaaagcagatgagaggcgacctgttcacccagcagcagctggaggtgctggacagagtgttcgagagacagcactacagcgacatcttcaccaccaccgagcccatcaagcccgagcagtggtgccccgtgctgatgagacagtacctggtgcagccccaggccgtgctgttccaggccgtgacctggagagccagacccagccccggcaccctgcacaccagcccccccctggacagagccgccacccagcacagaagatag

SEQ ID NO: 12024 - DNA, 1197 bp, Artificial Sequence
  Description of Artificial Sequence: Synthetic coding sequence
atgccccacaacagcatcagaagcggccacggcggcctgaaccagctgggcggcgccttcgtgaacggcagacccctgcccgaggtggtgagacagagaatcgtggacctggcccaccagggcgtgagaccctgcgacatcagcagacagctgagagtgagccacggctgcgtgagcaagatcctgggcagatactacgagaccggcagcatcagacccggcgtgatcggcggcagcaagcccaaggtggccacccccaaggtggtggagaagatcggcgactacaagagacagaaccccaccatgttcgcctgggagatcagagacagactgctggccgagggcgtgtgcgacaacgacaccgtgcccagcgtgagcagcatcaacagaatcatcagaaccaaggtgcagcagcccttcaacctgcccatggacagctgcgtggccaccaagagcctgagccccggccacaccctgatccccagcagcgccgtgaccccccccgagagcccccagagcgacagcctgggcagcacctacagcatcaacggcctgctgggcatcgcccagcccggcagcgacaagagaaagatggacgacagcgaccaggacagctgcagactgagcatcgacagccagagcagcagcagcggccccagaaagcacctgagaaccgacgccttcagccagcaccacctggagcccctggagtgccccttcgagagacagcactaccccgaggcctacgccagccccagccacaccaagggcgagcagggcctgtaccccctgcccctgctgaacagcaccctggacgacggcaaggccaccctgacccccagcaacacccccctgggcagaaacctgagcacccaccagacctaccccgtggtggccgccccccccttctggatctgcagcaagagcgcccccggcagcagacccagcatgcccttccccatgctgcccccctgcaccggcagcagcagagccagacccagcagccagggcgagagatggtggggccccagatgccccgacacccaccccaccagcccccccgccgacagagccgccatgccccccctgcccagccaggcctggtggcaggaggtgaacaccctggccatgcccatggccaccccccccaccccccccaccgccagacccggcgccagccccacccccgcctgctag

SEQ ID NO: 12025 - DNA, 966 bp, Artificial Sequence
  Description of Artificial Sequence: Synthetic coding sequence
atgccccacaacagcatcagaagcggccacggcggcctgaaccagctgggcggcgccttcgtgaacggcagacccctgcccgaggtggtgagacagagaatcgtggacctggcccaccagggcgtgagaccctgcgacatcagcagacagctgagagtgagccacggctgcgtgagcaagatcctgggcagatactacgagaccggcagcatcagacccggcgtgatcggcggcagcaagcccaaggtggccacccccaaggtggtggagaagatcggcgactacaagagacagaaccccaccatgttcgcctgggagatcagagacagactgctggccgagggcgtgtgcgacaacgacaccgtgcccagcgtgagcagcatcaacagaatcatcagaaccaaggtgcagcagcccttcaacctgcccatggacagctgcgtggccaccaagagcctgagccccggccacaccctgatccccagcagcgccgtgaccccccccgagagcccccagagcgacagcctgggcagcacctacagcatcaacggcctgctgggcatcgcccagcccggcagcgacaagagaaagatggacgacagcgaccaggacagctgcagactgagcatcgacagccagagcagcagcagcggccccagaaagcacctgagaaccgacgccttcagccagcaccacctggagcccctggagtgccccttcgagagacagcactaccccgaggcctacgccagccccagccacaccaagggcgagcagggcgagagatggtggggccccagatgccccgacacccaccccaccagcccccccgccgacagagccgccatgccccccctgcccagccaggcctggtggcaggaggtgaacaccctggccatgcccatggccaccccccccaccccccccaccgccagacccggcgccagccccacccccgcctgctag

SEQ ID NO: 12026 - DNA, 1197 bp, Artificial Sequence; identical to SEQ ID NO: 12024
  Description of Artificial Sequence: Synthetic coding sequence

SEQ ID NO: 12027 - DNA, 864 bp, Artificial Sequence
  Description of Artificial Sequence: Synthetic coding sequence
atgccccacaacagcatcagaagcggccacggcggcctgaaccagctgggcggcgccttcgtgaacggcagacccctgcccgaggtggtgagacagagaatcgtggacctggcccaccagggcgtgagaccctgcgacatcagcagacagctgagagtgagccacggctgcgtgagcaagatcctgggcagatactacgagaccggcagcatcagacccggcgtgatcggcggcagcaagcccaaggtggccacccccaaggtggtggagaagatcggcgactacaagagacagaaccccaccatgttcgcctgggagatcagagacagactgctggccgagggcgtgtgcgacaacgacaccgtgcccagcgtgagcagcatcaacagaatcatcagaaccaaggtgcagcagcccttcaacctgcccatggacagctgcgtggccaccaagagcctgagccccggccacaccctgatccccagcagcgccgtgaccccccccgagagcccccagagcgacagcctgggcagcacctacagcatcaacggcctgctgggcatcgcccagcccggcagcgacaagagaaagatggacgacagcgaccaggacagctgcagactgagcatcgacagccagagcagcagcagcggccccagaaagcacctgagaaccgacgccttcagccagcaccacctggagcccctggagtgccccttcgagagacagcactaccccgaggcctacgccagccccagccacaccaagggcgagcaggaggtgaacaccctggccatgcccatggccaccccccccaccccccccaccgccagacccggcgccagccccacccccgcctgctag

SEQ ID NO: 12028 - DNA, 1353 bp, Artificial Sequence
  Description of Artificial Sequence: Synthetic coding sequence
atgccccacaacagcatcagaagcggccacggcggcctgaaccagctgggcggcgccttcgtgaacggcagacccctgcccgaggtggtgagacagagaatcgtggacctggcccaccagggcgtgagaccctgcgacatcagcagacagctgagagtgagccacggctgcgtgagcaagatcctgggcagatactacgagaccggcagcatcagacccggcgtgatcggcggcagcaagcccaaggtggccacccccaaggtggtggagaagatcggcgactacaagagacagaaccccaccatgttcgcctgggagatcagagacagactgctggccgagggcgtgtgcgacaacgacaccgtgcccagcgtgagcagcatcaacagaatcatcagaaccaaggtgcagcagcccttcaacctgcccatggacagctgcgtggccaccaagagcctgagccccggccacaccctgatccccagcagcgccgtgaccccccccgagagcccccagagcgacagcctgggcagcacctacagcatcaacggcctgctgggcatcgcccagcccggcagcgacaagagaaagatggacgacagcgaccaggacagctgcagactgagcatcgacagccagagcagcagcagcggccccagaaagcacctgagaaccgacgccttcagccagcaccacctggagcccctggagtgccccttcgagagacagcactaccccgaggcctacgccagccccagccacaccaagggcgagcagggcctgtaccccctgcccctgctgaacagcaccctggacgacggcaaggccaccctgacccccagcaacacccccctgggcagaaacctgagcacccaccagacctaccccgtggtggccgacccccacagccccttcgccatcaagcaggagacccccgaggtgagcagcagcagcagcacccccagcagcctgagcagcagcgccttcctggacctgcagcaggtgggcagcggcgtgccccccttcaacgccttcccccacgccgccagcgtgtacggccagttcaccggccaggccctgctgagcggcagagagatggtgggccccaccctgcccggctaccccccccacatccccaccagcggccagggcagctacgccagcagcgccatcgccggcatggtggccggcagcgagtacagcggcaacgcctacggccacaccccctacagcagctacagcgaggcctggagattccccaacagcagcctgctgagcagcccctactactacagcagcaccagcagacccagcgccccccccaccaccgccaccgccttcgaccacctgtag

SEQ ID NO: 12029 - DNA, 570 bp, Artificial Sequence
  Description of Artificial Sequence: Synthetic coding sequence
atggccagcaagagagccctggtgatcctggccaagggcgccgaggagatggagaccgtgatccccgtggacgtgatgagaagagccggcatcaaggtgaccgtggccggcctggccggcaaggaccccgtgcagtgcagcagagacgtggtgatctgccccgacgccagcctggaggacgccaagaaggagggcccctacgacgtggtggtgctgcccggcggcaacctgggcgcccagaacctgagcgagagcgccgccgtgaaggagatcctgaaggagcaggagaacagaaagggcctgatcgccgccatctgcgccggccccaccgccctgctggcccacgagatcggcttcggcagcaaggtgaccacccaccccctggccaaggacaagatgatgaacggcggccactacacctacagcgagaacagagtggagaaggacggcctgatcctgaccagcagaggccccggcaccagcttcgagttcgccctggccatcgtggaggccctgaacggcaaggaggtggccgcccaggtgaaggcccccctggtgctgaaggactag

SEQ ID NO: 12030 - DNA, 570 bp, Artificial Sequence; identical to SEQ ID NO: 12029
  Description of Artificial Sequence: Synthetic coding sequence

SEQ ID NO: 12031 - DNA, 570 bp, Artificial Sequence; identical to SEQ ID NO: 12029
  Description of Artificial Sequence: Synthetic coding sequence

SEQ ID NO: 12032 - DNA, 570 bp, Artificial Sequence; identical to SEQ ID NO: 12029
  Description of Artificial Sequence: Synthetic coding sequence

SEQ ID NO: 12033 - DNA, 3561 bp, Artificial Sequence
  Description of Artificial Sequence: Synthetic coding sequence
atggacgagccccccggcaagcccctgagctgcgaggagaaggagaagctgaaggagaagctggccttcctgaagagagagtacagcaagaccctggccagactgcagagagcccagagagccgagaagatcaagcacagcatcaagaagaccgtggaggagcaggactgcctgagccagcaggacctgagcccccagctgaagcacagcgagcccaagaacaagatctgcgtgtacgacaagctgcacatcaagacccacctggacgaggagaccggcgagaagaccagcatcaccctggacgtgggccccgagagcttcaaccccggcgacggccccggcggcctgcccatccagagaaccgacgacacccaggagcacttcccccacagagtgagcgaccccagcggcgagcagaagcagaagctgcccagcagaagaaagaagcagcagaagagaaccttcatcagccaggagagagactgcgtgttcggcaccgacagcctgagactgagcggcaagagactgaaggagcaggaggagatcagcagcaagaaccccgccagaagccccgtgaccgagatcagaacccacctgctgagcctgaagagcgagctgcccgacagccccgagcccgtgaccgagatcaacgaggacagcgtgctgatcccccccaccgcccagcccgagaagggcgtggacaccttcctgagaagacccaacttcaccagagccaccaccgtgcccctgcagaccctgagcgacagcggcagcagccagcacctggagcacatcccccccaagggcagcagcgagctgaccacccacgacctgaagaacatcagattcaccagccccgtgagcctggaggcccagggcaagaagatgaccgtgagcaccgacaacctgctggtgaacaaggccatcagcaagagcggccagctgcccaccagcagcaacctggaggccaacatcagctgcagcctgaacgagctgacctacaacaacctgcccgccaacgagaaccagaacctgaaggagcagaaccagaccgagaagagcctgaagagccccagcgacaccctggacggcagaaacgagaacctgcaggagagcgagatcctgagccagcccaagagcctgagcctggaggccaccagccccctgagcgccgagaagcacagctgcaccgtgcccgagggcctgctgttccccgccgagtactacgtgagaaccaccagaagcatgagcaactgccagagaaaggtggccgtggaggccgtgatccagagccacctggacgtgaagaagaagggcttcaagaacaagaacaaggacgccagcaagaacctgaacctgagcaacgaggagaccgaccagagcgagatcagaatgagcggcacctgcaccggccagcccagcagcagaaccagccagaagctgctgagcctgaccaaggtgagcagccccgccggccccaccgaggacaacgacctgagcagaaaggccgtggcccaggcccccggcagaagatacaccggcaagagaaagagcgcctgcacccccgccagcgaccactgcgagcccctgctgcccaccagcagcctgagcatcgtgaacagaagcaaggaggaggtgaccagccacaagtaccagcacgagaagctgttcatccaggtgaagggcaagaagagcagacaccagaaggaggacagcctgagctggagcaacagcgcctacctgagcctggacgacgacgccttcaccgcccccttccacagagacggcatgctgagcctgaagcagctgctgagcttcctgagcatcaccgacttccagctgcccgacgaggacttcggccccctgaagctggagaaggtgaagagctgcagcgagaagcccgtggagcccttcgagagcaagatgttcggcgagagacacctgaaggagggcagctgcatcttccccgaggagctgagccccaagagaatggacaccgagatggaggacctggaggaggacctgatcgtgctgcccggcaagagccaccccaagagacccaacagccagagccagcacaccaagaccggcctgagcagcagcatcctgctgtacacccccctgaacaccgtggcccccgacgacaacgacagacccaccaccgacatgtgcagccccgccttccccatcctgggcaccacccccgccttcggcccccagggcagctacgagaaggccagcaccgaggtggccggcagaacctgctgcaccccccagctggcccacctgaaggacagcgtgtgcctggccagcgacaccaagcagttcgacagcagcggcagccccgccaagccccacaccaccctgcaggtgagcggcagacagggccagcccacctgcgactgcgacagcgtgccccccggcacccccccccccatcgagagcttcaccttcaaggagaaccagctgtgcagaaacacctgccaggagctgcacaagcacagcgtggagcagaccgagaccgccgagctgcccgccagcgacagcatcaaccccggcaacctgcagctggtgagcgagctgaagaaccccagcggcagctgcagcgtggacgtgagcgccatgttctgggagagagccggctgcaaggagccctgcatcatcaccgcctgcgaggacgtggtgagcctgtggaaggccctggacgcctggcagtgggagaagctgtacacctggcacttcgccgaggtgcccgtgctgcagatcgtgcccgtgcccgacgtgtacaacctggtgtgcgtggccctgggcaacctggagatcagagagatcagagccctgttctgcagcagcgacgacgagagcgagaagcaggtgctgctgaagagcggcaacatcaaggccgtgctgggcctgaccaagagaagactggtgagcagcagcggcaccctgagcgaccagcaggtggaggtgatgaccttcgccgaggacggcggcggcaaggagaaccagttcctgatgccccccgaggagaccatcctgaccttcgccgaggtgcagggcatgcaggaggccctgctgggcaccaccatcatgaacaacatcgtgatctggaacctgaagaccggccagctgctgaagaagatgcacatcgacgacagctaccaggccagcgtgtgccacaaggcctacagcgagatgggcctgctgttcatcgtgctgagccacccctgcgccaaggagagcgagagcctgagaagccccgtgttccagctgatcgtgatcaaccccaagaccaccctgagcgtgggcgtgatgctgtactgcctgccccccggccaggccggcagattcctggagggcgacgtgaaggaccactgcgccgccgccatcctgaccagcggcaccatcgccatctgggacctgctgctgggccagtgcaccgccctgctgccccccgtgagcgaccagcactggagcttcgtgaagtggagcggcaccgacagccacctgctggccggccagaaggacggcaacatcttcgtgtaccactacagctag

SEQ ID NO: 12034 - DNA, 4344 bp, Artificial Sequence
  Description of Artificial Sequence: Synthetic coding sequence
atggccagcgccggcaacgccgccgagccccaggacagaggcggcggcggcagcggctgcatcggcgcccccggcagacccgccggcggcggcagaagaagaagaaccggcggcctgagaagagccgccgcccccgacagagactacctgcacagacccagctactgcgacgccgccttcgccctggagcagatcagcaagggcaaggccaccggcagaaaggcccccctgtggctgagagccaagttccagagactgctgttcaagctgggctgctacatccagaagaactgcggcaagttcctggtggtgggcctgctgatcttcggcgccttcgccgtgggcctgaaggccgccaacctggagaccaacgtggaggagctgtgggtggaggtgggcggcagagtgagcagagagctgaactacaccagacagaagatcggcgaggaggccatgttcaacccccagctgatgatccagacccccaaggaggagggcgccaacgtgctgaccaccgaggccctgctgcagcacctggacagcgccctgcaggccagcagagtgcacgtgtacatgtacaacagacagtggaagctggagcacctgtgctacaagagcggcgagctgatcaccgagaccggctacatggaccagatcatcgagtacctgtacccctgcctgatcatcacccccctggactgcttctgggagggcgccaagctgcagagcggcaccgcctacctgctgggcaagccccccctgagatggaccaacttcgaccccctggagttcctggaggagctgaagaagatcaactaccaggtggacagctgggaggagatgctgaacaaggccgaggtgggccacggctacatggacagaccctgcctgaaccccgccgaccccgactgccccgccaccgcccccaacaagaacagcaccaagcccctggacatggccctggtgctgaacggcggctgccacggcctgagcagaaagtacatgcactggcaggaggagctgatcgtgggcggcaccgtgaagaacagcaccggcaagctggtgagcgcccacgccctgcagaccatgttccagctgatgacccccaagcagatgtacgagcacttcaagggctacgagtacgtgagccacatcaactggaacgaggacaaggccgccgccatcctggaggcctggcagagaacctacgtggaggtggtgcaccagagcgtggcccagaacagcacccagaaggtgctgagcttcaccaccaccaccctggacgacatcctgaagagcttcagcgacgtgagcgtgatcagagtggccagcggctacctgctgatgctggcctacgcctgcctgaccatgctgagatgggactgcagcaagagccagggcgccgtgggcctggccggcgtgctgctggtggccctgagcgtggccgccggcctgggcctgtgcagcctgatcggcatcagcttcaacgccgccaccacccaggtgctgcccttcctggccctgggcgtgggcgtggacgacgtgttcctgctggcccacgccttcagcgagaccggccagaacaagagaatccccttcgaggacagaaccggcgagtgcctgaagagaaccggcgccagcgtggccctgaccagcatcagcaacgtgaccgccttcttcatggccgccctgatccccatccccgccctgagagccttcagcctgcaggccgccgtggtggtggtgttcaacttcgccatggtgctgctgatcttccccgccatcctgagcatggacctgtacagaagagaggacagaagactggacatcttctgctgcttcaccagcccctgcgtgagcagagtgatccaggtggagccccaggcctacaccgacacccacgacaacaccagatacagccccccccccccctacagcagccacagcttcgcccacgagacccagatcaccatgcagagcaccgtgcagctgagaaccgagtacgacccccacacccacgtgtactacaccaccgccgagcccagaagcgagatcagcgtgcagcccgtgaccgtgacccaggacaccctgagctgccagagccccgagagcaccagcagcaccagagacctgctgagccagttcagcgacagcagcctgcactgcctggagcccccctgcaccaagtggaccctgagcagcttcgccgagaagcactacgcccccttcctgctgaagcccaaggccaaggtggtggtgatcttcctgttcctgggcctgctgggcgtgagcctgtacggcaccaccagagtgagagacggcctggacctgaccgacatcgtgcccagagagaccagagagtacgacttcatcgccgcccagttcaagtacttcagcttctacaacatgtacatcgtgacccagaaggccgactaccccaacatccagcacctgctgtacgacctgcacagaagcttcagcaacgtgaagtacgtgatgctggaggagaacaagcagctgcccaagatgtggctgcactacttcagagactggctgcagggcctgcaggacgccttcgacagcgactgggagaccggcaagatcatgcccaacaactacaagaacggcagcgacgacggcgtgctggcctacaagctgctggtgcagaccggcagcagagacaagcccatcgacatcagccagctgaccaagcagagactggtggacgccgacggcatcatcaaccccagcgccttctacatctacctgaccgcctgggtgagcaacgaccccgtggcctacgccgccagccaggccaacatcagaccccacagacccgagtgggtgcacgacaaggccgactacatgcccgagaccagactgagaatccccgccgccgagcccatcgagtacgcccagttccccttctacctgaacggcctgagagacaccagcgacttcgtggaggccatcgagaaggtgagaaccatctgcagcaactacaccagcctgggcctgagcagctaccccaacggctaccccttcctgttctgggagcagtacatcggcctgagacactggctgctgctgttcatcagcgtggtgctggcctgcaccttcctggtgtgcgccgtgttcctgctgaacccctggaccgccggcatcatcgtgatggtgctggccctgatgaccgtggagctgttcggcatgatgggcctgatcggcatcaagctgagcgccgtgcccgtggtgatcctgatcgccagcgtgggcatcggcgtggagttcaccgtgcacgtggccctggccttcctgaccgccatcggcgacaagaacagaagagccgtgctggccctggagcacatgttcgcccccgtgctggacggcgccgtgagcaccctgctgggcgtgctgatgctggccggcagcgagttcgacttcatcgtgagatacttcttcgccgtgctggccatcctgaccatcctgggcgtgctgaacggcctggtgctgctgcccgtgctgctgagcttcttcggcccctaccccgaggtgagccccgccaacggcctgaacagactgcccacccccagccccgagcccccccccagcgtggtgagattcgccatgccccccggccacacccacagcggcagcgacagcagcgacagcgagtacagcagccagaccaccgtgagcggcctgagcgaggagctgagacactacgaggcccagcagggcgccggcggccccgcccaccaggtgatcgtggaggccaccgagaaccccgtgttcgcccacagcaccgtggtgcaccccgagagcagacaccacccccccagcaaccccagacagcagccccacctggacagcggcagcctgccccccggcagacagggccagcagcccagaagagacccccccagagagggcctgtggccccccccctacagacccagaagagacgccttcgagatcagcaccgagggccacagcggccccagcaacagagccagatggggccccagaggcgccagaagccacaaccccagaaaccccgccagcaccgccatgggcagcagcgtgcccggctactgccagcccatcaccaccgtgaccgccagcgccagcgtgaccgtggccgtgcaccccccccccgtgcccggccccggcagaaaccccagaggcggcctgtgccccggctaccccgagaccgaccacggcctgttcgaggacccccacgtgcccttccacgtgagatgcgagagaagagacagcaaggtggaggtgatcgagctgcaggacgtggagtgcgaggagagacccagaggcagcagcagcaactag

SEQ ID NO: 12035 - DNA, 1059 bp, Artificial Sequence
  Description of Artificial Sequence: Synthetic coding sequence
aaggccgaggtgggccacggctacatggacagaccctgcctgaaccccgccgaccccgactgccccgccaccgcccccaacaagaacagcaccaagcccctggacatggccctggtgctgaacggcggctgccacggcctgagcagaaagtacatgcactggcaggaggagctgatcgtgggcggcaccgtgaagaacagcaccggcaagctggtgagcgcccacgccctgcagaccatgttccagctgatgacccccaagcagatgtacgagcacttcaagggctacgagtacgtgagccacatcaactggaacgaggacaaggccgccgccatcctggaggcctggcagagaacctacgtggaggtggtgcaccagagcgtggcccagaacagcacccagaaggtgctgagcttcaccaccaccaccctggacgacatcctgaagagcttcagcgacgtgagcgtgatcagagtggccagcggctacctgctgatggtgctgcccttcctggccctgggcgtgggcgtggacgacgtgttcctgctggcccacgccttcagcgagaccggccagaacaagagaatccccttcgaggacagaaccggcgagtgcctgaagagaaccggcgccagcgtggccctgaccagcatcagcaacgtgaccgccttcttcatggccgccctgatccccatccccgccctgagagccttcagcctgcaggccgccgtggtggtggtgttcaacttcgccatggtgctgctgatcttccccgccatcctgagcatggacctgtacagaagagaggacagaagactggacatcttctgctgcttcaccagcccctgcgtgagcagagtgatccaggtggagccccaggcctacaccgacacccacgacaacaccagatacagccccccccccccctacagcagccacagcttcgcccacgagacccagatcaccatgcagagcaccgtgcagctgagaaccgagtacgacccccacacccacgtgtactacaccaccgccgagcccagaagcgagatcagcgtgtag

SEQ ID NO: 12036 - DNA, 4341 bp, Artificial Sequence
  Description of Artificial Sequence: Synthetic coding sequence
atggagctgctgaacagaaacagactggtgatcgtgagccccagatgcaccccccccaaggccagcggcggccccgccagaagaggcttctacaccttcagaagcttctgcaaggacggcggcggcggcgaggaggaggaggagaacggcggcgaggagaaggacgacagaggcgacaaggagaccagaagcgacaagggcaaggccaccggcagaaaggcccccctgtggctgagagccaagttccagagactgctgttcaagctgggctgctacatccagaagaactgcggcaagttcctggtggtgggcctgctgatcttcggcgccttcgccgtgggcctgaaggccgccaacctggagaccaacgtggaggagctgtgggtggaggtgggcggcagagtgagcagagagctgaactacaccagacagaagatcggcgaggaggccatgttcaacccccagctgatgatccagacccccaaggaggagggcgccaacgtgctgaccaccgaggccctgctgcagcacctggacagcgccctgcaggccagcagagtgcacgtgtacatgtacaacagacagtggaagctggagcacctgtgctacaagagcggcgagctgatcaccgagaccggctacatggaccagatcatcgagtacctgtacccctgcctgatcatcacccccctggactgcttctgggagggcgccaagctgcagagcggcaccgcctacctgctgggcaagccccccctgagatggaccaacttcgaccccctggagttcctggaggagctgaagaagatcaactaccaggtggacagctgggaggagatgctgaacaaggccgaggtgggccacggctacatggacagaccctgcctgaaccccgccgaccccgactgccccgccaccgcccccaacaagaacagcaccaagcccctggacatggccctggtgctgaacggcggctgccacggcctgagcagaaagtacatgcactggcaggaggagctgatcgtgggcggcaccgtgaagaacagcaccggcaagctggtgagcgcccacgccctgcagaccatgttccagctgatgacccccaagcagatgtacgagcacttcaagggctacgagtacgtgagccacatcaactggaacgaggacaaggccgccgccatcctggaggcctggcagagaacctacgtggaggtggtgcaccagagcgtggcccagaacagcacccagaaggtgctgagcttcaccaccaccaccctggacgacatcctgaagagcttcagcgacgtgagcgtgatcagagtggccagcggctacctgctgatgctggcctacgcctgcctgaccatgctgagatgggactgcagcaagagccagggcgccgtgggcctggccggcgtgctgctggtggccctgagcgtggccgccggcctgggcctgtgcagcctgatcggcatcagcttcaacgccgccaccacccaggtgctgcccttcctggccctgggcgtgggcgtggacgacgtgttcctgctggcccacgccttcagcgagaccggccagaacaagagaatccccttcgaggacagaaccggcgagtgcctgaagagaaccggcgccagcgtggccctgaccagcatcagcaacgtgaccgccttcttcatggccgccctgatccccatccccgccctgagagccttcagcctgcaggccgccgtggtggtggtgttcaacttcgccatggtgctgctgatcttccccgccatcctgagcatggacctgtacagaagagaggacagaagactggacatcttctgctgcttcaccagcccctgcgtgagcagagtgatccaggtggagccccaggcctacaccgacacccacgacaacaccagatacagccccccccccccctacagcagccacagcttcgcccacgagacccagatcaccatgcagagcaccgtgcagctgagaaccgagtacgacccccacacccacgtgtactacaccaccgccgagcccagaagcgagatcagcgtgcagcccgtgaccgtgacccaggacaccctgagctgccagagccccgagagcaccagcagcaccagagacctgctgagccagttcagcgacagcagcctgcactgcctggagcccccctgcaccaagtggaccctgagcagcttcgccgagaagcactacgcccccttcctgctgaagcccaaggccaaggtggtggtgatcttcctgttcctgggcctgctgggcgtgagcctgtacggcaccaccagagtgagagacggcctggacctgaccgacatcgtgcccagagagaccagagagtacgacttcatcgccgcccagttcaagtacttcagcttctacaacatgtacatcgtgacccagaaggccgactaccccaacatccagcacctgctgtacgacctgcacagaagcttcagcaacgtgaagtacgtgatgctggaggagaacaagcagctgcccaagatgtggctgcactacttcagagactggctgcagggcctgcaggacgccttcgacagcgactgggagaccggcaagatcatgcccaacaactacaagaacggcagcgacgacggcgtgctggcctacaagctgctggtgcagaccggcagcagagacaagcccatcgacatcagccagctgaccaagcagagactggtggacgccgacggcatcatcaaccccagcgccttctacatctacctgaccgcctgggtgagcaacgaccccgtggcctacgccgccagccaggccaacatcagaccccacagacccgagtgggtgcacgacaaggccgactacatgcccgagaccagactgagaatccccgccgccgagcccatcgagtacgcccagttccccttctacctgaacggcctgagagacaccagcgacttcgtggaggccatcgagaaggtgagaaccatctgcagcaactacaccagcctgggcctgagcagctaccccaacggctaccccttcctgttctgggagcagtacatcggcctgagacactggctgctgctgttcatcagcgtggtgctggcctgcaccttcctggtgtgcgccgtgttcctgctgaacccctggaccgccggcatcatcgtgatggtgctggccctgatgaccgtggagctgttcggcatgatgggcctgatcggcatcaagctgagcgccgtgcccgtggtgatcctgatcgccagcgtgggcatcggcgtggagttcaccgtgcacgtggccctggccttcctgaccgccatcggcgacaagaacagaagagccgtgctggccctggagcacatgttcgcccccgtgctggacggcgccgtgagcaccctgctgggcgtgctgatgctggccggcagcgagttcgacttcatcgtgagatacttcttcgccgtgctggccatcctgaccatcctgggcgtgctgaacggcctggtgctgctgcccgtgctgctgagcttcttcggcccctaccccgaggtgagccccgccaacggcctgaacagactgcccacccccagccccgagcccccccccagcgtggtgagattcgccatgccccccggccacacccacagcggcagcgacagcagcgacagcgagtacagcagccagaccaccgtgagcggcctgagcgaggagctgagacactacgaggcccagcagggcgccggcggccccgcccaccaggtgatcgtggaggccaccgagaaccccgtgttcgcccacagcaccgtggtgcaccccgagagcagacaccacccccccagcaaccccagacagcagccccacctggacagcggcagcctgccccccggcagacagggccagcagcccagaagagacccccccagagagggcctgtggccccccccctacagacccagaagagacgccttcgagatcagcaccgagggccacagcggccccagcaacagagccagatggggccccagaggcgccagaagccacaaccccagaaaccccgccagcaccgccatgggcagcagcgtgcccggctactgccagcccatcaccaccgtgaccgccagcgccagcgtgaccgtggccgtgcaccccccccccgtgcccggccccggcagaaaccccagaggcggcctgtgccccggctaccccgagaccgaccacggcctgttcgaggacccccacgtgcccttccacgtgagatgcgagagaagagacagcaaggtggaggtgatcgagctgcaggacgtggagtgcgaggagagacccagaggcagcagcagcaactag

SEQ ID NO: 12037 - DNA, 1758 bp, Artificial Sequence
  Description of Artificial Sequence: Synthetic coding sequence
ccctgcagaaagagcagcgccctgaacagccccaaggccgccgtggtggtggtgttcaacttcgccatggtgctgctgatcttccccgccatcctgagcatggacctgtacagaagagaggacagaagactggacatcttctgctgcttcaccagcccctgcgtgagcagagtgatccaggtggagccccaggcctacaccgacacccacgacaacaccagatacagccccccccccccctacagcagccacagcttcgcccacgagacccagatcaccatgcagagcaccgtgcagctgagaaccgagtacgacccccacacccacgtgtactacaccaccgccgagcccagaagcgagatcagcgtgcagcccgtgaccgtgacccaggacaccctgagctgccagagccccgagagcaccagcagcaccagagacctgctgagccagttcagcgacagcagcctgcactgcctggagcccccctgcaccaagtggaccctgagcagcttcgccgagaagcactacgcccccttcctgctgaagcccaaggccaaggtggtggtgatcttcctgttcctgggcctgctgggcgtgagcctgtacggcaccaccagagtgagagacggcctggacctgaccgacatcgtgcccagagagaccagagagtacgacttcatcgccgcccagttcaagtacttcagcttctacaacatgtacatcgtgacccagaaggccgactaccccaacatccagcacctgctgtacgacctgcacagaagcttcagcaacgtgaagtacgtgatgctggaggagaacaagcagctgcccaagatgtggctgcactacttcagagactggctgcagggcctgcaggacgccttcgacagcgactgggagaccggcaagatcatgcccaacaactacaagaacggcagcgacgacggcgtgctggcctacaagctgctggtgcagaccggcagcagagacaagcccatcgacatcagccagctgaccaagcagagactggtggacgccgacggcatcatcaaccccagcgccttctacatctacctgaccgcctgggtgagcaacgaccccgtggcctacgccgccagccaggccaacatcagaccccacagacccgagtgggtgcacgacaaggccgactacatgcccgagaccagactgagaatccccgccgccgagcccatcgagtacgcccagttccccttctacctgaacggcctgagagacaccagcgacttcgtggaggccatcgagaaggtgagaaccatctgcagcaactacaccagcctgggcctgagcagctaccccaacggctaccccttcctgttctgggagcagtacatcggcctgagacactggctgctgctgttcatcagcgtggtgctggcctgcaccttcctggtgtgcgccgtgttcctgctgaacccctggaccgccggcatcatcgtgatggtgctggccctgatgaccgtggagctgttcggcatgatgggcctgatcggcatcaagctgagcgccgtgcccgtggtgatcctgatcgccagcgtgggcatcggcgtggagttcaccgtgcacgtggccctggccttcctgaccgccatcggcgacaagaacagaagagccgtgctggccctggagcacatgttcgcccccgtgctggacggcgccgtgagcaccctgctgggcgtgctgatgctggccggcagcgagttcgacttcatcgtgtag

SEQ ID NO: 12038 - DNA, 729 bp, Artificial Sequence
  Description of Artificial Sequence: Synthetic coding sequence
atgccccccggccacacccacagcggcagcgacagcagcgacagcgagtacagcagccagaccaccgtgagcggcctgagcgaggagctgagacactacgaggcccagcagggcgccggcggccccgcccaccaggtgatcgtggaggccaccgagaaccccgtgttcgcccacagcaccgtggtgcaccccgagagcagacaccacccccccagcaaccccagacagcagccccacctggacagcggcagcctgccccccggcagacagggccagcagcccagaagagacccccccagagagggcctgtggccccccccctacagacccagaagagacgccttcgagatcagcaccgagggccacagcggccccagcaacagagccagatggggccccagaggcgccagaagccacaaccccagaaaccccgccagcaccgccatgggcagcagcgtgcccggctactgccagcccatcaccaccgtgaccgccagcgccagcgtgaccgtggccgtgcaccccccccccgtgcccggccccggcagaaaccccagaggcggcctgtgccccggctaccccgagaccgaccacggcctgttcgaggaccccacctgcctgagcaccagcggcgtgagaggcggcatcagaagatggaagagcctgagctgcagaacctggaacgccagaagaggccccggcgaggccgcccccaccgagggcgactag

SEQ ID NO: 12039 - DNA, 1461 bp, Artificial Sequence
  Description of Artificial Sequence: Synthetic coding sequence
ggcaaggccaccggcagaaaggcccccctgtggctgagagccaagttccagagactgctgttcaagctgggctgctacatccagaagaactgcggcaagttcctggtggtgggcctgctgatcttcggcgccttcgccgtgggcctgaaggccgccaacctggagaccaacgtggaggagctgtgggtggaggtgggcggcagagtgagcagagagctgaactacaccagacagaagatcggcgaggaggccatgttcaacccccagctgatgatccagacccccaaggaggagggcgccaacgtgctgaccaccgaggccctgctgcagcacctggacagcgccctgcaggccagcagagtgcacgtgtacatgtacaacagaggcaagccccccctgagatggaccaacttcgaccccctggagttcctggaggagctgaagaagatcaactaccaggtggacagctgggaggagatgctgaacaaggccgaggtgggccacggctacatggacagaccctgcctgaaccccgccgaccccgactgccccgccaccgcccccaacaagaacagcaccaagcccctggacatggccctggtgctgaacggcggctgccacggcctgagcagaaagtacatgcactggcaggaggagctgatcgtgggcggcaccgtgaagaacagcaccggcaagctggtgagcgcccacgccctgcagaccatgttccagctgatgacccccaagcagatgtacgagcacttcaagggctacgagtacgtgagccacatcaactggaacgaggacaaggccgccgccatcctggaggcctggcagagaacctacgtggaggtggtgcaccagagcgtggcccagaacagcacccagaaggtgctgagcttcaccaccaccaccctggacgacatcctgaagagcttcagcgacgtgagcgtgatcagagtggccagcggctacctgctgatgctggcctacgcctgcctgaccatgctgagatgggactgcagcaagagccagggcgccgtgggcctggccggcgtgctgctggtggccctgagcgtggccgccggcctgggcctgtgcagcctgatcggcatcagcttcaacgccgccaccacccaggtgctgcccttcctggccctgggcgtgggcgtggacgacgtgttcctgctggcccacgccttcagcgagaccggccagaacaagagaatccccttcgaggacagaaccggcgagtgcctgaagagaaccggcgccagcgtggccctgaccagcatcagcaacgtgaccgccttcttcatggccgccctgatccccatccccgccctgagagccttcagcctgcagtacatcctgatggcccacagaggcagactgagcttcaacgacaccctgtggtgcggcggcctgaagagctacatgagattcccctacgaggagtag

SEQ ID NO: 12040 - DNA, 3891 bp, Artificial Sequence
  Description of Artificial Sequence: Synthetic coding sequence
atgttcaacccccagctgatgatccagacccccaaggaggagggcgccaacgtgctgaccaccgaggccctgctgcagcacctggacagcgccctgcaggccagcagagtgcacgtgtacatgtacaacagacagtggaagctggagcacctgtgctacaagagcggcgagctgatcaccgagaccggctacatggaccagatcatcgagtacctgtacccctgcctgatcatcacccccctggactgcttctgggagggcgccaagctgcagagcggcaccgcctacctgctgggcaagccccccctgagatggaccaacttcgaccccctggagttcctggaggagctgaagaagatcaactaccaggtggacagctgggaggagatgctgaacaaggccgaggtgggccacggctacatggacagaccctgcctgaaccccgccgaccccgactgccccgccaccgcccccaacaagaacagcaccaagcccctggacatggccctggtgctgaacggcggctgccacggcctgagcagaaagtacatgcactggcaggaggagctgatcgtgggcggcaccgtgaagaacagcaccggcaagctggtgagcgcccacgccctgcagaccatgttccagctgatgacccccaagcagatgtacgagcacttcaagggctacgagtacgtgagccacatcaactggaacgaggacaaggccgccgccatcctggaggcctggcagagaacctacgtggaggtggtgcaccagagcgtggcccagaacagcacccagaaggtgctgagcttcaccaccaccaccctggacgacatcctgaagagcttcagcgacgtgagcgtgatcagagtggccagcggctacctgctgatgctggcctacgcctgcctgaccatgctgagatgggactgcagcaagagccagggcgccgtgggcctggccggcgtgctgctggtggccctgagcgtggccgccggcctgggcctgtgcagcctgatcggcatcagcttcaacgccgccaccacccaggtgctgcccttcctggccctgggcgtgggcgtggacgacgtgttcctgctggcccacgccttcagcgagaccggccagaacaagagaatccccttcgaggacagaaccggcgagtgcctgaagagaaccggcgccagcgtggccctgaccagcatcagcaacgtgaccgccttcttcatggccgccctgatccccatccccgccctgagagccttcagcctgcaggccgccgtggtggtggtgttcaacttcgccatggtgctgctgatcttccccgccatcctgagcatggacctgtacagaagagaggacagaagactggacatcttctgctgcttcaccagcccctgcgtgagcagagtgatccaggtggagccccaggcctacaccgacacccacgacaacaccagatacagccccccccccccctacagcagccacagcttcgcccacgagacccagatcaccatgcagagcaccgtgcagctgagaaccgagtacgacccccacacccacgtgtactacaccaccgccgagcccagaagcgagatcagcgtgcagcccgtgaccgtgacccaggacaccctgagctgccagagccccgagagcaccagcagcaccagagacctgctgagccagttcagcgacagcagcctgcactgcctggagcccccctgcaccaagtggaccctgagcagcttcgccgagaagcactacgcccccttcctgctgaagcccaaggccaaggtggtggtgatcttcctgttcctgggcctgctgggcgtgagcctgtacggcaccaccagagtgagagacggcctggacctgaccgacatcgtgcccagagagaccagagagtacgacttcatcgccgcccagttcaagtacttcagcttctacaacatgtacatcgtgacccagaaggccgactaccccaacatccagcacctgctgtacgacctgcacagaagcttcagcaacgtgaagtacgtgatgctggaggagaacaagcagctgcccaagatgtggctgcactacttcagagactggctgcagggcctgcaggacgccttcgacagcgactgggagaccggcaagatcatgcccaacaactacaagaacggcagcgacgacggcgtgctggcctacaagctgctggtgcagaccggcagcagagacaagcccatcgacatcagccagctgaccaagcagagactggtggacgccgacggcatcatcaaccccagcgccttctacatctacctgaccgcctgggtgagcaacgaccccgtggcctacgccgccagccaggccaacatcagaccccacagacccgagtgggtgcacgacaaggccgactacatgcccgagaccagactgagaatccccgccgccgagcccatcgagtacgcccagttccccttctacctgaacggcctgagagacaccagcgacttcgtggaggccatcgagaaggtgagaaccatctgcagcaactacaccagcctgggcctgagcagctaccccaacggctaccccttcctgttctgggagcagtacatcggcctgagacactggctgctgctgttcatcagcgtggtgctggcctgcaccttcctggtgtgcgccgtgttcctgctgaacccctggaccgccggcatcatcgtgatggtgctggccctgatgaccgtggagctgttcggcatgatgggcctgatcggcatcaagctgagcgccgtgcccgtggtgatcctgatcgccagcgtgggcatcggcgtggagttcaccgtgcacgtggccctggccttcctgaccgccatcggcgacaagaacagaagagccgtgctggccctggagcacatgttcgcccccgtgctggacggcgccgtgagcaccctgctgggcgtgctgatgctggccggcagcgagttcgacttcatcgtgagatacttcttcgccgtgctggccatcctgaccatcctgggcgtgctgaacggcctggtgctgctgcccgtgctgctgagcttcttcggcccctaccccgaggtgagccccgccaacggcctgaacagactgcccacccccagccccgagcccccccccagcgtggtgagattcgccatgccccccggccacacccacagcggcagcgacagcagcgacagcgagtacagcagccagaccaccgtgagcggcctgagcgaggagctgagacactacgaggcccagcagggcgccggcggccccgcccaccaggtgatcgtggaggccaccgagaaccccgtgttcgcccacagcaccgtggtgcaccccgagagcagacaccacccccccagcaaccccagacagcagccccacctggacagcggcagcctgccccccggcagacagggccagcagcccagaagagacccccccagagagggcctgtggccccccccctacagacccagaagagacgccttcgagatcagcaccgagggccacagcggccccagcaacagagccagatggggccccagaggcgccagaagccacaaccccagaaaccccgccagcaccgccatgggcagcagcgtgcccggctactgccagcccatcaccaccgtgaccgccagcgccagcgtgaccgtggccgtgcaccccccccccgtgcccggccccggcagaaaccccagaggcggcctgtgccccggctaccccgagaccgaccacggcctgttcgaggacccccacgtgcccttccacgtgagatgcgagagaagagacagcaaggtggaggtgatcgagctgcaggacgtggagtgcgaggagagacccagaggcagcagcagcaactag

SEQ ID NO: 12041 - DNA, 3891 bp, Artificial Sequence; identical to SEQ ID NO: 12040
  Description of Artificial Sequence: Synthetic coding sequence

SEQ ID NO: 12042 - DNA, 3891 bp, Artificial Sequence; identical to SEQ ID NO: 12040
  Description of Artificial Sequence: Synthetic coding sequence

SEQ ID NO: 12043 - DNA, 4146 bp, Artificial Sequence
  Description of Artificial Sequence: Synthetic coding sequence
atgggcaaggccaccggcagaaaggcccccctgtggctgagagccaagttccagagactgctgttcaagctgggctgctacatccagaagaactgcggcaagttcctggtggtgggcctgctgatcttcggcgccttcgccgtgggcctgaaggccgccaacctggagaccaacgtggaggagctgtgggtggaggtgggcggcagagtgagcagagagctgaactacaccagacagaagatcggcgaggaggccatgttcaacccccagctgatgatccagacccccaaggaggagggcgccaacgtgctgaccaccgaggccctgctgcagcacctggacagcgccctgcaggccagcagagtgcacgtgtacatgtacaacagacagtggaagctggagcacctgtgctacaagagcggcgagctgatcaccgagaccggctacatggaccagatcatcgagtacctgtacccctgcctgatcatcacccccctggactgcttctgggagggcgccaagctgcagagcggcaccgcctacctgctgggcaagccccccctgagatggaccaacttcgaccccctggagttcctggaggagctgaagaagatcaactaccaggtggacagctgggaggagatgctgaacaaggccgaggtgggccacggctacatggacagaccctgcctgaaccccgccgaccccgactgccccgccaccgcccccaacaagaacagcaccaagcccctggacatggccctggtgctgaacggcggctgccacggcctgagcagaaagtacatgcactggcaggaggagctgatcgtgggcggcaccgtgaagaacagcaccggcaagctggtgagcgcccacgccctgcagaccatgttccagctgatgacccccaagcagatgtacgagcacttcaagggctacgagtacgtgagccacatcaactggaacgaggacaaggccgccgccatcctggaggcctggcagagaacctacgtggaggtggtgcaccagagcgtggcccagaacagcacccagaaggtgctgagcttcaccaccaccaccctggacgacatcctgaagagcttcagcgacgtgagcgtgatcagagtggccagcggctacctgctgatgctggcctacgcctgcctgaccatgctgagatgggactgcagcaagagccagggcgccgtgggcctggccggcgtgctgctggtggccctgagcgtggccgccggcctgggcctgtgcagcctgatcggcatcagcttcaacgccgccaccacccaggtgctgcccttcctggccctgggcgtgggcgtggacgacgtgttcctgctggcccacgccttcagcgagaccggccagaacaagagaatccccttcgaggacagaaccggcgagtgcctgaagagaaccggcgccagcgtggccctgaccagcatcagcaacgtgaccgccttcttcatggccgccctgatccccatccccgccctgagagccttcagcctgcaggccgccgtggtggtggtgttcaacttcgccatggtgctgctgatcttccccgccatcctgagcatggacctgtacagaagagaggacagaagactggacatcttctgctgcttcaccagcccctgcgtgagcagagtgatccaggtggagccccaggcctacaccgacacccacgacaacaccagatacagccccccccccccctacagcagccacagcttcgcccacgagacccagatcaccatgcagagcaccgtgcagctgagaaccgagtacgacccccacacccacgtgtactacaccaccgccgagcccagaagcgagatcagcgtgcagcccgtgaccgtgacccaggacaccctgagctgccagagccccgagagcaccagcagcaccagagacctgctgagccagttcagcgacagcagcctgcactgcctggagcccccctgcaccaagtggaccctgagcagcttcgccgagaagcactacgcccccttcctgctgaagcccaaggccaaggtggtggtgatcttcctgttcctgggcctgctgggcgtgagcctgtacggcaccaccagagtgagagacggcctggacctgaccgacatcgtgcccagagagaccagagagtacgacttcatcgccgcccagttcaagtacttcagcttctacaacatgtacatcgtgacccagaaggccgactaccccaacatccagcacctgctgtacgacctgcacagaagcttcagcaacgtgaagtacgtgatgctggaggagaacaagcagctgcccaagatgtggctgcactacttcagagactggctgcagggcctgcaggacgccttcgacagcgactgggagaccggcaagatcatgcccaacaactacaagaacggcagcgacgacggcgtgctggcctacaagctgctggtgcagaccggcagcagagacaagcccatcgacatcagccagctgaccaagcagagactggtggacgccgacggcatcatcaaccccagcgccttctacatctacctgaccgcctgggtgagcaacgaccccgtggcctacgccgccagccaggccaacatcagaccccacagacccgagtgggtgcacgacaaggccgactacatgcccgagaccagactgagaatccccgccgccgagcccatcgagtacgcccagttccccttctacctgaacggcctgagagacaccagcgacttcgtggaggccatcgagaaggtgagaaccatctgcagcaactacaccagcctgggcctgagcagctaccccaacggctaccccttcctgttctgggagcagtacatcggcctgagacactggctgctgctgttcatcagcgtggtgctggcctgcaccttcctggtgtgcgccgtgttcctgctgaacccctggaccgccggcatcatcgtgatggtgctggccctgatgaccgtggagctgttcggcatgatgggcctgatcggcatcaagctgagcgccgtgcccgtggtgatcctgatcgccagcgtgggcatcggcgtggagttcaccgtgcacgtggccctggccttcctgaccgccatcggcgacaagaacagaagagccgtgctggccctggagcacatgttcgcccccgtgctggacggcgccgtgagcaccctgctgggcgtgctgatgctggccggcagcgagttcgacttcatcgtgagatacttcttcgccgtgctggccatcctgaccatcctgggcgtgctgaacggcctggtgctgctgcccgtgctgctgagcttcttcggcccctaccccgaggtgagccccgccaacggcctgaacagactgcccacccccagccccgagcccccccccagcgtggtgagattcgccatgccccccggccacacccacagcggcagcgacagcagcgacagcgagtacagcagccagaccaccgtgagcggcctgagcgaggagctgagacactacgaggcccagcagggcgccggcggccccgcccaccaggtgatcgtggaggccaccgagaaccccgtgttcgcccacagcaccgtggtgcaccccgagagcagacaccacccccccagcaaccccagacagcagccccacctggacagcggcagcctgccccccggcagacagggccagcagcccagaagagacccccccagagagggcctgtggccccccccctacagacccagaagagacgccttcgagatcagcaccgagggccacagcggccccagcaacagagccagatggggccccagaggcgccagaagccacaaccccagaaaccccgccagcaccgccatgggcagcagcgtgcccggctactgccagcccatcaccaccgtgaccgccagcgccagcgtgaccgtggccgtgcaccccccccccgtgcccggccccggcagaaaccccagaggcggcctgtgccccggctaccccgagaccgaccacggcctgttcgaggacccccacgtgcccttccacgtgagatgcgagagaagagacagcaaggtggaggtgatcgagctgcaggacgtggagtgcgaggagagacccagaggcagcagcagcaactag

SEQ ID NO: 12044 - DNA, 4146 bp, Artificial Sequence; identical to SEQ ID NO: 12043
  Description of Artificial Sequence: Synthetic coding sequence

SEQ ID NO: 12045 - DNA, 255 bp, Artificial Sequence
  Description of Artificial Sequence: Synthetic coding sequence
atgggcaaggccaccggcagaaaggcccccctgtggctgagagccaagttccagagactgctgttcaagctgggctgctacatccagaagaactgcggcaagttcctggtggtgggcctgctgatcttcggcgccttcgccgtgggcctgaaggccgccaacctggagaccaacgtggaggagctgtgggtggaggaggtgaacctgctgtgcggcggccagaccagcaccctgtggaacagctggaagagctag

SEQ ID NO: 12046 - DNA, 525 bp, Artificial Sequence
  Description of Artificial Sequence: Synthetic coding sequence
atgttcaacccccagctgatgatccagacccccaaggaggagggcgccaacgtgctgaccaccgaggccctgctgcagcacctggacagcgccctgcaggccagcagagtgcacgtgtacatgtacaacagacagtggaagctggagcacctgtgctacaagagcggcgagctgatcaccgagaccggctacatggaccagatcatcgagtacctgtacccctgcctgatcatcacccccctggactgcttctgggagggcgccaagctgcagagcggcaccgcctacctgctgggcaagccccccctgagatggaccaacttcgaccccctggagttcctggaggagctgaagaagatcaactaccaggtggacagctgggaggagatgctgaacaaggccgaggtgggccacggctacatggacagaccctgcctgaaccccgccgaccccgactgccccgccaccgcccccaacaagaacagcaccaagcccctggacatggccctggtgctgaacggctag

SEQ ID NO: 12047 - DNA, 525 bp, Artificial Sequence; identical to SEQ ID NO: 12046
  Description of Artificial Sequence: Synthetic coding sequence

SEQ ID NO: 12048 - DNA, 279 bp, Artificial Sequence
  Description of Artificial Sequence: Synthetic coding sequence
atgttcaacccccagctgatgatccagacccccaaggaggagggcgccaacgtgctgaccaccgaggccctgctgcagcacctggacagcgccctgcaggccagcagagtgcacgtgtacatgtacaacagacagtggaagctggagcacctgtgctacaagagcggcgagctgatcaccgagaccggctacatggaccagatcatcgagtacctgtacccctgcctgatcatcacccccctggactgcttctgggagggcgccaagctgcagagctag

SEQ ID NO: 12049 - DNA, 525 bp, Artificial Sequence; identical to SEQ ID NO: 12046
  Description of Artificial Sequence: Synthetic coding sequence

SEQ ID NO: 12050 - DNA, 525 bp, Artificial Sequence; identical to SEQ ID NO: 12046
  Description of Artificial Sequence: Synthetic coding sequence

SEQ ID NO: 12051 - DNA, 954 bp, Artificial Sequence
  Description of Artificial Sequence: Synthetic coding sequence
atgcccagagaggacagagccacctggaagagcaactacttcctgaagatcatccagctgctggacgactaccccaagtgcttcatcgtgggcgccgacaacgtgggcagcaagcagatgcagcagatcagaatgagcctgagaggcaaggccgtggtgctgatgggcaagaacaccatgatgagaaaggccatcagaggccacctggagaacaaccccgccctggagaagctgctgccccacatcagaggcaacgtgggcttcgtgttcaccaaggaggacctgaccgagatcagagacatgctgctggccaacaaggtgcccgccgccgccagagccggcgccatcgccccctgcgaggtgaccgtgcccgcccagaacaccggcctgggccccgagaagaccagcttcttccaggccctgggcatcaccaccaagatcagcagaggcaccatcgagatcctgagcgacgtgcagctgatcaagaccggcgacaaggtgggcgccagcgaggccaccctgctgaacatgctgaacatcagccccttcagcttcggcctggtgatccagcaggtgttcgacaacggcagcatctacaaccccgaggtgctggacatcaccgaggagaccctgcacagcagattcctggagggcgtgagaaacgtggccagcgtgtgcctgcagatcggctaccccaccgtggccagcgtgccccacagcatcatcaacggctacaagagagtgctggccctgagcgtggagaccgactacaccttccccctggccgagaaggtgaaggccttcctggccgaccccagcgccttcgtggccgccgcccccgtggccgccgccaccaccgccgcccccgccgccgccgccgcccccgccaaggtggaggccaaggaggagagcgaggagagcgacgaggacatgggcttcggcctgttcgactag

SEQ ID NO: 12052 - DNA, 1818 bp, Artificial Sequence
  Description of Artificial Sequence: Synthetic coding sequence
atggacgacctggacgccctgctggccgacctggagagcaccaccagccacatcagcaagagacccgtgttcctgagcgaggagaccccctacagctaccccaccggcaaccacacctaccaggagatcgccgtgcccccccccgtgccccccccccccagcagcgaggccctgaacggcaccatcctggaccccctggaccagtggcagcccagcagcagcagattcatccaccagcagccccagagcagcagccccgtgtacggcagcagcgccaagaccagcagcgtgagcaacccccaggacagcgtgggcagcccctgcagcagagtgggcgaggaggagcacgtgtacagcttccccaacaagcagaagagcgccgagcccagccccaccgtgatgagcaccagcctgggcagcaacctgagcgagctggacagactgctgctggagctgaacgccgtgcagcacaacccccccggcttccccgccgacgaggccaacagcagcccccccctgcccggcgccctgagccccctgtacggcgtgcccgagaccaacagccccctgggcggcaaggccggccccctgaccaaggagaagcccaagagaaacggcggcagaggcctggaggacgtgagacccagcgtggagagcctgctggacgagctggagagcagcgtgcccagccccgtgcccgccatcaccgtgaaccagggcgagatgagcagcccccagagagtgaccagcacccagcagcagaccagaatcagcgccagcagcgccaccagagagctggacgagctgatggccagcctgagcgacttcaagggcagctggcccctggaggaggtggtgctgctggtgagcatcagcagcagcgtgcaggagggcgagaagtacccccacccctgcgccgccagacacagaacccccagcctgagaagccccgaccagccccccccctgcccccagttcatggcccagggcaagaccggcagcagcagcccccccggcggcccccccaagcccggcagccagctggacagcatgctgggcagcctgcagagcgacctgaacaagctgggcgtggccaccgtggccaagggcgtgtgcggcgcctgcaagaagcccatcgccggccaggtggtgaccgccatgggcaagacctggcaccccgagcacttcgtgtgcacccactgccaggaggagatcggcagcagaaacttcttcgagagagacggccagccctactgcgagaaggactaccacaacctgttcagccccagatgctactactgcaacggccccatcctggacaaggtggtgaccgccctggacagaacctggcaccccgagcacttcttctgcgcccagtgcggcgccttcttcggccccgagggcttccacgagaaggacggcaaggcctactgcagaaaggactacttcgacatgttcgcccccaagtgcggcggctgcgccagagccatcctggagaactacatcagcgccctgaacaccctgtggcaccccgagtgcttcgtgtgcagagagtgcttcacccccttcgtgaacggcagcttcttcgagcacgacggccagccctactgcgaggtgcactaccacgagagaagaggcagcctgtgcagcggctgccagaagcccatcaccggcagatgcatcaccgccatggccaagaagttccaccccgagcacttcgtgtgcgccttctgcctgaagcagctgaacaagggcaccttcaaggagcagaacgacaagccctactgccagaactgcttcctgaagctgttctgctag

SEQ ID NO: 12053 - DNA, 702 bp, Artificial Sequence
  Description of Artificial Sequence: Synthetic coding sequence
atgggcaagacctggcaccccgagcacttcgtgtgcacccactgccaggaggagatcggcagcagaaacttcttcgagagagacggccagccctactgcgagaaggactaccacaacctgttcagccccagatgctactactgcaacggccccatcctggacaaggtggtgaccgccctggacagaacctggcaccccgagcacttcttctgcgcccagtgcggcgccttcttcggccccgagggcttccacgagaaggacggcaaggcctactgcagaaaggactacttcgacatgttcgcccccaagtgcggcggctgcgccagagccatcctggagaactacatcagcgccctgaacaccctgtggcaccccgagtgcttcgtgtgcagagagtgcttcacccccttcgtgaacggcagcttcttcgagcacgacggccagccctactgcgaggtgcactaccacgagagaagaggcagcctgtgcagcggctgccagaagcccatcaccggcagatgcatcaccgccatggccaagaagttccaccccgacccctgcaccagccccagaaccggcctggccagcaccccccactggagccacctgttcctgatcttccagcagtgcagcagaggcgccggcaagggcagacagggcctgctgggcagcctgttcatcctgatccccccccccacctag

SEQ ID NO: 12054 - DNA, 1212 bp, Artificial Sequence
  Description of Artificial Sequence: Synthetic coding sequence
atgagcgcccccagcagcaccggcccccagtactgccccggcctgcccagcagaaaggaggccacccccgagggcagacccgagacctgcctgctgcccagcagcccccaggcccagagacccatccagggcctggagcagagagccgacggcgagagatgctgggccgccggctggcccagagacggcggcagaagcagccccggcggccaggacgagggcggcggcagctggcccctggaggaggtggtgctgctggtgagcatcagcagcagcgtgcaggagggcgagaagtacccccacccctgcgccgccagacacagaacccccagcctgagaagccccgaccagccccccccctgcccccagttcatggcccagggcaagaccggcagcagcagcccccccggcggcccccccaagcccggcagccagctggacagcatgctgggcagcctgcagagcgacctgaacaagctgggcgtggccaccgtggccaagggcgtgtgcggcgcctgcaagaagcccatcgccggccaggtggtgaccgccatgggcaagacctggcaccccgagcacttcgtgtgcacccactgccaggaggagatcggcagcagaaacttcttcgagagagacggccagccctactgcgagaaggactaccacaacctgttcagccccagatgctactactgcaacggccccatcctggacaaggtggtgaccgccctggacagaacctggcaccccgagcacttcttctgcgcccagtgcggcgccttcttcggccccgagggcttccacgagaaggacggcaaggcctactgcagaaaggactacttcgacatgttcgcccccaagtgcggcggctgcgccagagccatcctggagaactacatcagcgccctgaacaccctgtggcaccccgagtgcttcgtgtgcagagagtgcttcacccccttcgtgaacggcagcttcttcgagcacgacggccagccctactgcgaggtgcactaccacgagagaagaggcagcctgtgcagcggctgccagaagcccatcaccggcagatgcatcaccgccatggccaagaagttccaccccgagcacttcgtgtgcgccttctgcctgaagcagctgaacaagggcaccttcaaggagcagaacgacaagccctactgccagaactgcttcctgaagctgttctgctag

SEQ ID NO: 12055 - DNA, 1674 bp, Artificial Sequence
  Description of Artificial Sequence: Synthetic coding sequence
atggacgacctggacgccctgctggccgacctggagagcaccaccagccacatcagcaagagacccgtgttcctgagcgaggagaccccctacagctaccccaccggcaaccacacctaccaggagatcgccgtgcccccccccgtgccccccccccccagcagcgaggccctgaacggcaccatcctggaccccctggaccagtggcagcccagcagcagcagattcatccaccagcagccccagagcagcagccccgtgtacggcagcagcgccaagaccagcagcgtgagcaacccccaggacagcgtgggcagcccctgcagcagagtgggcgaggaggagcacgtgtacagcttccccaacaagcagaagagcgccgagcccagccccaccgtgatgagcaccagcctgggcagcaacctgagcgagctggacagactgctgctggagctgaacgccgtgcagcacaacccccccggcttccccgccgacgaggccaacagcagcccccccctgcccggcgccctgagccccctgtacggcgtgcccgagaccaacagccccctgggcggcaaggccggccccctgaccaaggagaagcccaagagaaacggcggcagaggcctggaggacgtgagacccagcgtggagagcctgctggacgagctggagagcagcgtgcccagccccgtgcccgccatcaccgtgaaccagggcgagatgagcagcccccagagagtgaccagcacccagcagcagaccagaatcagcgccagcagcgccaccagagagctggacgagctgatggccagcctgagcgacttcaagttcatggcccagggcaagaccggcagcagcagcccccccggcggcccccccaagcccggcagccagctggacagcatgctgggcagcctgcagagcgacctgaacaagctgggcgtggccaccgtggccaagggcgtgtgcggcgcctgcaagaagcccatcgccggccaggtggtgaccgccatgggcaagacctggcaccccgagcacttcgtgtgcacccactgccaggaggagatcggcagcagaaacttcttcgagagagacggccagccctactgcgagaaggactaccacaacctgttcagccccagatgctactactgcaacggccccatcctggacaaggtggtgaccgccctggacagaacctggcaccccgagcacttcttctgcgcccagtgcggcgccttcttcggccccgagggcttccacgagaaggacggcaaggcctactgcagaaaggactacttcgacatgttcgcccccaagtgcggcggctgcgccagagccatcctggagaactacatcagcgccctgaacaccctgtggcaccccgagtgcttcgtgtgcagagagtgcttcacccccttcgtgaacggcagcttcttcgagcacgacggccagccctactgcgaggtgcactaccacgagagaagaggcagcctgtgcagcggctgccagaagcccatcaccggcagatgcatcaccgccatggccaagaagttccaccccgagcacttcgtgtgcgccttctgcctgaagcagctgaacaagggcaccttcaaggagcagaacgacaagccctactgccagaactgcttcctgaagctgttctgctag

SEQ ID NO: 12056 - DNA, 1275 bp, Artificial Sequence
  Description of Artificial Sequence: Synthetic coding sequence
atgagcaccagcctgggcagcaacctgagcgagctggacagactgctgctggagctgaacgccgtgcagcacaacccccccggcttccccgccgacgaggccaacagcagcccccccctgcccggcgccctgagccccctgtacggcgtgcccgagaccaacagccccctgggcggcaaggccggccccctgaccaaggagaagcccaagagaaacggcggcagaggcctggaggacgtgagacccagcgtggagagcctgctggacgagctggagagcagcgtgcccagccccgtgcccgccatcaccgtgaaccagggcgagatgagcagcccccagagagtgaccagcacccagcagcagaccagaatcagcgccagcagcgccaccagagagctggacgagctgatggccagcctgagcgacttcaagttcatggcccagggcaagaccggcagcagcagcccccccggcggcccccccaagcccggcagccagctggacagcatgctgggcagcctgcagagcgacctgaacaagctgggcgtggccaccgtggccaagggcgtgtgcggcgcctgcaagaagcccatcgccggccaggtggtgaccgccatgggcaagacctggcaccccgagcacttcgtgtgcacccactgccaggaggagatcggcagcagaaacttcttcgagagagacggccagccctactgcgagaaggactaccacaacctgttcagccccagatgctactactgcaacggccccatcctggacaaggtggtgaccgccctggacagaacctggcaccccgagcacttcttctgcgcccagtgcggcgccttcttcggccccgagggcttccacgagaaggacggcaaggcctactgcagaaaggactacttcgacatgttcgcccccaagtgcggcggctgcgccagagccatcctggagaactacatcagcgccctgaacaccctgtggcaccccgagtgcttcgtgtgcagagagtgcttcacccccttcgtgaacggcagcttcttcgagcacgacggccagccctactgcgaggtgcactaccacgagagaagaggcagcctgtgcagcggctgccagaagcccatcaccggcagatgcatcaccgccatggccaagaagttccaccccgagcacttcgtgtgcgccttctgcctgaagcagctgaacaagggcaccttcaaggagcagaacgacaagccctactgccagaactgcttcctgaagctgttctgctag

SEQ ID NO: 12057 - DNA, 951 bp, Artificial Sequence
  Description of Artificial Sequence: Synthetic coding sequence
atgagcagcccccagagagtgaccagcacccagcagcagaccagaatcagcgccagcagcgccaccagagagctggacgagctgatggccagcctgagcgacttcaagttcatggcccagggcaagaccggcagcagcagcccccccggcggcccccccaagcccggcagccagctggacagcatgctgggcagcctgcagagcgacctgaacaagctgggcgtggccaccgtggccaagggcgtgtgcggcgcctgcaagaagcccatcgccggccaggtggtgaccgccatgggcaagacctggcaccccgagcacttcgtgtgcacccactgccaggaggagatcggcagcagaaacttcttcgagagagacggccagccctactgcgagaaggactaccacaacctgttcagccccagatgctactactgcaacggccccatcctggacaaggtggtgaccgccctggacagaacctggcaccccgagcacttcttctgcgcccagtgcggcgccttcttcggccccgagggcttccacgagaaggacggcaaggcctactgcagaaaggactacttcgacatgttcgcccccaagtgcggcggctgcgccagagccatcctggagaactacatcagcgccctgaacaccctgtggcaccccgagtgcttcgtgtgcagagagtgcttcacccccttcgtgaacggcagcttcttcgagcacgacggccagccctactgcgaggtgcactaccacgagagaagaggcagcctgtgcagcggctgccagaagcccatcaccggcagatgcatcaccgccatggccaagaagttccaccccgagcacttcgtgtgcgccttctgcctgaagcagctgaacaagggcaccttcaaggagcagaacgacaagccctactgccagaactgcttcctgaagctgttctgctag

SEQ ID NO: 12058 - DNA, 993 bp, Artificial Sequence
  Description of Artificial Sequence: Synthetic coding sequence
atgccccacagcgtgaccctgagaggccccagcccctggggcttcagactggtgggcggcagagacttcagcgcccccctgaccatcagcagagtgcacgccggcagcaaggccgccctggccgccctgtgccccggcgacctgatccaggccatcaacggcgagagcaccgagctgatgacccacctggaggcccagaacagaatcaagggctgccacgaccacctgaccctgagcgtgagcagacccgagggcagaagctggcccagcgcccccgacgacagcaaggcccaggcccacagaatccacatcgaccccgagatccaggacggcagccccaccaccagcagaagacccagcggcaccggcaccggccccgaggacggcagacccagcctgggcagcccctacggccagccccccagattccccgtgccccacaacggcagcagcgaggccaccctgcccgcccagatgagcaccctgcacgtgagccccccccccagcgccgaccccgccagaggcctgcccagaagcagagactgcagagtggacctgggcagcgaggtgtacagaatgctgagagagcccgccgagcccgtggccgccgagcccaagcagagcggcagcttcagatacctgcagggcatgctggaggccggcgagggcggcgactggcccggccccggcggccccagaaacctgaagcccaccgccagcaagctgggcgcccccctgagcggcctgcagggcctgcccgagtgcaccagatgcggccacggcatcgtgggcaccatcgtgaaggccagagacaagctgtaccaccccgagtgcttcatgtgcagcgactgcggcctgaacctgaagcagagaggctacttcttcctggacgagagactgtactgcgagagccacgccaaggccagagtgaagccccccgagggctacgacgtggtggccgtgtaccccaacgccaaggtggagctggtgtag

SEQ ID NO: 12059 - DNA, 741 bp, Artificial Sequence
  Description of Artificial Sequence: Synthetic coding sequence
atgccccacagcgtgaccctgagaggccccagcccctggggcttcagactggtgggcggcagagacttcagcgcccccctgaccatcagcagagtgcacgccggcagcaaggccgccctggccgccctgtgccccggcgacctgatccaggccatcaacggcgagagcaccgagctgatgacccacctggaggcccagaacagaatcaagggctgccacgaccacctgaccctgagcgtgagcagacccgagggcagaagctggcccagcgcccccgacgacagcaaggcccaggcccacagaatccacatcgaccccgagatccaggacggcagccccaccaccagcagaagacccagcggcaccggcaccggccccgaggacggcagacccagcctgggcagcccctacggccagccccccagattccccgtgccccacaacggcagcagcgaggccaccctgcccgcccagatgagcaccctgcacgtgagccccccccccagcgccgaccccgccagaggcctgcccagaagcagagactgcagagtggacctgggcagcgaggtgtacagaatgctgagagagcccgccgagcccgtggccgccgagcccaagcagagcggcagcttcagatacctgcagggcatgctggaggccggcgagggcggcgcccccagcagcagacacggcaccagcagcaccatccccagcgccagctgcgccgtgaccgccgcctag

SEQ ID NO: 12060 - DNA, 1791 bp, Artificial Sequence
  Description of Artificial Sequence: Synthetic coding sequence
atgagcaactacagcgtgagcctggtgggccccgccccctggggcttcagactgcagggcggcaaggacttcaacatgcccctgaccatcagcagcctgaaggacggcggcaaggccgcccaggccaacgtgagaatcggcgacgtggtgctgagcatcgacggcatcaacgcccagggcatgacccacctggaggcccagaacaagatcaagggctgcaccggcagcctgaacatgaccctgcagagagccagcgccgcccccaagcccgagcccgtgcccgtgcagaagggcgagcccaaggaggtggtgaagcccgtgcccatcaccagccccgccgtgagcaaggtgaccagcaccaacaacatggcctacaacaaggcccccagacccttcggcagcgtgagcagccccaaggtgaccagcatccccagccccagcagcgccttcacccccgcccacgccaccaccagcagccacgccagccccagccccgtggccgccgtgaccccccccctgttcgccgccagcggcctgcacgccaacgccaacctgagcgccgaccagagccccagcgccctgagcgccggcaagaccgccgtgaacgtgcccagacagcccaccgtgaccagcgtgtgcagcgagaccagccaggagctggccgagggccagagaagaggcagccagggcgacagcaagcagcagaacggcccccccagaaagcacatcgtggagagatacaccgagttctaccacgtgcccacccacagcgacgccagcaagaagagactgatcgaggacaccgaggactggagacccagaaccggcaccacccagagcagaagcttcagaatcctggcccagatcaccggcaccgagcacctgaaggagagcgaggccgacaacaccaagaaggccaacaacagccaggagcccagcccccagctggccagcagcgtggccagcaccagaagcatgcccgagagcctggacagccccaccagcggcagacccggcgtgaccagcctgaccgccgccgccgccttcaagcccgtgggcagcaccggcgtgatcaagagccccagctggcagagacccaaccagggcgtgcccagcaccggcagaatcagcaacagcgccacctacagcggcagcgtggcccccgccaacagcgccctgggccagacccagcccagcgaccaggacaccctggtgcagagagccgagcacatccccgccggcaagagaacccccatgtgcgcccactgcaaccaggtgatcagaggccccttcctggtggccctgggcaagagctggcaccccgaggagttcaactgcgcccactgcaagaacaccatggcctacatcggcttcgtggaggagaagggcgccctgtactgcgagctgtgctacgagaagttcttcgcccccgagtgcggcagatgccagagaaagatcctgggcgaggtgatcagcgccctgaagcagacctggcacgtgagctgcttcgtgtgcgtggcctgcggcaagcccatcagaaacaacgtgttccacctggaggacggcgagccctactgcgagaccgactactacgccctgttcggcaccatctgccacggctgcgagttccccatcgaggccggcgacatgttcctggaggccctgggctacacctggcacgacacctgcttcgtgtgcagcgtgtgctgcgagagcctggagggccagaccttcttcagcaagaaggacaagcccctgtgcaagaagcacgcccacagcgtgaacttctag

SEQ ID NO: 12061 - DNA, 645 bp, Artificial Sequence
  Description of Artificial Sequence: Synthetic coding sequence
atgagcaactacagcgtgagcctggtgggccccgccccctggggcttcagactgcagggcggcaaggacttcaacatgcccctgaccatcagcagcctgaaggacggcggcaaggccgcccaggccaacgtgagaatcggcgacgtggtgctgagcatcgacggcatcaacgcccagggcatgacccacctggaggcccagaacaagatcaagggctgcaccggcagcctgaacatgaccctgcagagagccagcgccgcccccaagcccgagcccgtgcccgtgcagaagaagacccaggtgaccaacaaccccggcaccgtgaagatcccccccaagagaccccccagaaagcacatcgtggagagatacaccgagttctaccacgtgcccacccacagcgacgccagcaagaagagactgatcgaggacaccgaggactggagacccagaaccggcaccacccagagcagaagcttcagaatcctggcccagatcaccggcaccgagcacctgaaggagagcgaggccgacaacaccaagaaggccaaggagaagatccccctgcacgtgttcagccccaagtacaccaagctgagagactggcaccacgaggtgagcgccagagccctgaacgtgcagtag

SEQ ID NO: 12062 - DNA, 705 bp, Artificial Sequence
  Description of Artificial Sequence: Synthetic coding sequence
atgagcaactacagcgtgagcctggtgggccccgccccctggggcttcagactgcagggcggcaaggacttcaacatgcccctgaccatcagcagcctgaaggacggcggcaaggccgcccaggccaacgtgagaatcggcgacgtggtgctgagcatcgacggcatcaacgcccagggcatgacccacctggaggcccagaacaagatcaagggctgcaccggcagcctgaacatgaccctgcagagagccagcgccgcccccaagcccgagcccgtgcccgtgcagaagcccaccgtgaccagcgtgtgcagcgagaccagccaggagctggccgagggccagagaagaggcagccagggcgacagcaagcagcagaacggcaagatcccccccaagagaccccccagaaagcacatcgtggagagatacaccgagttctaccacgtgcccacccacagcgacgccagcaagaagagactgatcgaggacaccgaggactggagacccagaaccggcaccacccagagcagaagcttcagaatcctggcccagatcaccggcaccgagcacctgaaggagagcgaggccgacaacaccaagaaggccaaggagaagatccccctgcacgtgttcagccccaagtacaccaagctgagagactggcaccacgaggtgagcgccagagccctgaacgtgcagtag

SEQ ID NO: 12063 - DNA, 1464 bp, Artificial Sequence
  Description of Artificial Sequence: Synthetic coding sequence
atgagcaactacagcgtgagcctggtgggccccgccccctggggcttcagactgcagggcggcaaggacttcaacatgcccctgaccatcagcagcctgaaggacggcggcaaggccgcccaggccaacgtgagaatcggcgacgtggtgctgagcatcgacggcatcaacgcccagggcatgacccacctggaggcccagaacaagatcaagggctgcaccggcagcctgaacatgaccctgcagagagccagcgccgcccccaagcccgagcccgtgcccgtgcagaagcccaccgtgaccagcgtgtgcagcgagaccagccaggagctggccgagggccagagaagaggcagccagggcgacagcaagcagcagaacggcccccccagaaagcacatcgtggagagatacaccgagttctaccacgtgcccacccacagcgacgccagcaagaagagactgatcgaggacaccgaggactggagacccagaaccggcaccacccagagcagaagcttcagaatcctggcccagatcaccggcaccgagcacctgaaggagagcgaggccgacaacaccaagaaggccaacaacagccaggagcccagcccccagctggccagcagcgtggccagcaccagaagcatgcccgagagcctggacagccccaccagcggcagacccggcgtgaccagcctgaccgccgccgccgccttcaagcccgtgggcagcaccggcgtgatcaagagccccagctggcagagacccaaccagggcgtgcccagcaccggcagaatcagcaacagcgccacctacagcggcagcgtggcccccgccaacagcgccctgggccagacccagcccagcgaccaggacaccctggtgcagagagccgagcacatccccgccggcaagagaacccccatgtgcgcccactgcaaccaggtgatcagaggccccttcctggtggccctgggcaagagctggcaccccgaggagttcaactgcgcccactgcaagaacaccatggcctacatcggcttcgtggaggagaagggcgccctgtactgcgagctgtgctacgagaagttcttcgcccccgagtgcggcagatgccagagaaagatcctgggcgaggtgatcagcgccctgaagcagacctggcacgtgagctgcttcgtgtgcgtggcctgcggcaagcccatcagaaacaacgtgttccacctggaggacggcgagccctactgcgagaccgactactacgccctgttcggcaccatctgccacggctgcgagttccccatcgaggccggcgacatgttcctggaggccctgggctacacctggcacgacacctgcttcgtgtgcagcgtgtgctgcgagagcctggagggccagaccttcttcagcaagaaggacaagcccctgtgcaagaagcacgcccacagcgtgaacttctag

SEQ ID NO: 12064 - DNA, 705 bp, Artificial Sequence
  Description of Artificial Sequence: Synthetic coding sequence
atgagcaactacagcgtgagcctggtgggccccgccccctggggcttcagactgcagggcggcaaggacttcaacatgcccctgaccatcagcagcctgaaggacggcggcaaggccgcccaggccaacgtgagaatcggcgacgtggtgctgagcatcgacggcatcaacgcccagggcatgacccacctggaggcccagaacaagatcaagggctgcaccggcagcctgaacatgaccctgcagagagccagcgccgcccccaagcccgagcccgtgcccgtgcagaagcccaccgtgaccagcgtgtgcagcgagaccagccaggagctggccgagggccagagaagaggcagccagggcgacagcaagcagcagaacggccccgtgcccagaaagatcccccccagaaagcacatcgtggagagatacaccgagttctaccacgtgcccacccacagcgacgccagcaagaagagactgatcgaggacaccgaggactggagacccagaaccggcaccacccagagcagaagcttcagaatcctggcccagatcaccggcaccgagcacctgaaggagagcgaggccgacaacaccaagaaggccaaggagaagatccccctgcacgtgttcagccccaagtacaccaagctgagagactggcaccacgaggtgagcgccagagccctgaacgtgcagtag

SEQ ID NO: 12065 - DNA, 645 bp, Artificial Sequence
  Description of Artificial Sequence: Synthetic coding sequence
atgagcaactacagcgtgagcctggtgggccccgccccctggggcttcagactgcagggcggcaaggacttcaacatgcccctgaccatcagcagcctgaaggacggcggcaaggccgcccaggccaacgtgagaatcggcgacgtggtgctgagcatcgacggcatcaacgcccagggcatgacccacctggaggcccagaacaagatcaagggctgcaccggcagcctgaacatgaccctgcagagagccagcgccgcccccaagcccgagcccgtgcccgtgcagaaggtgacccagaagagagagagcagaagcagcagaagaaccgcccccggcctgccccccagaaagcacatcgtggagagatacaccgagttctaccacgtgcccacccacagcgacgccagcaagaagagactgatcgaggacaccgaggactggagacccagaaccggcaccacccagagcagaagcttcagaatcctggcccagatcaccggcaccgagcacctgaaggagagcgaggccgacaacaccaagaaggccaaggagaagatccccctgcacgtgttcagccccaagtacaccaagctgagagactggcaccacgaggtgagcgccagagccctgaacgtgcagtag

SEQ ID NO: 12066 - DNA, 1425 bp, Artificial Sequence
  Description of Artificial Sequence: Synthetic coding sequence
atggcctacaacaaggcccccagacccttcggcagcgtgagcagccccaaggtgaccagcatccccagccccagcagcgccttcacccccgcccacgccaccaccagcagccacgccagccccagccccgtggccgccgtgaccccccccctgttcgccgccagcggcctgcacgccaacgccaacctgagcgccgaccagagccccagcgccctgagcgccggcaagaccgccgtgaacgtgcccagacagcccaccgtgaccagcgtgtgcagcgagaccagccaggagctggccgagggccagagaagaggcagccagggcgacagcaagcagcagaacggcccccccagaaagcacatcgtggagagatacaccgagttctaccacgtgcccacccacagcgacgccagcaagaagagactgatcgaggacaccgaggactggagacccagaaccggcaccacccagagcagaagcttcagaatcctggcccagatcaccggcaccgagcacctgaaggagagcgaggccgacaacaccaagaaggccaacaacagccaggagcccagcccccagctggccagcagcgtggccagcaccagaagcatgcccgagagcctggacagccccaccagcggcagacccggcgtgaccagcctgaccgccgccgccgccttcaagcccgtgggcagcaccggcgtgatcaagagccccagctggcagagacccaaccagggcgtgcccagcaccggcagaatcagcaacagcgccacctacagcggcagcgtggcccccgccaacagcgccctgggccagacccagcccagcgaccaggacaccctggtgcagagagccgagcacatccccgccggcaagagaacccccatgtgcgcccactgcaaccaggtgatcagaggccccttcctggtggccctgggcaagagctggcaccccgaggagttcaactgcgcccactgcaagaacaccatggcctacatcggcttcgtggaggagaagggcgccctgtactgcgagctgtgctacgagaagttcttcgcccccgagtgcggcagatgccagagaaagatcctgggcgaggtgatcagcgccctgaagcagacctggcacgtgagctgcttcgtgtgcgtggcctgcggcaagcccatcagaaacaacgtgttccacctggaggacggcgagccctactgcgagaccgactactacgccctgttcggcaccatctgccacggctgcgagttccccatcgaggccggcgacatgttcctggaggccctgggctacacctggcacgacacctgcttcgtgtgcagcgtgtgctgcgagagcctggagggccagaccttcttcagcaagaaggacaagcccctgtgcaagaagcacgcccacagcgtgaacttctag

SEQ ID NO: 12067 - DNA, 411 bp, Artificial Sequence
  Description of Artificial Sequence: Synthetic coding sequence
atgagcaactacagcgtgagcctggtgggccccgccccctggggcttcagactgcagggcggcaaggacttcaacatgcccctgaccatcagcagcgccggcgtgcagtggagaaacctgggcagcccccagccccccagccccgagttcaagagattcagctgcctgagcctgcccagcagctgggactacagacacgtgccccccagactggccaacttcgtgttcctggtggagaccaagttcccctacgtgggccaggccggcctggagctgcccaccagcggcgacctgcccaccagcgccagccagagcgccaagatcaccggcgtgagccacagagcctggcccaccctgttctacaccctgctgttcttcgccaccatctaccccgagatcatcctgtactag

SEQ ID NO: 12068 - DNA, 669 bp, Artificial Sequence
  Description of Artificial Sequence: Synthetic coding sequence
atggacagcttcaaggtggtgctggagggccccgccccctggggcttcagactgcagggcggcaaggacttcaacgtgcccctgagcatcagcagactgacccccggcggcaaggccgcccaggccggcgtggccgtgggcgactgggtgctgagcatcgacggcgagaacgccggcagcctgacccacatcgaggcccagaacaagatcagagcctgcggcgagagactgagcctgggcctgagcagagcccagcccgtgcagagcaagccccagaaggccagcgcccccgccgccgacccccccagatacaccttcgcccccagcgtgagcctgaacaagaccgccagacccttcggcgcccccccccccgccgacagcgccccccagcagaacggccagcccctgagacccctggtgcccgacgccagcaagcagagactgatggagaacaccgaggactggagacccagacccggcaccggccagagcagaagcttcagaatcctggcccacctgaccggcaccgagttcatgcaggaccccgacgaggagcacctgaagaagagcagagagaagtacgtgctggagctgcagagccccagatacaccagactgagagactggcaccaccagagaagcgcccacgtgctgaacgtgcagagctag

SEQ ID NO: 12069 - DNA, 1374 bp, Artificial Sequence
  Description of Artificial Sequence: Synthetic coding sequence
atggacagcttcaaggtggtgctggagggccccgccccctggggcttcagactgcagggcggcaaggacttcaacgtgcccctgagcatcagcagactgacccccggcggcaaggccgcccaggccggcgtggccgtgggcgactgggtgctgagcatcgacggcgagaacgccggcagcctgacccacatcgaggcccagaacaagatcagagcctgcggcgagagactgagcctgggcctgagcagagcccagcccgtgcagagcaagccccagaaggccagcgcccccgccgccgacccccccagatacaccttcgcccccagcgtgagcctgaacaagaccgccagacccttcggcgcccccccccccgccgacagcgccccccagcagaacggccagcccctgagacccctggtgcccgacgccagcaagcagagactgatggagaacaccgaggactggagacccagacccggcaccggccagagcagaagcttcagaatcctggcccacctgaccggcaccgagttcatgcaggaccccgacgaggagcacctgaagaagagcagccaggtgcccagaaccgaggcccccgcccccgccagcagcaccccccaggagccctggcccggccccaccgcccccagccccaccagcagacccccctgggccgtggaccccgccttcgccgagagatacgcccccgacaagaccagcaccgtgctgaccagacacagccagcccgccacccccacccccctgcagagcagaaccagcatcgtgcaggccgccgccggcggcgtgcccggcggcggcagcaacaacggcaagacccccgtgtgccaccagtgccacaaggtgatcagaggcagatacctggtggccctgggccacgcctaccaccccgaggagttcgtgtgcagccagtgcggcaaggtgctggaggagggcggcttcttcgaggagaagggcgccatcttctgccccccctgctacgacgtgagatacgcccccagctgcgccaagtgcaagaagaagatcaccggcgagatcatgcacgccctgaagatgacctggcacgtgcactgcttcacctgcgccgcctgcaagacccccatcagaaacagagccttctacatggaggagggcgtgccctactgcgagagagactacgagaagatgttcggcaccaagtgccacggctgcgacttcaagatcgacgccggcgacagattcctggaggccctgggcttcagctggcacgacacctgcttcgtgtgcgccatctgccagatcaacctggagggcaagaccttctacagcaagaaggacagacccctgtgcaagagccacgccttcagccacgtgtag

SEQ ID NO: 12070 - DNA, 864 bp, Artificial Sequence
  Description of Artificial Sequence: Synthetic coding sequence
atggacagcttcaaggtggtgctggagggccccgccccctggggcttcagactgcagggcggcaaggacttcaacgtgcccctgagcatcagcagactgacccccggcggcaaggccgcccaggccggcgtggccgtgggcgactgggtgctgagcatcgacggcgagaacgccggcagcctgacccacatcgaggcccagaacaagatcagagcctgcggcgagagactgagcctgggcctgagcagagcccagcccgtgcagagcaagccccagaaggccagcgcccccgccgccgacccccccagatacaccttcgcccccagcgtgagcctgaacaagaccgccagacccttcggcgcccccccccccgccgacagcgccccccagcagaacggccagcccctgagacccctggtgcccgacgccagcaagcagagactgatggagaacaccgaggactggagacccagacccggcaccggccagagcagaagcttcagaatcctggcccacctgaccggcaccgagttcatgcaggaccccgacgaggagcacctgaagaagagcagaccctacagaccccagccctaccagccccccgccctgggctgcggcccctgcgtgtgcagagccctgtgccccggccagaacgagcacagcgccgaccccgcccagcccgccggccacgcccacgccgccgccgagccccacctgcactgcgccggcagctgcagaagaggcgccagaagaggccagcagcagagacaggacagcagagtgagccccgtgccccagggccaccccggccccctgcccggcggcgccggccccagagtgccccccggcggcgtgtgcgtgtag

SEQ ID NO: 12071 - DNA, 1272 bp, Artificial Sequence
  Description of Artificial Sequence: Synthetic coding sequence
atggacagcttcaaggtggtgctggagggccccgccccctggggcttcagactgcagggcggcaaggacttcaacgtgcccctgagcatcagcagactgacccccggcggcaaggccgcccaggccggcgtggccgtgggcgactgggtgctgagcatcgacggcgagaacgccggcagcctgacccacatcgaggcccagaacaagatcagagcctgcggcgagagactgagcctgggcctgagcagagcccagcccgtgcagagcaagccccagaaggtgcagacccccgacaagcagcccctgagacccctggtgcccgacgccagcaagcagagactgatggagaacaccgaggactggagacccagacccggcaccggccagagcagaagcttcagaatcctggcccacctgaccggcaccgagttcatgcaggaccccgacgaggagcacctgaagaagagcagccaggtgcccagaaccgaggcccccgcccccgccagcagcaccccccaggagccctggcccggccccaccgcccccagccccaccagcagacccccctgggccgtggaccccgccttcgccgagagatacgcccccgacaagaccagcaccgtgctgaccagacacagccagcccgccacccccacccccctgcagagcagaaccagcatcgtgcaggccgccgccggcggcgtgcccggcggcggcagcaacaacggcaagacccccgtgtgccaccagtgccacaaggtgatcagaggcagatacctggtggccctgggccacgcctaccaccccgaggagttcgtgtgcagccagtgcggcaaggtgctggaggagggcggcttcttcgaggagaagggcgccatcttctgccccccctgctacgacgtgagatacgcccccagctgcgccaagtgcaagaagaagatcaccggcgagatcatgcacgccctgaagatgacctggcacgtgcactgcttcacctgcgccgcctgcaagacccccatcagaaacagagccttctacatggaggagggcgtgccctactgcgagagagactacgagaagatgttcggcaccaagtgccacggctgcgacttcaagatcgacgccggcgacagattcctggaggccctgggcttcagctggcacgacacctgcttcgtgtgcgccatctgccagatcaacctggagggcaagaccttctacagcaagaaggacagacccctgtgcaagagccacgccttcagccacgtgtag

SEQ ID NO: 12072 - DNA, 522 bp, Artificial Sequence
  Description of Artificial Sequence: Synthetic coding sequence
atggacagcttcaaggtggtgctggagggccccgccccctggggcttcagactgcagggcggcaaggacttcaacgtgcccctgagcatcagcagactgacccccggcggcaaggccgcccaggccggcgtggccgtgggcgactgggtgctgagcatcgacggcgagaacgccggcagcctgacccacatcgaggcccagaacaagatcagagcctgcggcgagagactgagcctgggcctgagcagagcccagcccgtgcagagcaagccccagaaggccagcgcccccgccgccgacccccccagatacaccttcgcccccagcgtgagcctgaacaagaccgccagacccttcggcgcccccccccccgccgacagcgccccccagcagaacggccagcccctgagacccctggtgcccgacgccagcaagcagagactgatggagaacaccgaggactggagacccagacccggcaccggccagagcagaagcttcagaatcctggcccacctgtag

SEQ ID NO: 12073 - DNA, 273 bp, Artificial Sequence
  Description of Artificial Sequence: Synthetic coding sequence
atggacagcttcaaggtggtgctggagggccccgccccctggggcttcagactgcagggcggcaaggacttcaacgtgcccctgagcatcagcagactgacccccggcggcaaggccgcccaggccggcgtggccgtgggcgactgggtgctgagcatcgacggcgagaacgccggcagcctgacccacatcgaggcccagaacaagatcagagcctgcggcgagagactgagcctgggcctgagcagagcccagcccgtgcagagcaagtag

SEQ ID NO: 12074 - DNA, 492 bp, Artificial Sequence
  Description of Artificial Sequence: Synthetic coding sequence
atggccgacgaggagaagctgccccccggctgggagaagagaatgagcagaagcagcggcagagtgtactacttcaaccacatcaccaacgccagccagtgggagagacccagcggcaacagcagcagcggcggcaagaacggccagggcgagcccgccagagtgagatgcagccacctgctggtgaagcacagccagagcagaagacccagcagctggagacaggagaagatcaccagaaccaaggaggaggccctggagctgatcaacggctacatccagaagatcaagagcggcgaggaggacttcgagagcctggccagccagttcagcgactgcagcagcgccaaggccagaggcgacctgggcgccttcagcagaggccagatgcagaagcccttcgaggacgccagcttcgccctgagaaccggcgagatgagcggccccgtgttcaccgacagcggcatccacatcatcctgagaaccgagtag

SEQ ID NO: 12075 - DNA, 138 bp, Artificial Sequence
  Description of Artificial Sequence: Synthetic coding sequence
atgcagaagcccttcgaggacgccagcttcgccctgagaaccggcgagatgagcggccccgtgttcaccgacagcggcatccacatcatcctgagaaccgagtgctggagacagaccagaggccccaactgcttctag

SEQ ID NO: 12076 - DNA, 438 bp, Artificial Sequence
  Description of Artificial Sequence: Synthetic coding sequence
atggccgacgaggagaagctgccccccggctgggagaagagaatgagcagaagcagcggcagagtgtactacttcaaccacatcaccaacgccagccagtgggagagacccagcggcaacagcagcagcggcggcaagaacggccagggcgagcccgccagagtgagatgcagccacctgctggtgaagcacagccagagcagaagacccagcagctggagacaggagaagatcaccagaaccaaggaggaggccctggagctgatcaacggctacatccagaagatcaagagcggcgaggaggacttcgagagcctggccagccagttcagcgactgcagcagcgccaaggccagaggcgacctgggcgccttcagcagaggcgcccagggcatgggcctgaccagactgggcgacccctaccaccccgagggctag

SEQ ID NO: 12077 - DNA, 561 bp, Artificial Sequence
  Description of Artificial Sequence: Synthetic coding sequence
atgaccatggtggacaccgagatgcccttctggcccaccaacttcggcatcagcagcgtggacctgagcgtgatggaggaccacagccacagcttcgacatcaagcccttcaccaccgtggacttcagcagcatcagcaccccccactacgaggacatccccttcaccagaaccgaccccgtggtggccgactacaagtacgacctgaagctgcaggagtaccagagcgccatcaaggtggagcccgccagccccccctactacagcgagaagacccagctgtacaacaagccccacgaggagcccagcaacagcctgatggccatcgagtgcagagtgtgcggcgacaaggccagcggcttccactacggcgtgcacgcctgcgagggctgcaagggcttcttcagaagaaccatcagactgaagctgatctacgacagatgcgacctgaactgcagaatccacaagaagagcagaaacaagtgccagtactgcagattccagaagtgcctggccgtgggcatgagccacaacgaggagctgcagaaggacagctactag

SEQ ID NO: 12078 - DNA, 1752 bp, Artificial Sequence
  Description of Artificial Sequence: Synthetic coding sequence
atgggcggcctggagaagaagaagtacgagagaggcagcgccaccaactacatcaccagaaacaaggccagaaagaagctgcagctgagcctggccgacttcagaagactgtgcatcctgaagggcatctacccccacgagcccaagcacaagaagaaggtgaacaagggcagcaccgccgccagaaccttctacctgatcaaggacatcagattcctgctgcacgagcccatcgtgaacaagttcagagagtacaaggtgttcgtgagaaagctgagaaaggcctacggcaagagcgagtggaacaccgtggagagactgaaggacaacaagcccaactacaagctggaccacatcatcaaggagagataccccaccttcatcgacgccctgagagacctggacgacgccctgagcatgtgcttcctgttcagcaccttccccagaaccggcaagtgccacgtgcagaccatccagctgtgcagaagactgaccgtggagttcatgcactacatcatcgccgccagagccctgagaaaggtgttcctgagcatcaagggcatctactaccaggccgaggtgctgggccagcccatcgtgtggatcaccccctacgccttcagccacgaccaccccaccgacgtggactacagagtgatggccaccttcaccgagttctacaccaccctgctgggcttcgtgaacttcagactgtaccagctgctgaacctgcactacccccccaagctggagggccaggcccaggccgaggccaaggccggcgagggcacctacgccctggacagcgagagctgcatggagaagctggccgccctgagcgccagcctggccagagtggtggtgcccgccaccgaggaggaggccgaggtggacgagttccccaccgacggcgaggaggacagaagaaaggagctggaggcccaggagaagcacaagaagctgttcgagggcctgaagttcttcctgaacagagaggtgcccagagaggccctggccttcatcatcagaagcttcggcggcgaggtgagctgggacaagagcctgtgcatcggcgccacctacgacgtgaccgacagcagaatcacccaccagatcgtggacagacccggccagcagaccagcgtgatcggcagatgctacgtgcagccccagtgggtgttcgacagcgtgaacgccagactgctgctgcccgtggccgagtacttcagcggcgtgcagctgcccccccacctgagccccttcgtgaccgagaaggagggcgactacgtgccccccgagaagctgaagctgctggccctgcagagaggcgaggaccccggcaacctgaacgagagcgaggaggaggaggaggaggacgacaacaacgagggcgacggcgacgaggagggcgagaacgaggaggaggaggaggacgccgaggccggcagcgagaaggaggaggaggccagactggccgccctggaggagcagagaatggagggcaagaagcccagagtgatggccggcaccctgaagctggaggacaagcagagactggcccaggaggaggagagcgaggccaagagactggccatcatgatgatgaagaagagagagaagtacctgtaccagaagatcatgttcggcaagagaagaaagatcagagaggccaacaagctggccgagaagagaaaggcccacgacgaggccgtgagaagcgagaagaaggccaagaaggccagacccgagtag

SEQ ID NO: 12079 - DNA, 1767 bp, Artificial Sequence
  Description of Artificial Sequence: Synthetic coding sequence
atgggcggcctggagaagaagaagtacgagagaggcagcgccaccaactacatcaccagaaacaaggccagaaagaagctgcagctgagcctggccgacttcagaagactgtgcatcctgaagggcatctacccccacgagcccaagcacaagaagaaggtgaacaagggcagcaccgccgccagaaccttctacctgatcaaggacatcagattcctgctgcacgagcccatcgtgaacaagttcagagagtacaaggtgttcgtgagaaagctgagaaaggcctacggcaagagcgagtggaacaccgtggagagactgaaggacaacaagcccaactacaagctggaccacatcatcaaggagagataccccaccttcatcgacgccctgagagacctggacgacgccctgagcatgtgcttcctgttcagcaccttccccagaaccggcaagtgccacgtgcagaccatccagctgtgcagaagactgaccgtggagttcatgcactacatcatcgccgccagagccctgagaaaggtgttcctgagcatcaagggcatctactaccaggccgaggtgctgggccagcccatcgtgtggatcaccccctacgccttcagccacgaccaccccaccgacgtggactacagagtgatggccaccttcaccgagttctacaccaccctgctgggcttcgtgaacttcagactgtaccagctgctgaacctgcactacccccccaagctggagggccaggcccaggccgaggccaaggccggcgagggcacctacgccctggacagcgagagctgcatggagaagctggccgccctgagcgccagcctggccagagtggtggtgcccgccaccgaggaggaggccgaggtggacgagttccccaccgacggcgagatgagcgcccaggaggaggacagaagaaaggagctggaggcccaggagaagcacaagaagctgttcgagggcctgaagttcttcctgaacagagaggtgcccagagaggccctggccttcatcatcagaagcttcggcggcgaggtgagctgggacaagagcctgtgcatcggcgccacctacgacgtgaccgacagcagaatcacccaccagatcgtggacagacccggccagcagaccagcgtgatcggcagatgctacgtgcagccccagtgggtgttcgacagcgtgaacgccagactgctgctgcccgtggccgagtacttcagcggcgtgcagctgcccccccacctgagccccttcgtgaccgagaaggagggcgactacgtgccccccgagaagctgaagctgctggccctgcagagaggcgaggaccccggcaacctgaacgagagcgaggaggaggaggaggaggacgacaacaacgagggcgacggcgacgaggagggcgagaacgaggaggaggaggaggacgccgaggccggcagcgagaaggaggaggaggccagactggccgccctggaggagcagagaatggagggcaagaagcccagagtgatggccggcaccctgaagctggaggacaagcagagactggcccaggaggaggagagcgaggccaagagactggccatcatgatgatgaagaagagagagaagtacctgtaccagaagatcatgttcggcaagagaagaaagatcagagaggccaacaagctggccgagaagagaaaggcccacgacgaggccgtgagaagcgagaagaaggccaagaaggccagacccgagtag

SEQ ID NO: 12080 - DNA, 1350 bp, Artificial Sequence
  Description of Artificial Sequence: Synthetic coding sequence
atgtgcttcctgttcagcaccttccccagaaccggcaagtgccacgtgcagaccatccagctgtgcagaagactgaccgtggagttcatgcactacatcatcgccgccagagccctgagaaaggtgttcctgagcatcaagggcatctactaccaggccgaggtgctgggccagcccatcgtgtggatcaccccctacgccttcagccacgaccaccccaccgacgtggactacagagtgatggccaccttcaccgagttctacaccaccctgctgggcttcgtgaacttcagactgtaccagctgctgaacctgcactacccccccaagctggagggccaggcccaggccgaggccaaggccggcgagggcacctacgccctggacagcgagagctgcatggagaagctggccgccctgagcgccagcctggccagagtggtggtgcccgccaccgaggaggaggccgaggtggacgagttccccaccgacggcgagatgagcgcccaggaggaggacagaagaaaggagctggaggcccaggagaagcacaagaagctgttcgagggcctgaagttcttcctgaacagagaggtgcccagagaggccctggccttcatcatcagaagcttcggcggcgaggtgagctgggacaagagcctgtgcatcggcgccacctacgacgtgaccgacagcagaatcacccaccagatcgtggacagacccggccagcagaccagcgtgatcggcagatgctacgtgcagccccagtgggtgttcgacagcgtgaacgccagactgctgctgcccgtggccgagtacttcagcggcgtgcagctgcccccccacctgagccccttcgtgaccgagaaggagggcgactacgtgccccccgagaagctgaagctgctggccctgcagagaggcgaggaccccggcaacctgaacgagagcgaggaggaggaggaggaggacgacaacaacgagggcgacggcgacgaggagggcgagaacgaggaggaggaggaggacgccgaggccggcagcgagaaggaggaggaggccagactggccgccctggaggagcagagaatggagggcaagaagcccagagtgatggccggcaccctgaagctggaggacaagcagagactggcccaggaggaggagagcgaggccaagagactggccatcatgatgatgaagaagagagagaagtacctgtaccagaagatcatgttcggcaagagaagaaagatcagagaggccaacaagctggccgagaagagaaaggcccacgacgaggccgtgagaagcgagaagaaggccaagaaggccagacccgagtag

SEQ ID NO: 12081 - DNA, 1350 bp, Artificial Sequence; identical to SEQ ID NO: 12080
  Description of Artificial Sequence: Synthetic coding sequence

SEQ ID NO: 12082 - DNA, 5154 bp, Artificial Sequence
  Description of Artificial Sequence: Synthetic coding sequence
atggagcccgccgccgccgccaccgtgcagagactgcccgagctgggcagagaggacagagccagcgcccccgccgccgccgccgccgccgccgccgccgccgccgccgccgccgccgccctggccgccgccgccggcggcggcagaagccccgagcccgccctgacccccgccgcccccagcggcggcaacggcagcggcagcggcgccagagaggaggcccccggcgaggccccccccggccccctgcccggcagagccggcggcgccggcagaagaagaagaagaggcgccccccagcccatcgccggcggcgccgcccccgtgcccggcgccggcggcggcgccaacagcctgctgctgagaagaggcagactgaagagaaacctgagcgccgccgccgccgccgccagcagcagcagcagcagcagcgccgccgccgccagccacagccccggcgccgccggcctgcccgccagctgcagcgccagcgccagcctgtgcaccagaagcctggacagaaagaccctgctgctgaagcacagacagaccctgcagctgcagcccagcgacagagactgggtgagacaccagctgcagagaggctgcgtgcacgtgttcgacagacacatggccagcacctacctgagacccgtgctgtgcaccctggacaccaccgccggcgaggtggccgccagactgctgcagctgggccacaagggcggcggcgtggtgaaggtgctgggccagggccccggcgccgccgccgccagagagcccgccgagcccccccccgaggccggccccagactggccccccccgagcccagagacagcgaggtgccccccgccagaagcgcccccggcgccttcggcggcccccccagagccccccccgccgacctgcccctgcccgtgggcggccccggcggctggagcagaagagccagccccgcccccagcgacagcagccccggcgagcccttcgtgggcggccccgtgagcagccccagagcccccagacccgtggtgagcgacaccgagagcttcagcctgagccccagcgccgagagcgtgagcgacagactggacccctacagcagcggcggcggcagcagcagcagcagcgaggagctggaggccgacgccgccagcgcccccaccggcgtgcccggccagcccagaagacccggccaccccgcccagcccctgcccctgccccagaccgccagcagcccccagccccagcagaaggcccccagagccatcgacagccccggcggcgccgtgagagagggcagctgcgaggagaaggccgccgccgccgtggcccccggcggcctgcagagcacccccggcagaagcggcgtgaccgccgagaaggcccccccccccccccccccccccaccctgtacgtgcagctgcacggcgagaccaccagaagactggaggccgaggagaagcccctgcagatccagaacgactacctgttccagctgggcttcggcgagctgtggagagtgcaggaggagggcatggacagcgagatcggctgcctgatcagattctacgccggcaagccccacagcaccggcagcagcgagagaatccagctgagcggcatgtacaacgtgagaaagggcaagatgcagctgcccgtgaacagatggaccagaagacaggtgatcctgtgcggcacctgcctgatcgtgagcagcgtgaaggacagcctgaccggcaagatgcacgtgctgcccctgatcggcggcaaggtggaggaggtgaagaagcaccagcactgcctggccttcagcagcagcggcccccagagccagacctactacatctgcttcgacaccttcaccgagtacctgagatggctgagacaggtgagcaaggtggccagccagagaatcagcagcgtggacctgagctgctgcagcctggagcacctgcccgccaacctgttctacagccaggacctgacccacctgaacctgaagcagaacttcctgagacagaaccccagcctgcccgccgccagaggcctgaacgagctgcagagattcaccaagctgaagagcctgaacctgagcaacaaccacctgggcgacttccccctggccgtgtgcagcatccccaccctggccgagctgaacgtgagctgcaacgccctgagaagcgtgcccgccgccgtgggcgtgatgcacaacctgcagaccttcctgctggacggcaacttcctgcagagcctgcccgccgagctggagaacatgaagcagctgagctacctgggcctgagcttcaacgagttcaccgacatccccgaggtgctggagaagctgaccgccgtggacaagctgtgcatgagcggcaactgcgtggagaccctgagactgcaggccctgagaaagatgccccacatcaagcacgtggacctgagactgaacgtgatcagaaagctgatcgccgacgaggtggacttcctgcagcacgtgacccagctggacctgagagacaacaagctgggcgacctggacgccatgatcttcaacaacatcgaggtgctgcactgcgagagaaaccagctggtgaccctggacatctgcggctacttcctgaaggccctgtacgccagcagcaacgagctggtgcagctggacgtgtaccccgtgcccaactacctgagctacatggacgtgagcagaaacagactggagaacgtgcccgagtgggtgtgcgagagcagaaagctggaggtgctggacatcggccacaaccagatctgcgagctgcccgccagactgttctgcaacagcagcctgagaaagctgctggccggccacaaccagctggccagactgcccgagagactggagagaaccagcgtggaggtgctggacgtgcagcacaaccagctgctggagctgccccccaacctgctgatgaaggccgacagcctgagattcctgaacgccagcgccaacaagctggagagcctgccccccgccaccctgagcgaggagaccaacagcatcctgcaggagctgtacctgaccaacaacagcctgaccgacaagtgcgtgcccctgctgaccggccacccccacctgaagatcctgcacatggcctacaacagactgcagagcttccccgccagcaagatggccaagctggaggagctggaggagatcgacctgagcggcaacaagctgaaggccatccccaccaccatcatgaactgcagaagaatgcacaccgtgatcgcccacagcaactgcatcgaggtgttccccgaggtgatgcagctgcccgagatcaagtgcgtggacctgagctgcaacgagctgagcgaggtgaccctgcccgagaacctgccccccaagctgcaggagctggacctgaccggcaaccccagactggtgctggaccacaagaccctggagctgctgaacaacatcagatgcttcaagatcgaccagcccagcaccggcgacgccagcggcgcccccgccgtgtggagccacggctacaccgaggccagcggcgtgaagaacaagctgtgcgtggccgccctgagcgtgaacaacttctgcgacaacagagaggccctgtacggcgtgttcgacggcgacagaaacgtggaggtgccctacctgctgcagtgcaccatgagcgacatcctggccgaggagctgcagaagaccaagaacgaggaggagtacatggtgaacaccttcatcgtgatgcagagaaagctgggcaccgccggccagaagctgggcggcgccgccgtgctgtgccacatcaagcacgaccccgtggaccccggcggcagcttcaccctgaccagcgccaacgtgggcaagtgccagaccgtgctgtgcagaaacggcaagcccctgcccctgagcagaagctacatcatgagctgcgaggaggagctgaagagaatcaagcagcacaaggccatcatcaccgaggacggcaaggtgaacggcgtgaccgagagcaccagaatcctgggctacaccttcctgcaccccagcgtggtgcccagaccccacgtgcagagcgtgctgctgaccccccaggacgagttcttcatcctgggcagcaagggcctgtgggacagcctgagcgtggaggaggccgtggaggccgtgagaaacgtgcccgacgccctggccgccgccaagaagctgtgcaccctggcccagagctacggctgccacgacagcatcagcgccgtggtggtgcagctgagcgtgaccgaggacagcttctgctgctgcgagctgagcgccggcggcgccgtgcccccccccagccccggcatcttcccccccagcgtgaacatggtgatcaaggacagacccagcgacggcctgggcgtgcccagcagcagcagcggcatggccagcgagatcagcagcgagctgagcaccagcgagatgagcagcgaggtgggcagcaccgccagcgacgagcccccccccggcgccctgagcgagaacagccccgcctaccccagcgagcagagatgcatgctgcaccccatctgcctgagcaacagcttccagagacagctgagcagcgccaccttcagcagcgccttcagcgacaacggcctggacagcgacgacgaggagcccatcgagggcgtgttcaccaacggcagcagagtggaggtggaggtggacatccactgcagcagagccaaggagaaggagaagcagcagcacctgctgcaggtgcccgccgaggccagcgacgagggcatcgtgatcagcgccaacgaggacgagcccggcctgcccagaaaggccgacttcagcgccgtgggcaccatcggcagaagaagagccaacggcagcgtggccccccaggagagaagccacaacgtgatcgaggtggccaccgacgcccccctgagaaagcccggcggctacttcgccgcccccgcccagcccgaccccgacgaccagttcatcatcccccccgagctggaggaggaggtgaaggagatcatgaagcaccaccaggagcagcagcagcagcagcagccccccccccccccccagctgcagccccagctgcccagacactaccagctggaccagctgcccgactactacgacacccccctgtag

SEQ ID NO: 12083 - DNA, 3618 bp, Artificial Sequence
  Description of Artificial Sequence: Synthetic coding sequence
atggacagcgagatcggctgcctgatcagattctacgccggcaagccccacagcaccggcagcagcgagagaatccagctgagcggcatgtacaacgtgagaaagggcaagatgcagctgcccgtgaacagatggaccagaagacaggtgatcctgtgcggcacctgcctgatcgtgagcagcgtgaaggacagcctgaccggcaagatgcacgtgctgcccctgatcggcggcaaggtggaggaggtgaagaagcaccagcactgcctggccttcagcagcagcggcccccagagccagacctactacatctgcttcgacaccttcaccgagtacctgagatggctgagacaggtgagcaaggtggccagccagagaatcagcagcgtggacctgagctgctgcagcctggagcacctgcccgccaacctgttctacagccaggacctgacccacctgaacctgaagcagaacttcctgagacagaaccccagcctgcccgccgccagaggcctgaacgagctgcagagattcaccaagctgaagagcctgaacctgagcaacaaccacctgggcgacttccccctggccgtgtgcagcatccccaccctggccgagctgaacgtgagctgcaacgccctgagaagcgtgcccgccgccgtgggcgtgatgcacaacctgcagaccttcctgctggacggcaacttcctgcagagcctgcccgccgagctggagaacatgaagcagctgagctacctgggcctgagcttcaacgagttcaccgacatccccgaggtgctggagaagctgaccgccgtggacaagctgtgcatgagcggcaactgcgtggagaccctgagactgcaggccctgagaaagatgccccacatcaagcacgtggacctgagactgaacgtgatcagaaagctgatcgccgacgaggtggacttcctgcagcacgtgacccagctggacctgagagacaacaagctgggcgacctggacgccatgatcttcaacaacatcgaggtgctgcactgcgagagaaaccagctggtgaccctggacatctgcggctacttcctgaaggccctgtacgccagcagcaacgagctggtgcagctggacgtgtaccccgtgcccaactacctgagctacatggacgtgagcagaaacagactggagaacgtgcccgagtgggtgtgcgagagcagaaagctggaggtgctggacatcggccacaaccagatctgcgagctgcccgccagactgttctgcaacagcagcctgagaaagctgctggccggccacaaccagctggccagactgcccgagagactggagagaaccagcgtggaggtgctggacgtgcagcacaaccagctgctggagctgccccccaacctgctgatgaaggccgacagcctgagattcctgaacgccagcgccaacaagctggagagcctgccccccgccaccctgagcgaggagaccaacagcatcctgcaggagctgtacctgaccaacaacagcctgaccgacaagtgcgtgcccctgctgaccggccacccccacctgaagatcctgcacatggcctacaacagactgcagagcttccccgccagcaagatggccaagctggaggagctggaggagatcgacctgagcggcaacaagctgaaggccatccccaccaccatcatgaactgcagaagaatgcacaccgtgatcgcccacagcaactgcatcgaggtgttccccgaggtgatgcagctgcccgagatcaagtgcgtggacctgagctgcaacgagctgagcgaggtgaccctgcccgagaacctgccccccaagctgcaggagctggacctgaccggcaaccccagactggtgctggaccacaagaccctggagctgctgaacaacatcagatgcttcaagatcgaccagcccagcaccggcgacgccagcggcgcccccgccgtgtggagccacggctacaccgaggccagcggcgtgaagaacaagctgtgcgtggccgccctgagcgtgaacaacttctgcgacaacagagaggccctgtacggcgtgttcgacggcgacagaaacgtggaggtgccctacctgctgcagtgcaccatgagcgacatcctggccgaggagctgcagaagaccaagaacgaggaggagtacatggtgaacaccttcatcgtgatgcagagaaagctgggcaccgccggccagaagctgggcggcgccgccgtgctgtgccacatcaagcacgaccccgtggaccccggcggcagcttcaccctgaccagcgccaacgtgggcaagtgccagaccgtgctgtgcagaaacggcaagcccctgcccctgagcagaagctacatcatgagctgcgaggaggagctgaagagaatcaagcagcacaaggccatcatcaccgaggacggcaaggtgaacggcgtgaccgagagcaccagaatcctgggctacaccttcctgcaccccagcgtggtgcccagaccccacgtgcagagcgtgctgctgaccccccaggacgagttcttcatcctgggcagcaagggcctgtgggacagcctgagcgtggaggaggccgtggaggccgtgagaaacgtgcccgacgccctggccgccgccaagaagctgtgcaccctggcccagagctacggctgccacgacagcatcagcgccgtggtggtgcagctgagcgtgaccgaggacagcttctgctgctgcgagctgagcgccggcggcgccgtgcccccccccagccccggcatcttcccccccagcgtgaacatggtgatcaaggacagacccagcgacggcctgggcgtgcccagcagcagcagcggcatggccagcgagatcagcagcgagctgagcaccagcgagatgagcagcgaggtgggcagcaccgccagcgacgagcccccccccggcgccctgagcgagaacagccccgcctaccccagcgagcagagatgcatgctgcaccccatctgcctgagcaacagcttccagagacagctgagcagcgccaccttcagcagcgccttcagcgacaacggcctggacagcgacgacgaggagcccatcgagggcgtgttcaccaacggcagcagagtggaggtggaggtggacatccactgcagcagagccaaggagaaggagaagcagcagcacctgctgcaggtgcccgccgaggccagcgacgagggcatcgtgatcagcgccaacgaggacgagcccggcctgcccagaaaggccgacttcagcgccgtgggcaccatcggcagaagaagagccaacggcagcgtggccccccaggagagaagccacaacgtgatcgaggtggccaccgacgcccccctgagaaagcccggcggctacttcgccgcccccgcccagcccgaccccgacgaccagttcatcatcccccccgagctggaggaggaggtgaaggagatcatgaagcaccaccaggagcagcagcagcagcagcagccccccccccccccccagctgcagccccagctgcccagacactaccagctggaccagctgcccgactactacgacacccccctgtag

SEQ ID NO: 12084 - DNA, 2379 bp, Artificial Sequence
  Description of Artificial Sequence: Synthetic coding sequence
atgcacatcctgcccctggtgggcggcaagatcgaggaggtgaagagaagacagtacagcctggccttcagcagcgccggcgcccaggcccagacctaccacgtgagcttcgagaccctggccgagtaccagagatggcagagacaggccagcaaggtggtgagccagagaatcagcaccgtggacctgagctgctacagcctggaggaggtgcccgagcacctgttctacagccaggacatcacctacctgaacctgagacacaacttcatgcagctggagagacccggcggcctggacaccctgtacaagttcagccagctgaagggcctgaacctgagccacaacaagctgggcctgttccccatcctgctgtgcgagatcagcaccctgaccgagctgaacctgagctgcaacggcttccacgacctgcccagccagatcggcaacctgctgaacctgcagaccctgtgcctggacggcaacttcctgaccaccctgcccgaggagctgggcaacctgcagcagctgagcagcctgggcatcagcttcaacaacttcagccagatccccgaggtgtacgagaagctgaccatgctggacagagtggtgatggccggcaactgcctggaggtgctgaacctgggcgtgctgaacagaatgaaccacatcaagcacgtggacctgagaatgaaccacctgaagaccatggtgatcgagaacctggagggcaacaagcacatcacccacgtggacctgagagacaacagactgaccgacctggacctgagcagcctgtgcagcctggagcagctgcactgcggcagaaaccagctgagagagctgaccctgagcggcttcagcctgagaaccctgtacgccagcagcaacagactgaccgccgtgaacgtgtaccccgtgcccagcctgctgaccttcctggacctgagcagaaacctgctggagtgcgtgcccgactgggcctgcgaggccaagaagatcgaggtgctggacgtgagctacaacctgctgaccgaggtgcccgtgagaatcctgagcagcctgagcctgagaaagctgatgctgggccacaaccacgtgcagaacctgcccaccctggtggagcacatccccctggaggtgctggacctgcagcacaacgccctgaccagactgcccgacaccctgttcagcaaggccctgaacctgagatacctgaacgccagcgccaacagcctggagagcctgcccagcgcctgcaccggcgaggagagcctgagcatgctgcagctgctgtacctgaccaacaacctgctgaccgaccagtgcatccccgtgctggtgggccacctgcacctgagaatcctgcacctggccaacaaccagctgcagaccttccccgccagcaagctgaacaagctggagcagctggaggagctgaacctgagcggcaacaagctgaagaccatccccaccaccatcgccaactgcaagagactgcacaccctggtggcccacagcaacaacatcagcatcttccccgagatcctgcagctgccccagatccagttcgtggacctgagctgcaacgacctgaccgagatcctgatccccgaggccctgcccgccaccctgcaggacctggacctgaccggcaacaccaacctggtgctggagcacaagaccctggacatcttcagccacatcaccaccctgaagatcgaccagaagcccctgcccaccaccgacagcaccgtgaccagcaccttctggagccacggcctggccgagatggccggccagagaaacaagctgtgcgtgagcgccctggccatggacagcttcgccgagggcgtgggcgccgtgtacggcatgttcgacggcgacagaaacgaggagctgcccagactgctgcagtgcaccatggccgacgtgctgctggaggaggtgcagcagagcaccaacgacaccgtgttcatggccaacaccttcctggtgagccacagaaagctgggcatggccggccagaagctgggcagcagcgccctgctgtgctacatcagacccgacaccgccgaccccgccagcagcttcagcctgaccgtggccaacgtgggcacctgccaggccgtgctgtgcagaggcggcaagcccgtgcccctgagcaaggtgttcagcctggagcaggaccccgaggaggcccagagagtgaaggaccagaaggccatcatcaccgaggtgcccgaggacctgaaggagttccagaccaccgacatccccgtgcaccactgcaacttcagagccgtgctgggctgcctgtgcagcgccagcgtgctgggcagctacgccggccccgcccccagatggagaagaacctag

SEQ ID NO: 12085 - DNA, 3972 bp, Artificial Sequence
  Description of Artificial Sequence: Synthetic coding sequence
atgaagagaaacggcagcagaaactgcctgaacagaagaagcagattcggcagcagagagagagactggctgagagaggacgtgaagagaggctgcgtgtacctgtacggcgccgacaccaccaccgccaccaccaccaccaccaccagcagcagcagcagcagcagcagcagcagcagcgacctgcacctggtgctgtgcaccgtggagacccccgccagcgagatctgcgccggcgagggcagagagagcctgtacctgcagctgcacggcgacctggtgagaagactggagcccaccgagagacccctgcagatcgtgtacgactacctgagcagactgggcttcgacgaccccgtgagaatccaggaggaggccaccaaccccgacctgggctgcatgatcagattctacggcgagaagccctgccacatggacagactggacagaatcctgctgagcggcatctacaacgtgagaaagggcaagacccagctgcacaagtgggccgagagactggtggtgctgtgcggcacctgcctgatcgtgagcagcgtgaaggactgccagaccggcaagatgcacatcctgcccctggtgggcggcaagatcgaggaggtgaagagaagacagtacagcctggccttcagcagcgccggcgcccaggcccagacctaccacgtgagcttcgagaccctggccgagtaccagagatggcagagacaggccagcaaggtggtgagccagagaatcagcaccgtggacctgagctgctacagcctggaggaggtgcccgagcacctgttctacagccaggacatcacctacctgaacctgagacacaacttcatgcagctggagagacccggcggcctggacaccctgtacaagttcagccagctgaagggcctgaacctgagccacaacaagctgggcctgttccccatcctgctgtgcgagatcagcaccctgaccgagctgaacctgagctgcaacggcttccacgacctgcccagccagatcggcaacctgctgaacctgcagaccctgtgcctggacggcaacttcctgaccaccctgcccgaggagctgggcaacctgcagcagctgagcagcctgggcatcagcttcaacaacttcagccagatccccgaggtgtacgagaagctgaccatgctggacagagtggtgatggccggcaactgcctggaggtgctgaacctgggcgtgctgaacagaatgaaccacatcaagcacgtggacctgagaatgaaccacctgaagaccatggtgatcgagaacctggagggcaacaagcacatcacccacgtggacctgagagacaacagactgaccgacctggacctgagcagcctgtgcagcctggagcagctgcactgcggcagaaaccagctgagagagctgaccctgagcggcttcagcctgagaaccctgtacgccagcagcaacagactgaccgccgtgaacgtgtaccccgtgcccagcctgctgaccttcctggacctgagcagaaacctgctggagtgcgtgcccgactgggcctgcgaggccaagaagatcgaggtgctggacgtgagctacaacctgctgaccgaggtgcccgtgagaatcctgagcagcctgagcctgagaaagctgatgctgggccacaaccacgtgcagaacctgcccaccctggtggagcacatccccctggaggtgctggacctgcagcacaacgccctgaccagactgcccgacaccctgttcagcaaggccctgaacctgagatacctgaacgccagcgccaacagcctggagagcctgcccagcgcctgcaccggcgaggagagcctgagcatgctgcagctgctgtacctgaccaacaacctgctgaccgaccagtgcatccccgtgctggtgggccacctgcacctgagaatcctgcacctggccaacaaccagctgcagaccttccccgccagcaagctgaacaagctggagcagctggaggagctgaacctgagcggcaacaagctgaagaccatccccaccaccatcgccaactgcaagagactgcacaccctggtggcccacagcaacaacatcagcatcttccccgagatcctgcagctgccccagatccagttcgtggacctgagctgcaacgacctgaccgagatcctgatccccgaggccctgcccgccaccctgcaggacctggacctgaccggcaacaccaacctggtgctggagcacaagaccctggacatcttcagccacatcaccaccctgaagatcgaccagaagcccctgcccaccaccgacagcaccgtgaccagcaccttctggagccacggcctggccgagatggccggccagagaaacaagctgtgcgtgagcgccctggccatggacagcttcgccgagggcgtgggcgccgtgtacggcatgttcgacggcgacagaaacgaggagctgcccagactgctgcagtgcaccatggccgacgtgctgctggaggaggtgcagcagagcaccaacgacaccgtgttcatggccaacaccttcctggtgagccacagaaagctgggcatggccggccagaagctgggcagcagcgccctgctgtgctacatcagacccgacaccgccgaccccgccagcagcttcagcctgaccgtggccaacgtgggcacctgccaggccgtgctgtgcagaggcggcaagcccgtgcccctgagcaaggtgttcagcctggagcaggaccccgaggaggcccagagagtgaaggaccagaaggccatcatcaccgaggacaacaaggtgaacggcgtgacctgctgcaccagaatgctgggctgcacctacctgtacccctggatcctgcccaagccccacatcagcagcacccccctgaccatccaggacgagctgctgatcctgggcaacaaggccctgtgggagcacctgagctacaccgaggccgtgaacgccgtgagacacgtgcaggaccccctggccgccgccaagaagctgtgcaccctggcccagagctacggctgccaggacaacgtgggcgccatggtggtgtacctgaacatcggcgaggagggctgcacctgcgagatgaacggcctgaccctgcccggccccgtgggcttcgccagcaccaccaccatcaaggacgcccccaagcccgccacccccagcagcagcagcggcatcgccagcgagttcagcagcgagatgagcaccagcgaggtgagcagcgaggtgggcagcaccgccagcgacgagcacaacgccggcggcctggacaccgccctgctgcccagacccgagagaagatgcagcctgcaccccacccccaccagcggcctgttccagagacagcccagcagcgccaccttcagcagcaaccagagcgacaacggcctggacagcgacgacgaccagcccgtggagggcgtgatcaccaacggcagcaaggtggaggtggaggtggacatccactgctgcagaggcagagacctggagaacagcccccccctgatcgagagcagccccaccctgtgcagcgaggagcacgccagaggcagctgcttcggcatcagaagacagaacagcgtgaacagcggcatgctgctgcccatgagcaaggacagaatggagctgcagaagagccccagcaccagctgcctgtacggcaagaagctgagcaacggcagcatcgtgcccctggaggacagcctgaacctgatcgaggtggccaccgaggtgcccaagagaaagaccggctacttcgccgcccccacccagatggagcccgaggaccagttcgtggtgccccacgacctggaggaggaggtgaaggagcagatgaagcagcaccaggacagcagactggagcccgagccccacgaggaggacagaaccgagccccccgaggagttcgacaccgccctgtag

SEQ ID NO: 12086 - DNA, 2871 bp, Artificial Sequence
  Description of Artificial Sequence: Synthetic coding sequence
atgaagagaaacggcagcagaaactgcctgaacagaagaagcagattcggcagcagagagagagactggctgagagaggacgtgaagagaggctgcgtgtacctgtacggcgccgacaccaccaccgccaccaccaccaccaccaccagcagcagcagcagcagcagcagcagcagcagcgacctgcacctggtgctgtgcaccgtggagacccccgccagcgagatctgcgccggcgagggcagagagagcctgtacctgcagctgcacggcgacctggtgagaagactggagcccaccgagagacccctgcagatcgtgtacgactacctgagcagactgggcttcgacgaccccgtgagaatccaggaggaggccaccaaccccgacctgggctgcatgatcagattctacggcgagaagccctgccacatggacagactggacagaatcctgctgagcggcatctacaacgtgagaaagggcaagacccagctgcacaagtgggccgagagactggtggtgctgtgcggcacctgcctgatcgtgagcagcgtgaaggactgccagaccggcaagatgcacatcctgcccctggtgggcggcaagatcgaggaggtgaagagaagacagtacagcctggccttcagcagcgccggcgcccaggcccagacctaccacgtgagcttcgagaccctggccgagtaccagagatggcagagacaggccagcaaggtggtgagccagagaatcagcaccgtggacctgagctgctacagcctggaggaggtgcccgagcacctgttctacagccaggacatcacctacctgaacctgagacacaacttcatgcagctggagagacccggcggcctggacaccctgtacaagttcagccagctgaagggcctgaacctgagccacaacaagctgggcctgttccccatcctgctgtgcgagatcagcaccctgaccgagctgaacctgagctgcaacggcttccacgacctgcccagccagatcggcaacctgctgaacctgcagaccctgtgcctggacggcaacttcctgaccaccctgcccgaggagctgggcaacctgcagcagctgagcagcctgggcatcagcttcaacaacttcagccagatccccgaggtgtacgagaagctgaccatgctggacagagtggtgatggccggcaactgcctggaggtgctgaacctgggcgtgctgaacagaatgaaccacatcaagcacgtggacctgagaatgaaccacctgaagaccatggtgatcgagaacctggagggcaacaagcacatcacccacgtggacctgagagacaacagactgaccgacctggacctgagcagcctgtgcagcctggagcagctgcactgcggcagaaaccagctgagagagctgaccctgagcggcttcagcctgagaaccctgtacgccagcagcaacagactgaccgccgtgaacgtgtaccccgtgcccagcctgctgaccttcctggacctgagcagaaacctgctggagtgcgtgcccgactgggcctgcgaggccaagaagatcgaggtgctggacgtgagctacaacctgctgaccgaggtgcccgtgagaatcctgagcagcctgagcctgagaaagctgatgctgggccacaaccacgtgcagaacctgcccaccctggtggagcacatccccctggaggtgctggacctgcagcacaacgccctgaccagactgcccgacaccctgttcagcaaggccctgaacctgagatacctgaacgccagcgccaacagcctggagagcctgcccagcgcctgcaccggcgaggagagcctgagcatgctgcagctgctgtacctgaccaacaacctgctgaccgaccagtgcatccccgtgctggtgggccacctgcacctgagaatcctgcacctggccaacaaccagctgcagaccttccccgccagcaagctgaacaagctggagcagctggaggagctgaacctgagcggcaacaagctgaagaccatccccaccaccatcgccaactgcaagagactgcacaccctggtggcccacagcaacaacatcagcatcttccccgagatcctgcagctgccccagatccagttcgtggacctgagctgcaacgacctgaccgagatcctgatccccgaggccctgcccgccaccctgcaggacctggacctgaccggcaacaccaacctggtgctggagcacaagaccctggacatcttcagccacatcaccaccctgaagatcgaccagaagcccctgcccaccaccgacagcaccgtgaccagcaccttctggagccacggcctggccgagatggccggccagagaaacaagctgtgcgtgagcgccctggccatggacagcttcgccgagggcgtgggcgccgtgtacggcatgttcgacggcgacagaaacgaggagctgcccagactgctgcagtgcaccatggccgacgtgctgctggaggaggtgcagcagagcaccaacgacaccgtgttcatggccaacaccttcctggtgagccacagaaagctgggcatggccggccagaagctgggcagcagcgccctgctgtgctacatcagacccgacaccgccgaccccgccagcagcttcagcctgaccgtggccaacgtgggcacctgccaggccgtgctgtgcagaggcggcaagcccgtgcccctgagcaaggtgttcagcctggagcaggaccccgaggaggcccagagagtgaaggaccagaaggccatcatcaccgagaactgggtgctgaaccagaagcacctgcaggacttccccggcgaggacaagtag

SEQ ID NO: 12087 - DNA, 3771 bp, Artificial Sequence
  Description of Artificial Sequence: Synthetic coding sequence
atgaagagaaacggcagcagaaactgcctgaacagaagaagcagattcggcagcagagagagagactggctgagagaggacgtgaagagaggctgcgtgtacctgtacggcgccgacaccaccaccgccaccaccaccaccaccaccagcagcagcagcagcagcagcagcagcagcagcgacctgcacctggtgctgtgcaccgtggagacccccgccagcgagatctgcgccggcgagggcagagagagcctgtacctgcagctgcacggcgacctggtgagaagactggagcccaccgagagacccctgcagatcgtgtacgactacctgagcagactgggcttcgacgaccccgtgagaatccaggaggaggccaccaaccccgacctgggctgcatgatcagattctacggcgagaagccctgccacatggacagactggacagaatcctgctgagcggcatctacaacgtgagaaagggcaagacccagctgcacaagtgggccgagagactggtggtgctgtgcggcacctgcctgatcgtgagcagcgtgaaggactgccagaccggcaagatgcacatcctgcccctggtgggcggcaagatcgaggaggtgaagagaagacagtacagcctggccttcagcagcgccggcgcccaggcccagacctaccacgtgagcttcgagaccctggccgagtaccagagatggcagagacaggccagcaaggtggtgagccagagaatcagcaccgtggacctgagctgctacagcctggaggaggtgcccgagcacctgttctacagccaggacatcacctacctgaacctgagacacaacttcatgcagctggagagacccggcggcctggacaccctgtacaagttcagccagctgaagggcctgaacctgagccacaacaagctgggcctgttccccatcctgctgtgcgagatcagcaccctgaccgagctgaacctgagctgcaacggcttccacgacctgcccagccagatcggcaacctgctgaacctgcagaccctgtgcctggacggcaacttcctgaccaccctgcccgaggagctgggcaacctgcagcagctgagcagcctgggcatcagcttcaacaacttcagccagatccccgaggtgtacgagaagctgaccatgctggacagagtggtgatggccggcaactgcctggaggtgctgaacctgggcgtgctgaacagaatgaaccacatcaagcacgtggacctgagaatgaaccacctgaagaccatggtgatcgagaacctggagggcaacaagcacatcacccacgtggacctgagagacaacagactgaccgacctggacctgagcagcctgtgcagcctggagcagctgcactgcggcagaaaccagctgagagagctgaccctgagcggcttcagcctgagaaccctgtacgccagcagcaacagactgaccgccgtgaacgtgtaccccgtgcccagcctgctgaccttcctggacctgagcagaaacctgctggagtgcgtgcccgactgggcctgcgaggccaagaagatcgaggtgctggacgtgagctacaacctgctgaccgaggtgcccgtgagaatcctgagcagcctgagcctgagaaagctgatgctgggccacaaccacgtgcagaacctgcccaccctggtggagcacatccccctggaggtgctggacctgcagcacaacgccctgaccagactgcccgacaccctgttcagcaaggccctgaacaagctgaacaagctggagcagctggaggagctgaacctgagcggcaacaagctgaagaccatccccaccaccatcgccaactgcaagagactgcacaccctggtggcccacagcaacaacatcagcatcttccccgagatcctgcagctgccccagatccagttcgtggacctgagctgcaacgacctgaccgagatcctgatccccgaggccctgcccgccaccctgcaggacctggacctgaccggcaacaccaacctggtgctggagcacaagaccctggacatcttcagccacatcaccaccctgaagatcgaccagaagcccctgcccaccaccgacagcaccgtgaccagcaccttctggagccacggcctggccgagatggccggccagagaaacaagctgtgcgtgagcgccctggccatggacagcttcgccgagggcgtgggcgccgtgtacggcatgttcgacggcgacagaaacgaggagctgcccagactgctgcagtgcaccatggccgacgtgctgctggaggaggtgcagcagagcaccaacgacaccgtgttcatggccaacaccttcctggtgagccacagaaagctgggcatggccggccagaagctgggcagcagcgccctgctgtgctacatcagacccgacaccgccgaccccgccagcagcttcagcctgaccgtggccaacgtgggcacctgccaggccgtgctgtgcagaggcggcaagcccgtgcccctgagcaaggtgttcagcctggagcaggaccccgaggaggcccagagagtgaaggaccagaaggccatcatcaccgaggacaacaaggtgaacggcgtgacctgctgcaccagaatgctgggctgcacctacctgtacccctggatcctgcccaagccccacatcagcagcacccccctgaccatccaggacgagctgctgatcctgggcaacaaggccctgtgggagcacctgagctacaccgaggccgtgaacgccgtgagacacgtgcaggaccccctggccgccgccaagaagctgtgcaccctggcccagagctacggctgccaggacaacgtgggcgccatggtggtgtacctgaacatcggcgaggagggctgcacctgcgagatgaacggcctgaccctgcccggccccgtgggcttcgccagcaccaccaccatcaaggacgcccccaagcccgccacccccagcagcagcagcggcatcgccagcgagttcagcagcgagatgagcaccagcgaggtgagcagcgaggtgggcagcaccgccagcgacgagcacaacgccggcggcctggacaccgccctgctgcccagacccgagagaagatgcagcctgcaccccacccccaccagcggcctgttccagagacagcccagcagcgccaccttcagcagcaaccagagcgacaacggcctggacagcgacgacgaccagcccgtggagggcgtgatcaccaacggcagcaaggtggaggtggaggtggacatccactgctgcagaggcagagacctggagaacagcccccccctgatcgagagcagccccaccctgtgcagcgaggagcacgccagaggcagctgcttcggcatcagaagacagaacagcgtgaacagcggcatgctgctgcccatgagcaaggacagaatggagctgcagaagagccccagcaccagctgcctgtacggcaagaagctgagcaacggcagcatcgtgcccctggaggacagcctgaacctgatcgaggtggccaccgaggtgcccaagagaaagaccggctacttcgccgcccccacccagatggagcccgaggaccagttcgtggtgccccacgacctggaggaggaggtgaaggagcagatgaagcagcaccaggacagcagactggagcccgagccccacgaggaggacagaaccgagccccccgaggagttcgacaccgccctgtag

SEQ ID NO: 12088 - DNA, 1272 bp, Artificial Sequence
  Description of Artificial Sequence: Synthetic coding sequence
atgaagagaaacggcagcagaaactgcctgaacagaagaagcagattcggcagcagagagagagactggctgagagaggacgtgaagagaggctgcgtgtacctgtacggcgccgacaccaccaccgccaccaccaccaccaccaccagcagcagcagcagcagcagcagcagcagcagcgacctgcacctggtgctgtgcaccgtggagacccccgccagcgagatctgcgccggcgagggcagagagagcctgtacctgcagctgcacggcgacctggtgagaagactggagcccaccgagagacccctgcagatcgtgtacgactacctgagcagactgggcttcgacgaccccgtgagaatccaggaggaggccaccaaccccgacctgggctgcatgatcagattctacggcgagaagccctgccacatggacagactggacagaatcctgctgagcggcatctacaacgtgagaaagggcaagacccagctgcacaagtgggccgagagactggtggtgctgtgcggcacctgcctgatcgtgagcagcgtgaaggactgccagaccggcaagatgcacatcctgcccctggtgggcggcaagatcgaggaggtgaagagaagacagtacagcctggccttcagcagcgccggcgcccaggcccagacctaccacgtgagcttcgagaccctggccgagtaccagagatggcagagacaggccagcaaggtggtgagccagagaatcagcaccgtggacctgagctgctacagcctggaggaggtgcccgagcacctgttctacagccaggacatcacctacctgaacctgagacacaacttcatgcagctggagagacccggcggcctggacaccctgtacaagttcagccagctgaagggcctgaacctgagccacaacaagctgggcctgttccccatcctgctgtgcgagatcagcaccctgaccgagctgaacctgagctgcaacggcttccacgacctgcccagccagatcggcaacctgctgaacctgcagaccctgtgcctggacggcaacttcctgaccaccctgcccgaggagctgggcaacctgcagcagctgagcagcctgggcatcagcttcaacaacttcagccagatccccgaggtgtacgagaagctgaccatgctggacagagtggtgatggccggcaactgcctggaggtgctgaacctgggcgtgctgaacagaatgaaccacatcaagcacgtggacctgagatag

SEQ ID NO: 12089 - DNA, 501 bp, Artificial Sequence
  Description of Artificial Sequence: Synthetic coding sequence
atggccggccagagaaacaagctgtgcgtgagcgccctggccatggacagcttcgccgagggcgtgggcgccgtgtacggcatgttcgacggcgacagaaacgaggagctgcccagactgctgcagtgcaccatggccgacgtgctgctggaggaggtgcagcagagcaccaacgacaccgtgttcatggccaacaccttcctggtgagccacagaaagctgggcatggccggccagaagctgggcagcagcgccctgctgtgctacatcagacccgacaccgccgaccccgccagcagcttcagcctgaccgtggccaacgtgggcacctgccaggccgtgctgtgcagaggcggcaagcccgtgcccctgagcaaggtgttcagcctggagcaggaccccgaggaggcccagagagtgaaggaccagaaggccatcatcaccgagaactgggtgctgaaccagaagcacctgcaggacttccccggcgaggacaagtag

SEQ ID NO: 12090 - DNA, 3972 bp, Artificial Sequence; identical to SEQ ID NO: 12085
  Description of Artificial Sequence: Synthetic coding sequence

SEQ ID NO: 12091 - DNA, 1212 bp, Artificial Sequence
  Description of Artificial Sequence: Synthetic coding sequence
atgaccgccatcatcaaggagatcgtgagcagaaacaagagaagataccaggaggacggcttcgacctggacctgacctacatctaccccaacatcatcgccatgggcttccccgccgagagactggagggcgtgtacagaaacaacatcgacgacgtggtgagattcctggacagcaagcacaagaaccactacaagatctacaacctgtgcgccgagagacactacgacaccgccaagttcaactgcagagtggcccagtaccccttcgaggaccacaaccccccccagctggagctgatcaagcccttctgcgaggacctggaccagtggctgagcgaggacgacaaccacgtggccgccatccactgcaaggccggcaagggcagaaccggcgtgatgatctgcgcctacctgctgcacagaggcaagttcctgaaggcccaggaggccctggacttctacggcgaggtgagaaccagagacaagaagggcgtgaccatccccagccagagaagatacgtgtactactacagctacctgctgaagaaccacctggactacagacccgtggccctgctgttccacaagatgatgttcgagaccatccccatgttcagcggcggcacctgcaacccccagttcgtggtgtgccagctgaaggtgaagatctacagcagcaacagcggccccaccagaagagaggacaagttcatgtacttcgagttcccccagcccctgcccgtgtgcggcgacatcaaggtggagttcttccacaagcagaacaagatgctgaagaaggacaagatgttccacttctgggtgaacaccttcttcatccccggccccgaggagaccagcgagaaggtggagaacggcagcctgtgcgaccaggagatcgacagcatctgcagcatcgagagagccgacaacgacaaggagtacctggtgctgaccctgaccaagaacgacctggacaaggccaacaaggacaaggccaacagatacttcagccccaacttcaaggtgaagctgtacttcaccaagaccgtggaggagcccagcaaccccgaggccagcagcagcaccagcgtgacccccgacgtgagcgacaacgagcccgaccactacagatacagcgacaccaccgacagcgaccccgagaacgagcccttcgacgaggaccagcacacccagatcaccaaggtgtag

SEQ ID NO: 12092 - DNA, 531 bp, Artificial Sequence
  Description of Artificial Sequence: Synthetic coding sequence
atgggcaaggccgccgccgccgtggccttcggcgccgaggtgggcgtgagactggccctgttcgccgccttcctggtgaccgagctgctgccccccttccagagactgatccagcccgaggagatgtggctgtacagaaacccctacgtggaggccgagtacttccccaccaagcccatgttcgtgatcgccttcctgagccccctgagcctgatcttcctggccaagttcctgaagaaggccgacaccagagacagcagacaggcctgcctggccgccagcctggccctggccctgaacggcgtgttcaccaacaccatcaagctgatcgtgggcagacccagacccgacttcttctacagatgcttccccgacggcctggcccacagcgacctgatgtgcaccggcgacaaggacgtggtgaacgagggcagaaagagcttccccagcggccacagcagctgcatgaacatcatctggaccctgccctacgcctgcttccacatcatcgagttcaacctggagagctag

SEQ ID NO: 12093 - DNA, 651 bp, Artificial Sequence
  Description of Artificial Sequence: Synthetic coding sequence
atgggcaaggccgccgccgccgtggccttcggcgccgaggtgggcgtgagactggccctgttcgccgccttcctggtgaccgagctgctgccccccttccagagactgatccagcccgaggagatgtggctgtacagaaacccctacgtggaggccgagtacttccccaccaagcccatgttcgtgatcgccttcctgagccccctgagcctgatcttcctggccaagttcctgaagaaggccgacaccagagacagcagacaggcctgcctggccgccagcctggccctggccctgaacggcgtgttcaccaacaccatcaagctgatcgtgggcagacccagacccgacttcttctacagatgcttccccgacggcctggcccacagcgacctgatgtgcaccggcgacaaggacgtggtgaacgagggcagaaagagcttccccagcggccacagcagcttcgccttcgccggcctggccttcgccagcttctacctggccggcaagctgcactgcttcaccccccagggcagaggcaagagctggagattctgcgccttcctgagccccctgctgttcgccgccgtgatcgccctgagcagaacctgcgactacaagcaccactggcagggccccttcaagtggtag

SEQ ID NO: 12094 - DNA, 795 bp, Artificial Sequence
  Description of Artificial Sequence: Synthetic coding sequence
atgggcaaggccgccgccgccgtggccttcggcgccgaggtgggcgtgagactggccctgttcgccgccttcctggtgaccgagctgctgccccccttccagagactgatccagcccgaggagatgtggctgtacagaaacccctacgtggaggccgagtacttccccaccaagcccatgttcgtgatcgccttcctgagccccctgagcctgatcttcctggccaagttcctgaagaaggccgacaccagagacagcagacaggcctgcctggccgccagcctggccctggccctgaacggcgtgttcaccaacaccatcaagctgatcgtgggcagacccagacccgacttcttctacagatgcttccccgacggcctggcccacagcgacctgatgtgcaccggcgacaaggacgtggtgaacgagggcagaaagagcttccccagcggccacagcagcttcgccttcgccggcctggccttcgccagcttctacctggccggcaagctgcactgcttcaccccccagggcagaggcaagagctggagattctgcgccttcctgagccccctgctgttcgccgccgtgatcgccctgagcagaacctgcgactacaagcaccactggcaggacgtgctggtgggcagcatgatcggcatgaccttcgcctacgtgtgctacagacagtactacccccccctgaccgacgccgagtgccacaagcccttccaggacaagctggtgctgagcaccgcccagaagcccggcgacagctactgcttcgacatctag

SEQ ID NO: 12095 - DNA, 1086 bp, Artificial Sequence
  Description of Artificial Sequence: Synthetic coding sequence
atgcacggcgactacaccctgaccctgagaaagggcggcaacaacaagctgatcaagatcttccacagagacggcaagtacggcttcagcgaccccctgaccttcagcagcgtggtggagctgatcaaccactacagaaacgagagcctggcccagtacaaccccaagctggacgtgaagctgctgtaccccgtgagcaagtaccagcaggaccaggtggtgaaggaggacaacatcgaggccgtgggcaagaagctgcacgagtacaacacccagttccaggagaagagcagagagtacgacagactgtacgaggagtacaccagaaccagccaggagatccagatgaagagaaccgccatcgaggccttcaacgagaccatcaagatcttcgaggagcagtgccagacccaggagagatacagcaaggagtacatcgagaagttcaagagagagggcaacgagaaggagatccagagaatcatgcacaactacgacaagctgaagagcagaatcagcgagatcatcgacagcagaagaagactggaggaggacctgaagaagcaggccgccgagtacagagagatcgacaagagaatgaacagcatcaagcccgacctgatccagctgagaaagaccagagaccagtacctgatgtggctgacccagaagggcgtgagacagaagaagctgaacgagtggctgggcaacgagaacaccgaggaccagtacagcctggtggaggacgacgaggacctgccccaccacgacgagaagacctggaacgtgggcagcagcaacagaaacaaggccgagaacctgctgagaggcaagagagacggcaccttcctggtgagagagagcagcaagcagggctgctacgcctgcagcgtggtggtggacggcgaggtgaagcactgcgtgatcaacaagaccgccaccggctacggcttcgccgagccctacaacctgtacagcagcctgaaggagctggtgctgcactaccagcacaccagcctggtgcagcacaacgacagcctgaacgtgaccctggcctaccccgtgtacgcccagcagagaagatag

SEQ ID NO: 12096 - DNA, 3207 bp, Artificial Sequence
  Description of Artificial Sequence: Synthetic coding sequence
atgccccccagacccagcagcggcgagctgtggggcatccacctgatgccccccagaatcctggtggagtgcctgctgcccaacggcatgatcgtgaccctggagtgcctgagagaggccaccctgatcaccatcaagcacgagctgttcaaggaggccagaaagtaccccctgcaccagctgctgcaggacgagagcagctacatcttcgtgagcgtgacccaggaggccgagagagaggagttcttcgacgagaccagaagactgtgcgacctgagactgttccagcccttcctgaaggtgatcgagcccgtgggcaacagagaggagaagatcctgaacagagagatcggcttcgccatcggcatgcccgtgtgcgagttcgacatggtgaaggaccccgaggtgcaggacttcagaagaaacatcctgaacgtgtgcaaggaggccgtggacctgagagacctgaacagcccccacagcagagccatgtacgtgtacccccccaacgtggagagcagccccgagctgcccaagcacatctacaacaagctggacaagggccagatcatcgtggtgatctgggtgatcgtgagccccaacaacgacaagcagaagtacaccctgaagatcaaccacgactgcgtgcccgagcaggtgatcgccgaggccatcagaaagaagaccagaagcatgctgctgagcagcgagcagctgaagctgtgcgtgctggagtaccagggcaagtacatcctgaaggtgtgcggctgcgacgagtacttcctggagaagtaccccctgagccagtacaagtacatcagaagctgcatcatgctgggcagaatgcccaacctgatgctgatggccaaggagagcctgtacagccagctgcccatggactgcttcaccatgcccagctacagcagaagaatcagcaccgccaccccctacatgaacggcgagaccagcaccaagagcctgtgggtgatcaacagcgccctgagaatcaagatcctgtgcgccacctacgtgaacgtgaacatcagagacatcgacaagatctacgtgagaaccggcatctaccacggcggcgagcccctgtgcgacaacgtgaacacccagagagtgccctgcagcaaccccagatggaacgagtggctgaactacgacatctacatccccgacctgcccagagccgccagactgtgcctgagcatctgcagcgtgaagggcagaaagggcgccaaggaggagcactgccccctggcctggggcaacatcaacctgttcgactacaccgacaccctggtgagcggcaagatggccctgaacctgtggcccgtgccccacggcctggaggacctgctgaaccccatcggcgtgaccggcagcaaccccaacaaggagaccccctgcctggagctggagttcgactggttcagcagcgtggtgaagttccccgacatgagcgtgatcgaggagcacgccaactggagcgtgagcagagaggccggcttcagctacagccacgccggcctgagcaacagactggccagagacaacgagctgagagagaacgacaaggagcagctgaaggccatcagcaccagagaccccctgagcgagatcaccgagcaggagaaggacttcctgtggagccacagacactactgcgtgaccatccccgagatcctgcccaagctgctgctgagcgtgaagtggaacagcagagacgaggtggcccagatgtactgcctggtgaaggactggccccccatcaagcccgagcaggccatggagctgctggactgcaactaccccgaccccatggtgagaggcttcgccgtgagatgcctggagaagtacctgaccgacgacaagctgagccagtacctgatccagctggtgcaggtgctgaagtacgagcagtacctggacaacctgctggtgagattcctgctgaagaaggccctgaccaaccagagaatcggccacttcttcttctggcacctgaagagcgagatgcacaacaagaccgtgagccagagattcggcctgctgctggagagctactgcagagcctgcggcatgtacctgaagcacctgaacagacaggtggaggccatggagaagctgatcaacctgaccgacatcctgaagcaggagaagaaggacgagacccagaaggtgcagatgaagttcctggtggagcagatgagaagacccgacttcatggacgccctgcagggcttcctgagccccctgaaccccgcccaccagctgggcaacctgagactggaggagtgcagaatcatgagcagcgccaagagacccctgtggctgaactgggagaaccccgacatcatgagcgagctgctgttccagaacaacgagatcatcttcaagaacggcgacgacctgagacaggacatgctgaccctgcagatcatcagaatcatggagaacatctggcagaaccagggcctggacctgagaatgctgccctacggctgcctgagcatcggcgactgcgtgggcctgatcgaggtggtgagaaacagccacaccatcatgcagatccagtgcaagggcggcctgaagggcgccctgcagttcaacagccacaccctgcaccagtggctgaaggacaagaacaagggcgagatctacgacgccgccatcgacctgttcaccagaagctgcgccggctactgcgtggccaccttcatcctgggcatcggcgacagacacaacagcaacatcatggtgaaggacgacggccagctgttccacatcgacttcggccacttcctggaccacaagaagaagaagttcggctacaagagagagagagtgcccttcgtgctgacccaggacttcctgatcgtgatcagcaagggcgcccaggagtgcaccaagaccagagagttcgagagattccaggagatgtgctacaaggcctacctggccatcagacagcacgccaacctgttcatcaacctgttcagcatgatgctgggcagcggcatgcccgagctgcagagcttcgacgacatcgcctacatcagaaagaccctggccctggacaagaccgagcaggaggccctggagtacttcatgaagcagatgaacgacgcccaccacggcggctggaccaccaagatggactggatcttccacaccatcaagcagcacgccctgaactag

SEQ ID NO: 12097 - DNA, 357 bp, Artificial Sequence
  Description of Artificial Sequence: Synthetic coding sequence
atgccccccagacccagcagcggcgagctgtggggcatccacctgatgccccccagaatcctggtggagtgcctgctgcccaacggcatgatcgtgaccctggagtgcctgagagaggccaccctgatcaccatcaagcacgagctgttcaaggaggccagaaagtaccccctgcaccagctgctgcaggacgagagcagctacatcttcgtgagcgtgacccaggaggccgagagagaggagttcttcgacgagaccagaagactgtgcgacctgagactgttccagcccttcctgaaggtgatcgagcccgtgggcaacagagaggagaagatcctgaacagagagatcggctag

SEQ ID NO: 12098 - DNA, 66 bp, Artificial Sequence
  Description of Artificial Sequence: Synthetic coding sequence
atgccccccagacccagcagcggcgagctgtggggcatccacctgatgccccccagaatcctgtag

SEQ ID NO: 12099 - DNA, 3213 bp, Artificial Sequence
  Description of Artificial Sequence: Synthetic coding sequence
atgtgcttcagcttcatcatgccccccgccatggccgacatcctggacatctgggccgtggacagccagatcgccagcgacggcagcatccccgtggacttcctgctgcccaccggcatctacatccagctggaggtgcccagagaggccaccatcagctacatcaagcagatgctgtggaagcaggtgcacaactaccccatgttcaacctgctgatggacatcgacagctacatgttcgcctgcgtgaaccagaccgccgtgtacgaggagctggaggacgagaccagaagactgtgcgacgtgagacccttcctgcccgtgctgaagctggtgaccagaagctgcgaccccggcgagaagctggacagcaagatcggcgtgctgatcggcaagggcctgcacgagttcgacagcctgaaggaccccgaggtgaacgagttcagaagaaagatgagaaagttcagcgaggagaagatcctgagcctggtgggcctgagctggatggactggctgaagcagacctacccccccgagcacgagcccagcatccccgagaacctggaggacaagctgtacggcggcaagctgatcgtggccgtgcacttcgagaactgccaggacgtgttcagcttccaggtgagccccaacatgaaccccatcaaggtgaacgagctggccatccagaagagactgaccatccacggcaaggaggacgaggtgagcccctacgactacgtgctgcaggtgagcggcagagtggagtacgtgttcggcgaccaccccctgatccagttccagtacatcagaaactgcgtgatgaacagagccctgccccacttcatcctggtggagtgctgcaagatcaagaagatgtacgagcaggagatgatcgccatcgaggccgccatcaacagaaacagcagcaacctgcccctgcccctgccccccaagaagaccagaatcatcagccacgtgtgggagaacaacaaccccttccagatcgtgctggtgaagggcaacaagctgaacaccgaggagaccgtgaaggtgcacgtgagagccggcctgttccacggcaccgagctgctgtgcaagaccatcgtgagcagcgaggtgagcggcaagaacgaccacatctggaacgagcccctggagttcgacatcaacatctgcgacctgcccagaatggccagactgtgcttcgccgtgtacgccgtgctggacaaggtgaagaccaagaagagcaccaagaccatcaaccccagcaagtaccagaccatcagaaaggccggcaaggtgcactaccccgtggcctgggtgaacaccatggtgttcgacttcaagggccagctgagaaccggcgacatcatcctgcacagctggagcagcttccccgacgagctggaggagatgctgaaccccatgggcaccgtgcagaccaacccctacaccgagaacgccaccgccctgcacgtgaagttccccgagaacaagaagcagccctactactacccccccttcgacaagatcatcgagaaggccgccgagatcgccagcagcgacagcgccaacgtgagcagcagaggcggcaagaagttcctgcccgtgctgaaggagatcctggacagagaccccctgagccagctgtgcgagaacgagatggacctgatctggaccctgagacaggactgcagagagatcttcccccagagcctgcccaagctgctgctgagcatcaagtggaacaagctggaggacgtggcccagctgcaggccctgctgcagatctggcccaagctgccccccagagaggccctggagctgctggacttcaactaccccgaccagtacgtgagagagtacgccgtgggctgcctgagacagatgagcgacgaggagctgagccagtacctgctgcagctggtgcaggtgctgaagtacgagcccttcctggactgcgccctgagcagattcctgctggagagagccctgggcaacagaagaatcggccagttcctgttctggcacctgagaagcgaggtgcacatccccgccgtgagcgtgcagttcggcgtgatcctggaggcctactgcagaggcagcgtgggccacatgaaggtgctgagcaagcaggtggaggccctgaacaagctgaagaccctgaacagcctgatcaagctgaacgccgtgaagctgaacagagccaagggcaaggaggccatgcacacctgcctgaagcagagcgcctacagagaggccctgagcgacctgcagagccccctgaacccctgcgtgatcctgagcgagctgtacgtggagaagtgcaagtacatggacagcaagatgaagcccctgtggctggtgtacaacaacaaggtgttcggcgaggacagcgtgggcgtgatcttcaagaacggcgacgacctgagacaggacatgctgaccctgcagatgctgagactgatggacctgctgtggaaggaggccggcctggacctgagaatgctgccctacggctgcctggccaccggcgacagaagcggcctgatcgaggtggtgagcaccagcgagaccatcgccgacatccagctgaacagcagcaacgtggccgccgccgccgccttcaacaaggacgccctgctgaactggctgaaggagtacaacagcggcgacgacctggacagagccatcgaggagttcaccctgagctgcgccggctactgcgtggccagctacgtgctgggcatcggcgacagacacagcgacaacatcatggtgaagaagaccggccagctgttccacatcgacttcggccacatcctgggcaacttcaagagcaagttcggcatcaagagagagagagtgcccttcatcctgacctacgacttcatccacgtgatccagcagggcaagaccggcaacaccgagaagttcggcagattcagacagtgctgcgaggacgcctacctgatcctgagaagacacggcaacctgttcatcaccctgttcgccctgatgctgaccgccggcctgcccgagctgaccagcgtgaaggacatccagtacctgaaggacagcctggccctgggcaagagcgaggaggaggccctgaagcagttcaagcagaagttcgacgaggccctgagagagagctggaccaccaaggtgaactggatggcccacaccgtgagaaaggactacagaagctag

SEQ ID NO: 12100 - DNA, 303 bp, Artificial Sequence
  Description of Artificial Sequence: Synthetic coding sequence
atgtgcttcagcttcatcatgccccccgccatggccgacatcctggacatctgggccgtggacagccagatcgccagcgacggcagcatccccgtggacttcctgctgcccaccggcatctacatccagctggaggtgcccagagaggccaccatcagctacatcaagcagatgctgtggaagcaggtgcacaactaccccatgttcaacctgctgatggacatcgacagctacatgttcgcctgcgtgaaccagaccgccgtgtacgaggagctggaggacgagaccagaagactgtgctag

SEQ ID NO: 12101 - DNA, 171 bp, Artificial Sequence
  Description of Artificial Sequence: Synthetic coding sequence
atgtgcttcagcttcatcatgccccccgccatggccgacatcctggacatctgggccgtggacagccagatcgccagcgacggcagcatccccgtggacttcctgctgcccaccggcatctacatccagctggaggtgcccagagaggccaccatcagctacatcaagtag

SEQ ID NO: 12102 - DNA, 3213 bp, Artificial Sequence; identical to SEQ ID NO: 12099
  Description of Artificial Sequence: Synthetic coding sequence

SEQ ID NO: 12103 - DNA, 396 bp, Artificial Sequence
  Description of Artificial Sequence: Synthetic coding sequence
atgtgcttcagcttcatcatgccccccgccatggccgacatcctggacatctgggccgtggacagccagatcgccagcgacggcagcatccccgtggacttcctgctgcccaccggcatctacatccagctggaggtgcccagagaggccaccatcagctacatcaagcagatgctgtggaagcaggtgcacaactaccccatgttcaacctgctgatggacatcgacagctacatgttcgcctgcgtgaaccagaccgccgtgtacgaggagctggaggacgagaccagaagactgtgcgacgtgagacccttcctgcccgtgctgaagctggtgaccagaagctgcgaccccggcgagaagctggacagcaagatcggcgtgctgatcggctag

SEQ ID NO: 12104 - DNA, 2109 bp, Artificial Sequence
  Description of Artificial Sequence: Synthetic coding sequence
tgagtgagagccggcctgttccacggcaccgagctgctgtgcaagaccatcgtgagcagcgaggtgagcggcaagaacgaccacatctggaacgagcccctggagttcgacatcaacatctgcgacctgcccagaatggccagactgtgcttcgccgtgtacgccgtgctggacaaggtgaagaccaagaagagcaccaagaccatcaaccccagcaagtaccagaccatcagaaaggccggcaaggtgcactaccccgtggcctgggtgaacaccatggtgttcgacttcaagggccagctgagaaccggcgacatcatcctgcacagctggagcagcttccccgacgagctggaggagatgctgaaccccatgggcaccgtgcagaccaacccctacaccgagaacgccaccgccctgcacgtgaagttccccgagaacaagaagcagccctactactacccccccttcgacaagagcagaggcggcaagaagttcctgcccgtgctgaaggagatcctggacagagaccccctgagccagctgtgcgagaacgagatggacctgatctggaccctgagacaggactgcagagagatcttcccccagagcctgcccaagctgctgctgagcatcaagtggaacaagctggaggacgtggcccagctgcaggccctgctgcagatctggcccaagctgccccccagagaggccctggagctgctggacttcaactaccccgaccagtacgtgagagagtacgccgtgggctgcctgagacagatgagcgacgaggagctgagccagtacctgctgcagctggtgcaggtgctgaagtacgagcccttcctggactgcgccctgagcagattcctgctggagagagccctgggcaacagaagaatcggccagttcctgttctggcacctgagaagcgaggtgcacatccccgccgtgagcgtgcagttcggcgtgatcctggaggcctactgcagaggcagcgtgggccacatgaaggtgctgagcaagcaggtggaggccctgaacaagctgaagaccctgaacagcctgatcaagctgaacgccgtgaagctgaacagagccaagggcaaggaggccatgcacacctgcctgaagcagagcgcctacagagaggccctgagcgacctgcagagccccctgaacccctgcgtgatcctgagcgagctgtacgtggagaagtgcaagtacatggacagcaagatgaagcccctgtggctggtgtacaacaacaaggtgttcggcgaggacagcgtgggcgtgatcttcaagaacggcgacgacctgagacaggacatgctgaccctgcagatgctgagactgatggacctgctgtggaaggaggccggcctggacctgagaatgctgccctacggctgcctggccaccggcgacagaagcggcctgatcgaggtggtgagcaccagcgagaccatcgccgacatccagctgaacagcagcaacgtggccgccgccgccgccttcaacaaggacgccctgctgaactggctgaaggagtacaacagcggcgacgacctggacagagccatcgaggagttcaccctgagctgcgccggctactgcgtggccagctacgtgctgggcatcggcgacagacacagcgacaacatcatggtgaagaagaccggccagctgttccacatcgacttcggccacatcctgggcaacttcaagagcaagttcggcatcaagagagagagagtgcccttcatcctgacctacgacttcatccacgtgatccagcagggcaagaccggcaacaccgagaagttcggcagattcagacagtgctgcgaggacgcctacctgatcctgagaagacacggcaacctgttcatcaccctgttcgccctgatgctgaccgccggcctgcccgagctgaccagcgtgaaggacatccagtacctgaaggacagcctggccctgggcaagagcgaggaggaggccctgaagcagttcaagcagaagttcgacgaggccctgagagagagctggaccaccaaggtgaactggatggcccacaccgtgagaaaggactacagaagctag

SEQ ID NO: 12105 - DNA, 1566 bp, Artificial Sequence
  Description of Artificial Sequence: Synthetic coding sequence
atggacctgatctggaccctgagacaggactgcagagagatcttcccccagagcctgcccaagctgctgctgagcatcaagtggaacaagctggaggacgtggcccagctgcaggccctgctgcagatctggcccaagctgccccccagagaggccctggagctgctggacttcaactaccccgaccagtacgtgagagagtacgccgtgggctgcctgagacagatgagcgacgaggagctgagccagtacctgctgcagctggtgcaggtgctgaagtacgagcccttcctggactgcgccctgagcagattcctgctggagagagccctgggcaacagaagaatcggccagttcctgttctggcacctgagaagcgaggtgcacatccccgccgtgagcgtgcagttcggcgtgatcctggaggcctactgcagaggcagcgtgggccacatgaaggtgctgagcaagcaggtggaggccctgaacaagctgaagaccctgaacagcctgatcaagctgaacgccgtgaagctgaacagagccaagggcaaggaggccatgcacacctgcctgaagcagagcgcctacagagaggccctgagcgacctgcagagccccctgaacccctgcgtgatcctgagcgagctgtacgtggagaagtgcaagtacatggacagcaagatgaagcccctgtggctggtgtacaacaacaaggtgttcggcgaggacagcgtgggcgtgatcttcaagaacggcgacgtgtgcttccccctggacctgagacaggacatgctgaccctgcagatgctgagactgatggacctgctgtggaaggaggccggcctggacctgagaatgctgccctacggctgcctggccaccggcgacagaagcggcctgatcgaggtggtgagcaccagcgagaccatcgccgacatccagctgaacagcagcaacgtggccgccgccgccgccttcaacaaggacgccctgctgaactggctgaaggagtacaacagcggcgacgacctggacagagccatcgaggagttcaccctgagctgcgccggctactgcgtggccagctacgtgctgggcatcggcgacagacacagcgacaacatcatggtgaagaagaccggccagctgttccacatcgacttcggccacatcctgggcaacttcaagagcaagttcggcatcaagagagagagagtgcccttcatcctgacctacgacttcatccacgtgatccagcagggcaagaccggcaacaccgagaagttcggcagattcagacagtgctgcgaggacgcctacctgatcctgagaagacacggcaacctgttcatcaccctgttcgccctgatgctgaccgccggcctgcccgagctgaccagcgtgaaggacatccagtacctgaaggacagcctggccctgggcaagagcgaggaggaggccctgaagcagttcaagcagaagttcgacgaggccctgagagagagctggaccaccaaggtgaactggatggcccacaccgtgagaaaggactacagaagctag

SEQ ID NO: 12106 - DNA, 3207 bp, Artificial Sequence
  Description of Artificial Sequence: Synthetic coding sequence
atgccccccggcgtggactgccccatggagttctggaccaaggaggagaaccagagcgtggtggtggacttcctgctgcccaccggcgtgtacctgaacttccccgtgagcagaaacgccaacctgagcaccatcaagcagctgctgtggcacagagcccagtacgagcccctgttccacatgctgagcggccccgaggcctacgtgttcacctgcatcaaccagaccgccgagcagcaggagctggaggacgagcagagaagactgtgcgacgtgcagcccttcctgcccgtgctgagactggtggccagagagggcgacagagtgaagaagctgatcaacagccagatcagcctgctgatcggcaagggcctgcacgagttcgacagcctgtgcgaccccgaggtgaacgacttcagagccaagatgtgccagttctgcgaggaggccgccgccagaagacagcagctgggctgggaggcctggctgcagtacagcttccccctgcagctggagcccagcgcccagacctggggccccggcaccctgagactgcccaacagagccctgctggtgaacgtgaagttcgagggcagcgaggagagcttcaccttccaggtgagcaccaaggacgtgcccctggccctgatggcctgcgccctgagaaagaaggccaccgtgttcagacagcccctggtggagcagcccgaggactacaccctgcaggtgaacggcagacacgagtacctgtacggcagctaccccctgtgccagttccaggtgcagaagcccagagccaagcccccccccatccccgccaagaagcccagcagcgtgagcctgtggagcctggagcagcccttcagaatcgagctgatccagggcagcaaggtgaacgccgacgagagaatgaagctggtggtgcaggccggcctgttccacggcaacgagatgctgtgcaagaccgtgagcagcagcgaggtgagcgtgtgcagcgagcccgtgtggaagcagagactggagttcgacatcaacatctgcgacctgcccagaatggccagactgtgcttcgccctgtacgccgtgatcgagaaggccaagaaggccagaagcaccaagaagaagagcaagaaggccgactgccccatcgcctgggccaacctgatgctgttcgactacaaggaccagctgaagaccggcgagagatgcctgtacatgtggcccagcgtgcccgacgagaagggcgagctgctgaaccccaccggcaccgtgagaagcaaccccaacaccgacagcgccgccgccctgctgatctgcctgcccgaggtggccccccaccccgtgtactaccccgccctggagaagctgcccggcggcatgctgctggccagcagagagtggagacccgagctgctgtggatgagactgcacgccgaggacagcgcccccagcagaatgatcggcgtggccatgcccggcctgggcgtgctgcccggcctggtgcaggcccccggcgacgccgagtgcagcagactgctgcagatcctggagctgggcagacacagcgagtgcgtgcacgtgaccgaggaggagcagctgcagctgagagagatcctggagagaagaggcagcggcgagctgtacgagcacgagaaggacctggtgtggaagctgagacacgaggtgcaggagcacttccccgaggccctggccagactgctgctggtgaccaagtggaacaagcacgaggacgtggcccaggacgccctgcccgccgtgagctggcccgagctgcccgtgctgagcgccctggagctgctggacttcagcttccccgactgccacgtgggcagcttcgccatcaagagcctgagaaagctgaccgacgacgagctgttccagtacctgctgcagctggtgcaggtgctgaagtacgagagctacctggactgcgagctgaccaagttcctgctggacagagccctggccaacagaaagatcggccacttcctgttctggcacctgagaagcgagatgcacgtgcccagcgtggccctgagattcggcctgatcctggaggcctactgcagaggcagcacccaccacatgaaggtgctgatgaagcagggcgaggccctgagcaagctgaaggccctgaacgacttcgtgaagctgagcagccagaagacccccaagccccagaccaaggagctgatgcacctgtgcatgagacaggaggcctacctggaggccctgagccacctgcagagccccctggaccccagcaccctgctggccgaggtgtgcgtggagcagtgcaccttcatggacagcaagatgaagcccctgtggatcatgtacagcaacgaggaggccggcagcggcggcagcgtgggcatcatcttcaagaacggcgacgacctgagacaggacatgctgaccctgcagatgatccagctgatggacgtgctgtggaagcaggagggcctggacctgagaatgaccccctacggctgcctgcccaccggcgacagaaccggcctgatcgaggtggtgctgagaagcgacaccatcgccaacatccagctgaacaagagcaacatggccgccaccgccgccttcaacaaggacgccctgctgaactggctgaagagcaagaaccccggcgaggccctggacagagccatcgaggagttcaccctgagctgcgccggctactgcgtggccacctacgtgctgggcatcggcgacagacacagcgacaacatcatgatcagagagagcggccagctgttccacatcgacttcggccacttcctgggcaacttcaagaccaagttcggcatcaacagagagagagtgcccttcatcctgacctacgacttcgtgcacgtgatccagcagggcaagaccaacaacagcgagaagttcgagagattcagaggctactgcgagagagcctacaccatcctgagaagacacggcctgctgttcctgcacctgttcgccctgatgagagccgccggcctgcccgagctgagctgcagcaaggacatccagtacctgaaggacagcctggccctgggcaagaccgaggaggaggccctgaagcacttcagagtgaagttcaacgaggccctgagagagagctggaagaccaaggtgaactggctggcccacaacgtgagcaaggacaacagacagtag

SEQ ID NO: 12107 - DNA, 3207 bp, Artificial Sequence
  Description of Artificial Sequence: Synthetic coding sequence
atgccccccggcgtggactgccccatggagttctggaccaaggaggagaaccagagcgtggtggtggacttcctgctgcccaccggcgtgtacctgaacttccccgtgagcagaaacgccaacctgagcaccatcaagcagctgctgtggcacagagcccagtacgagcccctgttccacatgctgagcggccccgaggcctacgtgttcacctgcatcaaccagaccgccgagcagcaggagctggaggacgagcagagaagactgtgcgacgtgcagcccttcctgcccgtgctgagactggtggccagagagggcgacagagtgaagaagctgatcaacagccagatcagcctgctgatcggcaagggcctgcacgagttcgacagcctgtgcgaccccgaggtgaacgacttcagagccaagatgtgccagttctgcgaggaggccgccgccagaagacagcagctgggctgggaggcctggctgcagtacagcttccccctgcagctggagcccagcgcccagacctggggccccggcaccctgagactgcccaacagagccctgctggtgaacgtgaagttcgagggcagcgaggagagcttcaccttccaggtgagcaccaaggacgtgcccctggccctgatggcctgcgccctgagaaagaaggccaccgtgttcagacagcccctggtggagcagcccgaggactacaccctgcaggtgaacggcagacacgagtacctgtacggcagctaccccctgtgccagttccaggtgcagaagcccagagccaagcccccccccatccccgccaagaagcccagcagcgtgagcctgtggagcctggagcagcccttcagaatcgagctgatccagggcagcaaggtgaacgccgacgagagaatgaagctggtggtgcaggccggcctgttccacggcaacgagatgctgtgcaagaccgtgagcagcagcgaggtgagcgtgtgcagcgagcccgtgtggaagcagagactggagttcgacatcaacatctgcgacctgcccagaatggccagactgtgcttcgccctgtacgccgtgatcgagaaggccaagaaggccagaagcaccaagaagaagagcaagaaggccgactgccccatcgcctgggccaacctgatgctgttcgactacaaggaccagctgaagaccggcgagagatgcctgtacatgtggcccagcgtgcccgacgagaagggcgagctgctgaaccccaccggcaccgtgagaagcaaccccaacaccgacagcgccgccgccctgctgatctgcctgcccgaggtggccccccaccccgtgtactaccccgccctggagaagctgcccggcggcatgctgctggccagcagagagtggagacccgagctgctgtggatgagactgcacgccgaggacagcgcccccagcagaatgatcggcgtggccatgcccggcctgggcgtgctgcccggcctggtgcaggcccccggcgacgccgagtgcagcagactgctgcagatcctggagctgggcagacacagcgagtgcgtgcacgtgaccgaggaggagcagctgcagctgagagagatcctggagagaagaggcagcggcgagctgtacgagcacgagaaggacctggtgtggaagctgagacacgaggtgcaggagcacttccccgaggccctggccagactgctgctggtgaccaagtggaacaagcacgaggacgtggcccagatgctgtacctgctgtgcagctggcccgagctgcccgtgctgagcgccctggagctgctggacttcagcttccccgactgccacgtgggcagcttcgccatcaagagcctgagaaagctgaccgacgacgagctgttccagtacctgctgcagctggtgcaggtgctgaagtacgagagctacctggactgcgagctgaccaagttcctgctggacagagccctggccaacagaaagatcggccacttcctgttctggcacctgagaagcgagatgcacgtgcccagcgtggccctgagattcggcctgatcctggaggcctactgcagaggcagcacccaccacatgaaggtgctgatgaagcagggcgaggccctgagcaagctgaaggccctgaacgacttcgtgaagctgagcagccagaagacccccaagccccagaccaaggagctgatgcacctgtgcatgagacaggaggcctacctggaggccctgagccacctgcagagccccctggaccccagcaccctgctggccgaggtgtgcgtggagcagtgcaccttcatggacagcaagatgaagcccctgtggatcatgtacagcaacgaggaggccggcagcggcggcagcgtgggcatcatcttcaagaacggcgacgacctgagacaggacatgctgaccctgcagatgatccagctgatggacgtgctgtggaagcaggagggcctggacctgagaatgaccccctacggctgcctgcccaccggcgacagaaccggcctgatcgaggtggtgctgagaagcgacaccatcgccaacatccagctgaacaagagcaacatggccgccaccgccgccttcaacaaggacgccctgctgaactggctgaagagcaagaaccccggcgaggccctggacagagccatcgaggagttcaccctgagctgcgccggctactgcgtggccacctacgtgctgggcatcggcgacagacacagcgacaacatcatgatcagagagagcggccagctgttccacatcgacttcggccacttcctgggcaacttcaagaccaagttcggcatcaacagagagagagtgcccttcatcctgacctacgacttcgtgcacgtgatccagcagggcaagaccaacaacagcgagaagttcgagagattcagaggctactgcgagagagcctacaccatcctgagaagacacggcctgctgttcctgcacctgttcgccctgatgagagccgccggcctgcccgagctgagctgcagcaaggacatccagtacctgaaggacagcctggccctgggcaagaccgaggaggaggccctgaagcacttcagagtgaagttcaacgaggccctgagagagagctggaagaccaaggtgaactggctggcccacaacgtgagcaaggacaacagacagtag

SEQ ID NO: 12108 - DNA, 3135 bp, Artificial Sequence
  Description of Artificial Sequence: Synthetic coding sequence
atgccccccggcgtggactgccccatggagttctggaccaaggaggagaaccagagcgtggtggtggacttcctgctgcccaccggcgtgtacctgaacttccccgtgagcagaaacgccaacctgagcaccatcaagcagctgctgtggcacagagcccagtacgagcccctgttccacatgctgagcggccccgaggcctacgtgttcacctgcatcaaccagaccgccgagcagcaggagctggaggacgagcagagaagactgtgcgacgtgcagcccttcctgcccgtgctgagactggtggccagagagggcgacagagtgaagaagctgatcaacagccagatcagcctgctgatcggcaagggcctgcacgagttcgacagcctgtgcgaccccgaggtgaacgacttcagagccaagatgtgccagttctgcgaggaggccgccgccagaagacagcagctgggctgggaggcctggctgcagtacagcttccccctgcagctggagcccagcgcccagacctggggccccggcaccctgagactgcccaacagagccctgctggtgaacgtgaagttcgagggcagcgaggagagcttcaccttccaggtgagcaccaaggacgtgcccctggccctgatggcctgcgccctgagaaagaaggccaccgtgttcagacagcccctggtggagcagcccgaggactacaccctgcaggtgaacggcagacacgagtacctgtacggcagctaccccctgtgccagttccagtacatctgcagctgcctgcacagcggcctgaccccccacctgaccatggtgcacagcagcagcatcctggccatgagagacgagcagagcaaccccgccccccaggtgcagaagcccagagccaagcccccccccatccccgccaagaagcccagcagcgtgagcctgtggagcctggagcagcccttcagaatcgagctgatccagggcagcaaggtgaacgccgacgagagaatgaagctggtggtgcaggccggcctgttccacggcaacgagatgctgtgcaagaccgtgagcagcagcgaggtgagcgtgtgcagcgagcccgtgtggaagcagagactggagttcgacatcaacatctgcgacctgcccagaatggccagactgtgcttcgccctgtacgccgtgatcgagaaggccaagaaggccagaagcaccaagaagaagagcaagaaggccgactgccccatcgcctgggccaacctgatgctgttcgactacaaggaccagctgaagaccggcgagagatgcctgtacatgtggcccagcgtgcccgacgagaagggcgagctgctgaaccccaccggcaccgtgagaagcaaccccaacaccgacagcgccgccgccctgctgatctgcctgcccgaggtggccccccaccccgtgtactaccccgccctggagaagatcctggagctgggcagacacagcgagtgcgtgcacgtgaccgaggaggagcagctgcagctgagagagatcctggagagaagaggcagcggcgagctgtacgagcacgagaaggacctggtgtggaagctgagacacgaggtgcaggagcacttccccgaggccctggccagactgctgctggtgaccaagtggaacaagcacgaggacgtggcccagatgctgtacctgctgtgcagctggcccgagctgcccgtgctgagcgccctggagctgctggacttcagcttccccgactgccacgtgggcagcttcgccatcaagagcctgagaaagctgaccgacgacgagctgttccagtacctgctgcagctggtgcaggtgctgaagtacgagagctacctggactgcgagctgaccaagttcctgctggacagagccctggccaacagaaagatcggccacttcctgttctggcacctgagaagcgagatgcacgtgcccagcgtggccctgagattcggcctgatcctggaggcctactgcagaggcagcacccaccacatgaaggtgctgatgaagcagggcgaggccctgagcaagctgaaggccctgaacgacttcgtgaagctgagcagccagaagacccccaagccccagaccaaggagctgatgcacctgtgcatgagacaggaggcctacctggaggccctgagccacctgcagagccccctggaccccagcaccctgctggccgaggtgtgcgtggagcagtgcaccttcatggacagcaagatgaagcccctgtggatcatgtacagcaacgaggaggccggcagcggcggcagcgtgggcatcatcttcaagaacggcgacgacctgagacaggacatgctgaccctgcagatgatccagctgatggacgtgctgtggaagcaggagggcctggacctgagaatgaccccctacggctgcctgcccaccggcgacagaaccggcctgatcgaggtggtgctgagaagcgacaccatcgccaacatccagctgaacaagagcaacatggccgccaccgccgccttcaacaaggacgccctgctgaactggctgaagagcaagaaccccggcgaggccctggacagagccatcgaggagttcaccctgagctgcgccggctactgcgtggccacctacgtgctgggcatcggcgacagacacagcgacaacatcatgatcagagagagcggccagctgttccacatcgacttcggccacttcctgggcaacttcaagaccaagttcggcatcaacagagagagagtgcccttcatcctgacctacgacttcgtgcacgtgatccagcagggcaagaccaacaacagcgagaagttcgagagattcagaggctactgcgagagagcctacaccatcctgagaagacacggcctgctgttcctgcacctgttcgccctgatgagagccgccggcctgcccgagctgagctgcagcaaggacatccagtacctgaaggacagcctggccctgggcaagaccgaggaggaggccctgaagcacttcagagtgaagttcaacgaggccctgagagagagctggaagaccaaggtgaactggctggcccacaacgtgagcaaggacaacagacagtag

SEQ ID NO: 12109 - DNA, 3207 bp, Artificial Sequence; identical to SEQ ID NO: 12107
  Description of Artificial Sequence: Synthetic coding sequence

SEQ ID NO: 12110 - DNA, 960 bp, Artificial Sequence
  Description of Artificial Sequence: Synthetic coding sequence
atgatccccgagagcagcgagctggtggtgcaggccggcctgttccacggcaacgagatgctgtgcaagaccgtgagcagcagcgaggtgagcgtgtgcagcgagcccgtgtggaagcagagactggagttcgacatcaacatctgcgacctgcccagaatggccagactgtgcttcgccctgtacgccgtgatcgagaaggccaagaaggccagaagcaccaagaagaagagcaagaaggccgactgccccatcgcctgggccaacctgatgctgttcgactacaaggaccagctgaagaccggcgagagatgcctgtacatgtggcccagcgtgcccgacgagaagggcgagctgctgaaccccaccggcaccgtgagaagcaaccccaacaccgacagcgccgccgccctgctgatctgcctgcccgaggtggccccccaccccgtgtactaccccgccctggagaagatcctggagctgggcagacacagcgagtgcgtgcacgtgaccgaggaggagcagctgcagctgagagagatcctggagagaagaggcagcggcgagctgtacgagcacgagaaggacctggtgtggaagctgagacacgaggtgcaggagcacttccccgaggccctggccagactgctgctggtgaccaagtggaacaagcacgaggacgtggcccagatgctgtacctgctgtgcagctggcccgagctgcccgtgctgagcgccctggagctgctggacttcagcttccccgactgccacgtgggcagcttcgccatcaagagcctgagaaagctgaccgacgacgagctgttccagtacctgctgcagctggtgcaggtgctgaagtacgagagctacctggactgcgagctgaccaagttcctgctggacagagccctggccaacagaaagatcggccacttcctgttctggcacctgagatag

SEQ ID NO: 12111 - DNA, 3309 bp, Artificial Sequence
  Description of Artificial Sequence: Synthetic coding sequence
atggagctggagaactacaagcagcccgtggtgctgagagaggacaactgcagaagaagaagaagaatgaagcccagaagcgccgccgccagcctgagcagcatggagctgatccccatcgagttcgtgctgcccaccagccagagaaagtgcaagagccccgagaccgccctgctgcacgtggccggccacggcaacgtggagcagatgaaggcccaggtgtggctgagagccctggagaccagcgtggccgccgacttctaccacagactgggcccccaccacttcctgctgctgtaccagaagaagggccagtggtacgagatctacgacaagtaccaggtggtgcagaccctggactgcctgagatactggaaggccacccacagaagccccggccagatccacctggtgcagagacacccccccagcgaggagagccaggccttccagagacagctgaccgccctgatcggctacgacgtgaccgacgtgagcaacgtgcacgacgacgagctggagttcaccagaagaggcctggtgacccccagaatggccgaggtggccagcagagaccccaagctgtacgccatgcacccctgggtgaccagcaagcccctgcccgagtacctgtggaagaagatcgccaacaactgcatcttcatcgtgatccacagaagcaccaccagccagaccatcaaggtgagccccgacgacacccccggcgccatcctgcagagcttcttcaccaagatggccaagaagaagagcctgatggacatccccgagagccagagcgagcaggacttcgtgctgagagtgtgcggcagagacgagtacctggtgggcgagacccccatcaagaacttccagtgggtgagacactgcctgaagaacggcgaggagatccacgtggtgctggacaccccccccgaccccgccctggacgaggtgagaaaggaggagtggcccctggtggacgactgcaccggcgtgaccggctaccacgagcagctgaccatccacggcaaggaccacgagagcgtgttcaccgtgagcctgtgggactgcgacagaaagttcagagtgaagatcagaggcatcgacatccccgtgctgcccagaaacaccgacctgaccgtgttcgtggaggccaacatccagcacggccagcaggtgctgtgccagagaagaaccagccccaagcccttcaccgaggaggtgctgtggaacgtgtggctggagttcagcatcaagatcaaggacctgcccaagggcgccctgctgaacctgcagatctactgcggcaaggcccccgccctgagcagcaaggccagcgccgagagccccagcagcgagagcaagggcaaggtgcagctgctgtactacgtgaacctgctgctgatcgaccacagattcctgctgagaagaggcgagtacgtgctgcacatgtggcagatcagcggcaagggcgaggaccagggcagcttcaacgccgacaagctgaccagcgccaccaaccccgacaaggagaacagcatgagcatcagcatcctgctggacaactactgccaccccatcgccctgcccaagcaccagcccacccccgaccccgagggcgacagagtgagagccgagatgcccaaccagctgagaaagcagctggaggccatcatcgccaccgaccccctgaaccccctgaccgccgaggacaaggagctgctgtggcacttcagatacgagagcctgaagcaccccaaggcctaccccaagctgttcagcagcgtgaagtggggccagcaggagatcgtggccaagacctaccagctgctggccagaagagaggtgtgggaccagagcgccctggacgtgggcctgaccatgcagctgctggactgcaacttcagcgacgagaacgtgagagccatcgccgtgcagaagctggagagcctggaggacgacgacgtgctgcactacctgctgcagctggtgcaggccgtgaagttcgagccctaccacgacagcgccctggccagattcctgctgaagagaggcctgagaaacaagagaatcggccacttcctgttctggttcctgagaagcgagatcgcccagagcagacactaccagcagagattcgccgtgatcctggaggcctacctgagaggctgcggcaccgccatgctgcacgacttcacccagcaggtgcaggtgatcgagatgctgcagaaggtgaccctggacatcaagagcctgagcgccgagaagtacgacgtgagcagccaggtgatcagccagctgaagcagaagctggagaacctgcagaacagccagctgcccgagagcttcagagtgccctacgaccccggcctgaaggccggcgccctggccatcgagaagtgcaaggtgatggccagcaagaagaagcccctgtggctggagttcaagtgcgccgaccccaccgccctgagcaacgagaccatcggcatcatcttcaagcacggcgacgacctgagacaggacatgctgatcctgcagatcctgagaatcatggagagcatctgggagaccgagagcctggacctgtgcctgctgccctacggctgcatcagcaccggcgacaagatcggcatgatcgagatcgtgaaggacgccaccaccatcgccaagatccagcagagcaccgtgggcaacaccggcgccttcaaggacgaggtgctgaaccactggctgaaggagaagagccccaccgaggagaagttccaggccgccgtggagagattcgtgtacagctgcgccggctactgcgtggccaccttcgtgctgggcatcggcgacagacacaacgacaacatcatgatcaccgagaccggcaacctgttccacatcgacttcggccacatcctgggcaactacaagagcttcctgggcatcaacaaggagagagtgcccttcgtgctgacccccgacttcctgttcgtgatgggcaccagcggcaagaagaccagcccccacttccagaagttccaggacatctgcgtgaaggcctacctggccctgagacaccacaccaacctgctgatcatcctgttcagcatgatgctgatgaccggcatgccccagctgaccagcaaggaggacatcgagtacatcagagacgccctgaccgtgggcaagaacgaggaggacgccaagaagtacttcctggaccagatcgaggtgtgcagagacaagggctggaccgtgcagttcaactggttcctgcacctggtgctgggcatcaagcagggcgagaagcacagcgcctag

SEQ ID NO: 12112 - DNA, 3309 bp, Artificial Sequence; identical to SEQ ID NO: 12111
  Description of Artificial Sequence: Synthetic coding sequence

SEQ ID NO: 12113 - DNA, 3309 bp, Artificial Sequence; identical to SEQ ID NO: 12111
  Description of Artificial Sequence: Synthetic coding sequence

SEQ ID NO: 12114 - DNA, 5061 bp, Artificial Sequence
  Description of Artificial Sequence: Synthetic coding sequence
atggcccagatcagcagcaacagcggcttcaaggagtgccccagcagccaccccgagcccaccagagccaaggacgtggacaaggaggaggccctgcagatggaggccgaggccctggccaagctgcagaaggacagacaggtgaccgacaaccagagaggcttcgagctgagcagcagcaccagaaagaaggcccaggtgtacaacaagcaggactacgacctgatggtgttccccgagagcgacagccagaagagagccctggacatcgacgtggagaagctgacccaggccgagctggagaagctgctgctggacgacagcttcgagaccaagaagacccccgtgctgcccgtgacccccatcctgagccccagcttcagcgcccagctgtacttcagacccaccatccagagaggccagtggccccccggcctgcccggccccagcacctacgccctgcccagcatctaccccagcacctacagcaagcaggccgccttccagaacggcttcaaccccagaatgcccaccttccccagcaccgagcccatctacctgagcctgcccggccagagcccctacttcagctaccccctgacccccgccacccccttccacccccagggcagcctgcccatctacagacccgtggtgagcaccgacatggccaagctgttcgacaagatcgccagcaccagcgagttcctgaagaacggcaaggccagaaccgacctggagatcaccgacagcaaggtgagcaacctgcaggtgagccccaagagcgaggacatcagcaagttcgactggctggacctggaccccctgagcaagcccaaggtggacaacgtggaggtgctggaccacgaggaggagaagaacgtgagcagcctgctggccaaggacccctgggacgccgtgctgctggaggagagaagcaccgccaactgccacctggagagaaaggtgaacggcaagagcctgagcgtggccaccgtgaccagaagccagagcctgaacatcagaaccacccagctggccaaggcccagggccacatcagccagaaggaccccaacggcaccagcagcctgcccaccggcagcagcctgctgcaggaggtggaggtgcagaacgaggagatggccgccttctgcagaagcatcaccaagctgaagaccaagttcccctacaccaaccacagaaccaaccccggctacctgctgagccccgtgaccgcccagagaaacatctgcggcgagaacgccagcgtgaaggtgagcatcgacatcgagggcttccagctgcccgtgaccttcacctgcgacgtgagcagcaccgtggagatcatcatcatgcaggccctgtgctgggtgcacgacgacctgaaccaggtggacgtgggcagctacgtgctgaaggtgtgcggccaggaggaggtgctgcagaacaaccactgcctgggcagccacgagcacatccagaactgcagaaagtgggacaccgagatcagactgcagctgctgaccttcagcgccatgtgccagaacctggccagaaccgccgaggacgacgagacccccgtggacctgaacaagcacctgtaccagatcgagaagccctgcaaggaggccatgaccagacaccccgtggaggagctgctggacagctaccacaaccaggtggagctggccctgcagatcgagaaccagcacagagccgtggaccaggtgatcaaggccgtgagaaagatctgcagcgccctggacggcgtggagaccctggccatcaccgagagcgtgaagaagctgaagagagccgtgaacctgcccagaagcaagaccgccgacgtgaccagcctgttcggcggcgaggacaccagcagaagcagcaccagaggcagcctgaaccccgagaaccccgtgcaggtgagcatcaaccagctgaccgccgccatctacgacctgctgagactgcacgccaacagcggcagaagccccaccgactgcgcccagagcagcaagagcgtgaaggaggcctggaccaccaccgagcagctgcagttcaccatcttcgccgcccacggcatcagcagcaactgggtgagcaactacgagaagtactacctgatctgcagcctgagccacaacggcaaggacctgttcaagcccatccagagcaagaaggtgggcacctacaagaacttcttctacctgatcaagtgggacgagctgatcatcttccccatccagatcagccagctgcccctggagagcgtgctgcacctgaccctgttcggcatcctgaaccagagcagcggcagcagccccgacagcaacaagcagagaaagggccccgaggccctgggcaaggtgagcctgcccctgttcgacttcaagagattcctgacctgcggcaccaagctgctgtacctgtggaccagcagccacaccaacagcgtgcccggcaccgtgaccaagaagggctacgtgatggagagaatcgtgctgcaggtggacttccccagccccgccttcgacatcatctacaccaccccccaggtggacagaagcatcatccagcagcacaacctggagaccctggagaacgacatcaagggcaagctgctggacatcctgcacaaggacagcagcctgggcctgagcaaggaggacaaggccttcctgtgggagaagagatactactgcttcaagcaccccaactgcctgcccaagatcctggccagcgcccccaactggaagtgggtgaacctggccaagacctacagcctgctgcaccagtggcccgccctgtaccccctgatcgccctggagctgctggacagcaagttcgccgaccaggaggtgagaagcctggccgtgacctggatcgaggccatcagcgacgacgagctgaccgacctgctgccccagttcgtgcaggccctgaagtacgagatctacctgaacagcagcctggtgcagttcctgctgagcagagccctgggcaacatccagatcgcccacaacctgtactggctgctgaaggacgccctgcacgacgtgcagttcagcaccagatacgagcacgtgctgggcgccctgctgagcgtgggcggcaagagactgagagaggagctgctgaagcagaccaagctggtgcagctgctgggcggcgtggccgagaaggtgagacaggccagcggcagcgccagacaggtggtgctgcagagaagcatggagagagtgcagagcttcttccagaagaacaagtgcagactgcccctgaagcccagcctggtggccaaggagctgaacatcaagagctgcagcttcttcagcagcaacgccgtgcccctgaaggtgaccatggtgaacgccgaccccatgggcgaggagatcaacgtgatgttcaaggtgggcgaggacctgagacaggacatgctggccctgcagatgatcaagatcatggacaagatctggctgaaggagggcctggacctgagaatggtgatcttcaagtgcctgagcaccggcagagacagaggcatggtggagctggtgcccgccagcgacaccctgagaaagatccaggtggagtacggcgtgaccggcagcttcaaggacaagcccctggccgagtggctgagaaagtacaaccccagcgaggaggagtacgagaaggccagcgagaacttcatctacagctgcgccggctgctgcgtggccacctacgtgctgggcatctgcgacagacacaacgacaacatcatgctgagaagcaccggccacatgttccacatcgacttcggcaagttcctgggccacgcccagatgttcggcagcttcaagagagacagagcccccttcgtgctgaccagcgacatggcctacgtgatcaacggcggcgagaagcccaccatcagattccagctgttcgtggacctgtgctgccaggcctacaacctgatcagaaagcagaccaacctgttcctgaacctgctgagcctgatgatccccagcggcctgcccgagctgaccagcatccaggacctgaagtacgtgagagacgccctgcagccccagaccaccgacgccgaggccaccatcttcttcaccagactgatcgagagcagcctgggcagcatcgccaccaagttcaacttcttcatccacaacctggcccagctgagattcagcggcctgcccagcaacgacgagcccatcctgagcttcagccccaagacctacagcttcagacaggacggcagaatcaaggaggtgagcgtgttcacctaccacaagaagtacaaccccgacaagcactacatctacgtggtgagaatcctgagagagggccagatcgagcccagcttcgtgttcagaaccttcgacgagttccaggagctgcacaacaagctgagcatcatcttccccctgtggaagctgcccggcttccccaacagaatggtgctgggcagaacccacatcaaggacgtggccgccaagagaaagatcgagctgaacagctacctgcagagcctgatgaacgccagcaccgacgtggccgagtgcgacctggtgtgcaccttcttccaccccctgctgagagacgagaaggccgagggcatcgccagaagcgccgacgccggcagcttcagccccacccccggccagatcggcggcgccgtgaagctgagcatcagctacagaaacggcaccctgttcatcatggtgatgcacatcaaggacctggtgaccgaggacggcgccgaccccaacccctacgtgaagacctacctgctgcccgacaaccacaagaccagcaagagaaagaccaagatcagcagaaagaccagaaaccccaccttcaacgagatgctggtgtacagcggctacagcaaggagaccctgagacagagagagctgcagctgagcgtgctgagcgccgagagcctgagagagaacttcttcctgggcggcgtgaccctgcccctgaaggacttcaacctgagcaaggagaccgtgaagtggtaccagctgaccgccgccacctacctgtag

SEQ ID NO: 12115 - DNA, 393 bp, Artificial Sequence
  Description of Artificial Sequence: Synthetic coding sequence
atggcccagatcagcagcaacagcggcttcaaggagtgccccagcagccaccccgagcccaccagagccaaggacgtggacaaggaggaggccctgcagatggaggccgaggccctggccaagctgcagaaggacagacaggtgaccgacaaccagagaggcttcgagctgagcagcagcaccagaaagaaggcccaggtgtacaacaagcaggactacgacctgatggtgttccccgagagcgacagccagaagagagccctggacatcgacgtggagaagctgacccaggccgagctggagaagctgctgctggacgacagcttcgagaccaagaagacccccgtgctgcccgtgacccccatcctgagccccagcttcagcgcccagtag

SEQ ID NO: 12116 - DNA, 1452 bp, Artificial Sequence
  Description of Artificial Sequence: Synthetic coding sequence
atggcccagatcagcagcaacagcggcttcaaggagtgccccagcagccaccccgagcccaccagagccaaggacgtggacaaggaggaggccctgcagatggaggccgaggccctggccaagctgcagaaggacagacaggtgaccgacaaccagagaggcttcgagctgagcagcagcaccagaaagaaggcccaggtgtacaacaagcaggactacgacctgatggtgttccccgagagcgacagccagaagagagccctggacatcgacgtggagaagctgacccaggccgagctggagaagctgctgctggacgacagcttcgagaccaagaagacccccgtgctgcccgtgacccccatcctgagccccagcttcagcgcccagctgtacttcagacccaccatccagagaggccagtggccccccggcctgcccggccccagcacctacgccctgcccagcatctaccccagcacctacagcaagcaggccgccttccagaacggcttcaaccccagaatgcccaccttccccagcaccgagcccatctacctgagcctgcccggccagagcccctacttcagctaccccctgacccccgccacccccttccacccccagggcagcctgcccatctacagacccgtggtgagcaccgacatggccaagctgttcgacaagatcgccagcaccagcgagttcctgaagaacggcaaggccagaaccgacctggagatcaccgacagcaaggtgagcaacctgcaggtgagccccaagagcgaggacatcagcaagttcgactggctggacctggaccccctgagcaagcccaaggtggacaacgtggaggtgctggaccacgaggaggagaagaacgtgagcagcctgctggccaaggacccctgggacgccgtgctgctggaggagagaagcaccgccaactgccacctggagagaaaggtgaacggcaagagcctgagcgtggccaccgtgaccagaagccagagcctgaacatcagaaccacccagctggccaaggcccagggccacatcagccagaaggaccccaacggcaccagcagcctgcccaccggcagcagcctgctgcaggaggtggaggtgcagaacgaggagatggccgccttctgcagaagcatcaccaagctgaagaccaagttcccctacaccaaccacagaaccaaccccggctacctgctgagccccgtgaccgcccagagaaacatctgcggcgagaacgccagcgtgaaggtgagcatcgacatcgagggcttccagctgcccgtgaccttcacctgcgacgtgagcagcaccgtggagatcatcatcatgcaggccctgtgctgggtgcacgacgacctgaaccaggtggacgtgggcagctacgtgctgaaggtgtgcggccaggaggaggtgctgcagaagtag

SEQ ID NO: 12117 - DNA, 3921 bp, Artificial Sequence
  Description of Artificial Sequence: Synthetic coding sequence
atggccgccttctgcagaagcatcaccaagctgaagaccaagttcccctacaccaaccacagaaccaaccccggctacctgctgagccccgtgaccgcccagagaaacatctgcggcgagaacgccagcgtgaaggtgagcatcgacatcgagggcttccagctgcccgtgaccttcacctgcgacgtgagcagcaccgtggagatcatcatcatgcaggccctgtgctgggtgcacgacgacctgaaccaggtggacgtgggcagctacgtgctgaaggtgtgcggccaggaggaggtgctgcagaacaaccactgcctgggcagccacgagcacatccagaactgcagaaagtgggacaccgagatcagactgcagctgctgaccttcagcgccatgtgccagaacctggccagaaccgccgaggacgacgagacccccgtggacctgaacaagcacctgtaccagatcgagaagccctgcaaggaggccatgaccagacaccccgtggaggagctgctggacagctaccacaaccaggtggagctggccctgcagatcgagaaccagcacagagccgtggaccaggtgatcaaggccgtgagaaagatctgcagcgccctggacggcgtggagaccctggccatcaccgagagcgtgaagaagctgaagagagccgtgaacctgcccagaagcaagaccgccgacgtgaccagcctgttcggcggcgaggacaccagcagaagcagcaccagaggcagcctgaaccccgagaaccccgtgcaggtgagcatcaaccagctgaccgccgccatctacgacctgctgagactgcacgccaacagcggcagaagccccaccgactgcgcccagagcagcaagagcgtgaaggaggcctggaccaccaccgagcagctgcagttcaccatcttcgccgcccacggcatcagcagcaactgggtgagcaactacgagaagtactacctgatctgcagcctgagccacaacggcaaggacctgttcaagcccatccagagcaagaaggtgggcacctacaagaacttcttctacctgatcaagtgggacgagctgatcatcttccccatccagatcagccagctgcccctggagagcgtgctgcacctgaccctgttcggcatcctgaaccagagcagcggcagcagccccgacagcaacaagcagagaaagggccccgaggccctgggcaaggtgagcctgcccctgttcgacttcaagagattcctgacctgcggcaccaagctgctgtacctgtggaccagcagccacaccaacagcgtgcccggcaccgtgaccaagaagggctacgtgatggagagaatcgtgctgcaggtggacttccccagccccgccttcgacatcatctacaccaccccccaggtggacagaagcatcatccagcagcacaacctggagaccctggagaacgacatcaagggcaagctgctggacatcctgcacaaggacagcagcctgggcctgagcaaggaggacaaggccttcctgtgggagaagagatactactgcttcaagcaccccaactgcctgcccaagatcctggccagcgcccccaactggaagtgggtgaacctggccaagacctacagcctgctgcaccagtggcccgccctgtaccccctgatcgccctggagctgctggacagcaagttcgccgaccaggaggtgagaagcctggccgtgacctggatcgaggccatcagcgacgacgagctgaccgacctgctgccccagttcgtgcaggccctgaagtacgagatctacctgaacagcagcctggtgcagttcctgctgagcagagccctgggcaacatccagatcgcccacaacctgtactggctgctgaaggacgccctgcacgacgtgcagttcagcaccagatacgagcacgtgctgggcgccctgctgagcgtgggcggcaagagactgagagaggagctgctgaagcagaccaagctggtgcagctgctgggcggcgtggccgagaaggtgagacaggccagcggcagcgccagacaggtggtgctgcagagaagcatggagagagtgcagagcttcttccagaagaacaagtgcagactgcccctgaagcccagcctggtggccaaggagctgaacatcaagagctgcagcttcttcagcagcaacgccgtgcccctgaaggtgaccatggtgaacgccgaccccatgggcgaggagatcaacgtgatgttcaaggtgggcgaggacctgagacaggacatgctggccctgcagatgatcaagatcatggacaagatctggctgaaggagggcctggacctgagaatggtgatcttcaagtgcctgagcaccggcagagacagaggcatggtggagctggtgcccgccagcgacaccctgagaaagatccaggtggagtacggcgtgaccggcagcttcaaggacaagcccctggccgagtggctgagaaagtacaaccccagcgaggaggagtacgagaaggccagcgagaacttcatctacagctgcgccggctgctgcgtggccacctacgtgctgggcatctgcgacagacacaacgacaacatcatgctgagaagcaccggccacatgttccacatcgacttcggcaagttcctgggccacgcccagatgttcggcagcttcaagagagacagagcccccttcgtgctgaccagcgacatggcctacgtgatcaacggcggcgagaagcccaccatcagattccagctgttcgtggacctgtgctgccaggcctacaacctgatcagaaagcagaccaacctgttcctgaacctgctgagcctgatgatccccagcggcctgcccgagctgaccagcatccaggacctgaagtacgtgagagacgccctgcagccccagaccaccgacgccgaggccaccatcttcttcaccagactgatcgagagcagcctgggcagcatcgccaccaagttcaacttcttcatccacaacctggcccagctgagattcagcggcctgcccagcaacgacgagcccatcctgagcttcagccccaagacctacagcttcagacaggacggcagaatcaaggaggtgagcgtgttcacctaccacaagaagtacaaccccgacaagcactacatctacgtggtgagaatcctgagagagggccagatcgagcccagcttcgtgttcagaaccttcgacgagttccaggagctgcacaacaagctgagcatcatcttccccctgtggaagctgcccggcttccccaacagaatggtgctgggcagaacccacatcaaggacgtggccgccaagagaaagatcgagctgaacagctacctgcagagcctgatgaacgccagcaccgacgtggccgagtgcgacctggtgtgcaccttcttccaccccctgctgagagacgagaaggccgagggcatcgccagaagcgccgacgccggcagcttcagccccacccccggccagatcggcggcgccgtgaagctgagcatcagctacagaaacggcaccctgttcatcatggtgatgcacatcaaggacctggtgaccgaggacggcgccgaccccaacccctacgtgaagacctacctgctgcccgacaaccacaagaccagcaagagaaagaccaagatcagcagaaagaccagaaaccccaccttcaacgagatgctggtgtacagcggctacagcaaggagaccctgagacagagagagctgcagctgagcgtgctgagcgccgagagcctgagagagaacttcttcctgggcggcgtgaccctgcccctgaaggacttcaacctgagcaaggagaccgtgaagtggtaccagctgaccgccgccacctacctgtag

SEQ ID NO: 12118 - DNA, 1947 bp, Artificial Sequence
  Description of Artificial Sequence: Synthetic coding sequence
atggcccagatcagcagcaacagcggcttcaaggagtgccccagcagccaccccgagcccaccagagccaaggacgtggacaaggaggaggccctgcagatggaggccgaggccctggccaagctgcagaaggacagacaggtgaccgacaaccagagaggcttcgagctgagcagcagcaccagaaagaaggcccaggtgtacaacaagcaggactacgacctgatggtgttccccgagagcgacagccagaagagagccctggacatcgacgtggagaagctgacccaggccgagctggagaagctgctgctggacgacagcttcgagaccaagaagacccccgtgctgcccgtgacccccatcctgagccccagcttcagcgcccagctgtacttcagacccaccatccagagaggccagtggccccccggcctgcccggccccagcacctacgccctgcccagcatctaccccagcacctacagcaagcaggccgccttccagaacggcttcaaccccagaatgcccaccttccccagcaccgagcccatctacctgagcctgcccggccagagcccctacttcagctaccccctgacccccgccacccccttccacccccagggcagcctgcccatctacagacccgtggtgagcaccgacatggccaagctgttcgacaagatcgccagcaccagcgagttcctgaagaacggcaaggccagaaccgacctggagatcaccgacagcaaggtgagcaacctgcaggtgagccccaagagcgaggacatcagcaagttcgactggctggacctggaccccctgagcaagcccaaggtggacaacgtggaggtgctggaccacgaggaggagaagaacgtgagcagcctgctggccaaggacccctgggacgccgtgctgctggaggagagaagcaccgccaactgccacctggagagaaaggtgaacggcaagagcctgagcgtggccaccgtgaccagaagccagagcctgaacatcagaaccacccagctggccaaggcccagggccacatcagccagaaggaccccaacggcaccagcagcctgcccaccggcagcagcctgctgcaggaggtggaggtgcagaacgaggagatggccgccttctgcagaagcatcaccaagctgaagaccaagttcccctacaccaaccacagaaccaaccccggctacctgctgagccccgtgaccgcccagagaaacatctgcggcgagaacgccagcgtgaaggtgagcatcgacatcgagggcttccagctgcccgtgaccttcacctgcgacgtgagcagcaccgtggagatcatcatcatgcaggccctgtgctgggtgcacgacgacctgaaccaggtggacgtgggcagctacgtgctgaaggtgtgcggccaggaggaggtgctgcagaacaaccactgcctgggcagccacgagcacatccagaactgcagaaagtgggacaccgagatcagactgcagctgctgaccttcagcgccatgtgccagaacctggccagaaccgccgaggacgacgagacccccgtggacctgaacaagcacctgtaccagatcgagaagccctgcaaggaggccatgaccagacaccccgtggaggagctgctggacagctaccacaaccaggtggagctggccctgcagatcgagaaccagcacagagccgtggaccaggtgatcaaggccgtgagaaagatctgcagcgccctggacggcgtggagaccctggccatcaccgagagcgtgaagaagctgaagagagccgtgaacctgcccagaagcaagaccgccgacgtgaccagcctgttcggcggcgaggacaccagcagaagcagcaccagaggcagcctgaaccccgagaaccccgtgcaggtgagcatcaaccagctgtag

SEQ ID NO: 12119 - DNA, 2664 bp, Artificial Sequence
  Description of Artificial Sequence: Synthetic coding sequence
atgggcgaggccgagaagttccactacatctacagctgcgacctggacatcaacgtgcagctgaagatcggcagcctggagggcaagagagagcagaagagctacaaggccgtgctggaggaccccatgctgaagttcagcggcctgtaccaggagacctgcagcgacctgtacgtgacctgccaggtgttcgccgagggcaagcccctggccctgcccgtgagaaccagctacaaggccttcagcaccagatggaactggaacgagtggctgaagctgcccgtgaagtaccccgacctgcccagaaacgcccaggtggccctgaccatctgggacgtgtacggccccggcaaggccgtgcccgtgggcggcaccaccgtgagcctgttcggcaagtacggcatgttcagacagggcatgcacgacctgaaggtgtggcccaacgtggaggccgacggcagcgagcccaccaagacccccggcagaaccagcagcaccctgagcgaggaccagatgagcagactggccaagctgaccaaggcccacagacagggccacatggtgaaggtggactggctggacagactgaccttcagagagatcgagatgatcaacgagagcgagaagagaagcagcaacttcatgtacctgatggtggagttcagatgcgtgaagtgcgacgacaaggagtacggcatcgtgtactacgagaaggacggcgacgagagcagccccatcctgaccagcttcgagctggtgaaggtgcccgacccccagatgagcatggagaacctggtggagagcaagcaccacaagctggccagaagcctgagaagcggccccagcgaccacgacctgaagcccaacgccgccaccagagaccagctgaacatcatcgtgagctacccccccaccaagcagctgacctacgaggagcaggacctggtgtggaagttcagatactacctgaccaaccaggagaaggccctgaccaagttcctgaagtgcgtgaactgggacctgccccaggaggccaagcaggccctggagctgctgggcaagtggaagcccatggacgtggaggacagcctggagctgctgagcagccactacaccaaccccaccgtgagaagatacgccgtggccagactgagacaggccgacgacgaggacctgctgatgtacctgctgcagctggtgcaggccctgaagtacgagaacttcgacgacatcaagaacggcctggagcccaccaagaaggacagccagagcagcgtgagcgagaacgtgagcaacagcggcatcaacagcgccgagatcgacagcagccagatcatcaccagccccctgcccagcgtgagcagccccccccccgccagcaagaccaaggaggtgcccgacggcgagaacctggagcaggacctgtgcaccttcctgatcagcagagcctgcaagaacagcaccctggccaactacctgtactggtacgtgatcgtggagtgcgaggaccaggacacccagcagagagaccccaagacccacgagatgtacctgaacgtgatgagaagattcagccaggccctgctgaagggcgacaagagcgtgagagtgatgagaagcctgctggccgcccagcagaccttcgtggacagactggtgcacctgatgaaggccgtgcagagagagagcggcaacagaaagaagaagaacgagagactgcaggccctgctgggcgacaacgagaagatgaacctgagcgacgtggagctgatccccctgcccctggagccccaggtgaagatcagaggcatcatccccgagaccgccaccctgttcaagagcgccctgatgcccgcccagctgttcttcaagaccgaggacggcggcaagtaccccgtgatcttcaagcacggcgacgacctgagacaggaccagctgatcctgcagatcatcagcctgatggacaagctgctgagaaaggagaacctggacctgaagctgaccccctacaaggtgctggccaccagcaccaagcacggcttcatgcagttcatccagagcgtgcccgtggccgaggtgctggacaccgagggcagcatccagaacttcttcagaaagtacgcccccagcgagaacggccccaacggcatcagcgccgaggtgatggacacctacgtgaagagctgcgccggctactgcgtgatcacctacatcctgggcgtgggcgacagacacctggacaacctgctgctgaccaagaccggcaagctgttccacatcgacttcggctacatcctgggcagagaccccaagcccctgcccccccccatgaagctgaacaaggagatggtggagggcatgggcggcacccagagcgagcagtaccaggagttcagaaagcagtgctacaccgccttcctgcacctgagaagatacagcaacctgatcctgaacctgttcagcctgatggtggacgccaacatccccgacatcgccctggagcccgacaagaccgtgaagaaggtgcaggacaagttcagactggacctgagcgacgaggaggccgtgcactacatgcagagcctgatcgacgagagcgtgcacgccctgttcgccgccgtggtggagcagatccacaagttcgcccagtactggagaaagtag

SEQ ID NO: 12120 - DNA, 2475 bp, Artificial Sequence
  Description of Artificial Sequence: Synthetic coding sequence
atgggcgaggccgagaagttccactacatctacagctgcgacctggacatcaacgtgcagctgaagatctggaacgagtggctgaagctgcccgtgaagtaccccgacctgcccagaaacgcccaggtggccctgaccatctgggacgtgtacggccccggcaaggccgtgcccgtgggcggcaccaccgtgagcctgttcggcaagtacggcatgttcagacagggcatgcacgacctgaaggtgtggcccaacgtggaggccgacggcagcgagcccaccaagacccccggcagaaccagcagcaccctgagcgaggaccagatgagcagactggccaagctgaccaaggcccacagacagggccacatggtgaaggtggactggctggacagactgaccttcagagagatcgagatgatcaacgagagcgagaagagaagcagcaacttcatgtacctgatggtggagttcagatgcgtgaagtgcgacgacaaggagtacggcatcgtgtactacgagaaggacggcgacgagagcagccccatcctgaccagcttcgagctggtgaaggtgcccgacccccagatgagcatggagaacctggtggagagcaagcaccacaagctggccagaagcctgagaagcggccccagcgaccacgacctgaagcccaacgccgccaccagagaccagctgaacatcatcgtgagctacccccccaccaagcagctgacctacgaggagcaggacctggtgtggaagttcagatactacctgaccaaccaggagaaggccctgaccaagttcctgaagtgcgtgaactgggacctgccccaggaggccaagcaggccctggagctgctgggcaagtggaagcccatggacgtggaggacagcctggagctgctgagcagccactacaccaaccccaccgtgagaagatacgccgtggccagactgagacaggccgacgacgaggacctgctgatgtacctgctgcagctggtgcaggccctgaagtacgagaacttcgacgacatcaagaacggcctggagcccaccaagaaggacagccagagcagcgtgagcgagaacgtgagcaacagcggcatcaacagcgccgagatcgacagcagccagatcatcaccagccccctgcccagcgtgagcagccccccccccgccagcaagaccaaggaggtgcccgacggcgagaacctggagcaggacctgtgcaccttcctgatcagcagagcctgcaagaacagcaccctggccaactacctgtactggtacgtgatcgtggagtgcgaggaccaggacacccagcagagagaccccaagacccacgagatgtacctgaacgtgatgagaagattcagccaggccctgctgaagggcgacaagagcgtgagagtgatgagaagcctgctggccgcccagcagaccttcgtggacagactggtgcacctgatgaaggccgtgcagagagagagcggcaacagaaagaagaagaacgagagactgcaggccctgctgggcgacaacgagaagatgaacctgagcgacgtggagctgatccccctgcccctggagccccaggtgaagatcagaggcatcatccccgagaccgccaccctgttcaagagcgccctgatgcccgcccagctgttcttcaagaccgaggacggcggcaagtaccccgtgatcttcaagcacggcgacgacctgagacaggaccagctgatcctgcagatcatcagcctgatggacaagctgctgagaaaggagaacctggacctgaagctgaccccctacaaggtgctggccaccagcaccaagcacggcttcatgcagttcatccagagcgtgcccgtggccgaggtgctggacaccgagggcagcatccagaacttcttcagaaagtacgcccccagcgagaacggccccaacggcatcagcgccgaggtgatggacacctacgtgaagagctgcgccggctactgcgtgatcacctacatcctgggcgtgggcgacagacacctggacaacctgctgctgaccaagaccggcaagctgttccacatcgacttcggctacatcctgggcagagaccccaagcccctgcccccccccatgaagctgaacaaggagatggtggagggcatgggcggcacccagagcgagcagtaccaggagttcagaaagcagtgctacaccgccttcctgcacctgagaagatacagcaacctgatcctgaacctgttcagcctgatggtggacgccaacatccccgacatcgccctggagcccgacaagaccgtgaagaaggtgcaggacaagttcagactggacctgagcgacgaggaggccgtgcactacatgcagagcctgatcgacgagagcgtgcacgccctgttcgccgccgtggtggagcagatccacaagttcgcccagtactggagaaagtag

SEQ ID NO: 12121 - DNA, 2175 bp, Artificial Sequence
  Description of Artificial Sequence: Synthetic coding sequence
atgagcgccgagggctaccagtacagagccctgtacgactacaagaaggagagagaggaggacatcgacctgcacctgggcgacatcctgaccgtgaacaagggcagcctggtggccctgggcttcagcgacggccaggaggccagacccgaggagatcggctggctgaacggctacaacgagaccaccggcgagagaggcgacttccccggcacctacgtggagtacatcggcagaaagaagatcagcccccccacccccaagcccagaccccccagacccctgcccgtggcccccggcagcagcaagaccgaggccgacgtggagcagcaggccctgaccctgcccgacctggccgagcagttcgccccccccgacatcgccccccccctgctgatcaagctggtggaggccatcgagaagaagggcctggagtgcagcaccctgtacagaacccagagcagcagcaacctggccgagctgagacagctgctggactgcgacacccccagcgtggacctggagatgatcgacgtgcacgtgctggccgacgccttcaagagatacctgctggacctgcccaaccccgtgatccccgccgccgtgtacagcgagatgatcagcctggcccccgaggtgcagagcagcgaggagtacatccagctgctgaagaagctgatcagaagccccagcatcccccaccagtactggctgaccctgcagtacctgctgaagcacttcttcaagctgagccagaccagcagcaagaacctgctgaacgccagagtgctgagcgagatcttcagccccatgctgttcagattcagcgccgccagcagcgacaacaccgagaacctgatcaaggtgatcgagatcctgatcagcaccgagtggaacgagagacagcccgcccccgccctgccccccaagccccccaagcccaccaccgtggccaacaacggcatgaacaacaacatgagcctgcaggacgccgagtggtactggggcgacatcagcagagaggaggtgaacgagaagctgagagacaccgccgacggcaccttcctggtgagagacgccagcaccaagatgcacggcgactacaccctgaccctgagaaagggcggcaacaacaagctgatcaagatcttccacagagacggcaagtacggcttcagcgaccccctgaccttcagcagcgtggtggagctgatcaaccactacagaaacgagagcctggcccagtacaaccccaagctggacgtgaagctgctgtaccccgtgagcaagtaccagcaggaccaggtggtgaaggaggacaacatcgaggccgtgggcaagaagctgcacgagtacaacacccagttccaggagaagagcagagagtacgacagactgtacgaggagtacaccagaaccagccaggagatccagatgaagagaaccgccatcgaggccttcaacgagaccatcaagatcttcgaggagcagtgccagacccaggagagatacagcaaggagtacatcgagaagttcaagagagagggcaacgagaaggagatccagagaatcatgcacaactacgacaagctgaagagcagaatcagcgagatcatcgacagcagaagaagactggaggaggacctgaagaagcaggccgccgagtacagagagatcgacaagagaatgaacagcatcaagcccgacctgatccagctgagaaagaccagagaccagtacctgatgtggctgacccagaagggcgtgagacagaagaagctgaacgagtggctgggcaacgagaacaccgaggaccagtacagcctggtggaggacgacgaggacctgccccaccacgacgagaagacctggaacgtgggcagcagcaacagaaacaaggccgagaacctgctgagaggcaagagagacggcaccttcctggtgagagagagcagcaagcagggctgctacgcctgcagcgtggtggtggacggcgaggtgaagcactgcgtgatcaacaagaccgccaccggctacggcttcgccgagccctacaacctgtacagcagcctgaaggagctggtgctgcactaccagcacaccagcctggtgcagcacaacgacagcctgaacgtgaccctggcctaccccgtgtacgcccagcagagaagatag

SEQ ID NO: 12122 - DNA, 1275 bp, Artificial Sequence
  Description of Artificial Sequence: Synthetic coding sequence
atgcacaacctgcagaccctgccccccaagccccccaagcccaccaccgtggccaacaacggcatgaacaacaacatgagcctgcaggacgccgagtggtactggggcgacatcagcagagaggaggtgaacgagaagctgagagacaccgccgacggcaccttcctggtgagagacgccagcaccaagatgcacggcgactacaccctgaccctgagaaagggcggcaacaacaagctgatcaagatcttccacagagacggcaagtacggcttcagcgaccccctgaccttcagcagcgtggtggagctgatcaaccactacagaaacgagagcctggcccagtacaaccccaagctggacgtgaagctgctgtaccccgtgagcaagtaccagcaggaccaggtggtgaaggaggacaacatcgaggccgtgggcaagaagctgcacgagtacaacacccagttccaggagaagagcagagagtacgacagactgtacgaggagtacaccagaaccagccaggagatccagatgaagagaaccgccatcgaggccttcaacgagaccatcaagatcttcgaggagcagtgccagacccaggagagatacagcaaggagtacatcgagaagttcaagagagagggcaacgagaaggagatccagagaatcatgcacaactacgacaagctgaagagcagaatcagcgagatcatcgacagcagaagaagactggaggaggacctgaagaagcaggccgccgagtacagagagatcgacaagagaatgaacagcatcaagcccgacctgatccagctgagaaagaccagagaccagtacctgatgtggctgacccagaagggcgtgagacagaagaagctgaacgagtggctgggcaacgagaacaccgaggaccagtacagcctggtggaggacgacgaggacctgccccaccacgacgagaagacctggaacgtgggcagcagcaacagaaacaaggccgagaacctgctgagaggcaagagagacggcaccttcctggtgagagagagcagcaagcagggctgctacgcctgcagcgtggtggtggacggcgaggtgaagcactgcgtgatcaacaagaccgccaccggctacggcttcgccgagccctacaacctgtacagcagcctgaaggagctggtgctgcactaccagcacaccagcctggtgcagcacaacgacagcctgaacgtgaccctggcctaccccgtgtacgcccagcagagaagatag

SEQ ID NO: 12123 - DNA, 1365 bp, Artificial Sequence
  Description of Artificial Sequence: Synthetic coding sequence
atgtacaacaccgtgtggaacatggaggacctggacctggagtacgccaagaccgacatcaactgcggcaccgacctgatgttctacatcgagatggacccccccgccctgccccccaagccccccaagcccaccaccgtggccaacaacggcatgaacaacaacatgagcctgcaggacgccgagtggtactggggcgacatcagcagagaggaggtgaacgagaagctgagagacaccgccgacggcaccttcctggtgagagacgccagcaccaagatgcacggcgactacaccctgaccctgagaaagggcggcaacaacaagctgatcaagatcttccacagagacggcaagtacggcttcagcgaccccctgaccttcagcagcgtggtggagctgatcaaccactacagaaacgagagcctggcccagtacaaccccaagctggacgtgaagctgctgtaccccgtgagcaagtaccagcaggaccaggtggtgaaggaggacaacatcgaggccgtgggcaagaagctgcacgagtacaacacccagttccaggagaagagcagagagtacgacagactgtacgaggagtacaccagaaccagccaggagatccagatgaagagaaccgccatcgaggccttcaacgagaccatcaagatcttcgaggagcagtgccagacccaggagagatacagcaaggagtacatcgagaagttcaagagagagggcaacgagaaggagatccagagaatcatgcacaactacgacaagctgaagagcagaatcagcgagatcatcgacagcagaagaagactggaggaggacctgaagaagcaggccgccgagtacagagagatcgacaagagaatgaacagcatcaagcccgacctgatccagctgagaaagaccagagaccagtacctgatgtggctgacccagaagggcgtgagacagaagaagctgaacgagtggctgggcaacgagaacaccgaggaccagtacagcctggtggaggacgacgaggacctgccccaccacgacgagaagacctggaacgtgggcagcagcaacagaaacaaggccgagaacctgctgagaggcaagagagacggcaccttcctggtgagagagagcagcaagcagggctgctacgcctgcagcgtggtggtggacggcgaggtgaagcactgcgtgatcaacaagaccgccaccggctacggcttcgccgagccctacaacctgtacagcagcctgaaggagctggtgctgcactaccagcacaccagcctggtgcagcacaacgacagcctgaacgtgaccctggcctaccccgtgtacgcccagcagagaagatag

SEQ ID NO: 12124 - DNA, 2199 bp, Artificial Sequence
  Description of Artificial Sequence: Synthetic coding sequence
atgagcgccgagggctaccagtacagagccctgtacgactacaagaaggagagagaggaggacatcgacctgcacctgggcgacatcctgaccgtgaacaagggcagcctggtggccctgggcttcagcgacggccaggaggccagacccgaggagatcggctggctgaacggctacaacgagaccaccggcgagagaggcgacttccccggcacctacgtggagtacatcggcagaaagaagatcagcccccccacccccaagcccagaccccccagacccctgcccgtggcccccggcagcagcaagaccgaggccgacgtggagcagcaggccctgaccctgcccgacctggccgagcagttcgccccccccgacatcgccccccccctgctgatcaagctggtggaggccatcgagaagaagggcctggagtgcagcaccctgtacagaacccagagcagcagcaacctggccgagctgagacagctgctggactgcgacacccccagcgtggacctggagatgatcgacgtgcacgtgctggccgacgccttcaagagatacctgctggacctgcccaaccccgtgatccccgccgccgtgtacagcgagatgatcagcctggcccccgaggtgcagagcagcgaggagtacatccagctgctgaagaagctgatcagaagccccagcatcccccaccagtactggctgaccctgcagtacctgctgaagcacttcttcaagctgagccagaccagcagcaagaacctgctgaacgccagagtgctgagcgagatcttcagccccatgctgttcagattcagcgccgccagcagcgacaacaccgagaacctgatcaaggtgatcgagatcctgatcagcaccgagtggaacgagagacagcccgcccccgccctgccccccaagccccccaagcccaccaccgtggccaacaacggcatgaacaacaacatgagcctgcaggacgccgagtggtactggggcgacatcagcagagaggaggtgaacgagaagctgagagacaccgccgacggcaccttcctggtgagagacgccagcaccaagatgcacggcgactacaccctgaccctgagaaagggcggcaacaacaagctgatcaagatcttccacagagacggcaagtacggcttcagcgaccccctgaccttcagcagcgtggtggagctgatcaaccactacagaaacgagagcctggcccagtacaaccccaagctggacgtgaagctgctgtaccccgtgagcaagtaccagcaggaccaggtggtgaaggaggacaacatcgaggccgtgggcaagaagctgcacgagtacaacacccagttccaggagaagagcagagagtacgacagactgtacgaggagtacaccagaaccagccaggagatccagatgaagagaaccgccatcgaggccttcaacgagaccatcaagatcttcgaggagcagtgccagacccaggagagatacagcaaggagtacatcgagaagttcaagagagagggcaacgagaaggagatccagagaatcatgcacaactacgacaagctgaagagcagaatcagcgagatcatcgacagcagaagaagactggaggaggacctgaagaagcaggccgccgagtacagagagatcgacaagagaatgaacagcatcaagcccgacctgatccagctgagaaagaccagagaccagtacctgatgtggctgacccagaagggcgtgagacagaagaagctgaacgagtggctgggcaacgagaacaccgaggagaacttcctgagctgcctgcccagccagtacagcctggtggaggacgacgaggacctgccccaccacgacgagaagacctggaacgtgggcagcagcaacagaaacaaggccgagaacctgctgagaggcaagagagacggcaccttcctggtgagagagagcagcaagcagggctgctacgcctgcagcgtggtggtggacggcgaggtgaagcactgcgtgatcaacaagaccgccaccggctacggcttcgccgagccctacaacctgtacagcagcctgaaggagctggtgctgcactaccagcacaccagcctggtgcagcacaacgacagcctgaacgtgaccctggcctaccccgtgtacgcccagcagagaagatag

SEQ ID NO: 12125 - DNA, 2175 bp, Artificial Sequence; identical to SEQ ID NO: 12121
  Description of Artificial Sequence: Synthetic coding sequence

SEQ ID NO: 12126 - DNA, 414 bp, Artificial Sequence
  Description of Artificial Sequence: Synthetic coding sequence
atgcacggcgactacaccctgaccctgagaaagggcggcaacaacaagctgatcaagatcttccacagagacggcaagtacggcttcagcgaccccctgaccttcagcagcgtggtggagctgatcaaccactacagaaacgagagcctggcccagtacaaccccaagctggacgtgaagctgctgtaccccgtgagcaagtaccagcaggaccaggtggtgaaggaggacaacatcgaggccgtgggcaagaagctgcacgagtacaacacccagttccaggagaagagcagagagtacgacagactgtacgaggagtacaccagaaccagccaggagatccagatgaagagaaccgccatcgaggccttcaacgagaccatcaagatcttcgaggagcagtgccagacctag

SEQ ID NO: 12127 - DNA, 2175 bp, Artificial Sequence; identical to SEQ ID NO: 12121
  Description of Artificial Sequence: Synthetic coding sequence

SEQ ID NO: 12128 - DNA, 1224 bp, Artificial Sequence
  Description of Artificial Sequence: Synthetic coding sequence
atgctgttcgacaaggtgaaggccttcagcgtgcagctggacggcgccaccgccggcgtggagcccgtgttcagcggcggccaggccgtggccggcagagtgctgctggagctgagcagcgccgccagagtgggcgccctgagactgagagccagaggcagagcccacgtgcactggaccgagagcagaagcgccggcagcagcaccgcctacacccagagctacagcgagagagtggaggtggtgagccacagagccaccctgctggcccccgacaccggcgagaccaccaccctgccccccggcagacacgagttcctgttcagcttccagctgccccccaccctggtgaccagcttcgagggcaagcacggcagcgtgagatactgcatcaaggccaccctgcacagaccctgggtgcccgccagaagagccagaaaggtgttcaccgtgatcgagcccgtggacatcaacacccccgccctgctggccccccaggccggcgccagagagaaggtggccagaagctggtactgcaacagaggcctggtgagcctgagcgccaagatcgacagaaagggctacacccccggcgaggtgatccccgtgttcgccgagatcgacaacggcagcaccagacccgtgctgcccagagccgccgtggtgcagacccagaccttcatggccagaggcgccagaaagcagaagagagccgtggtggccagcctggccggcgagcccgtgggccccggccagagagccctgtggcagggcagagccctgagaatcccccccgtgggccccagcatcctgcactgcagagtgctgcacgtggactacgccctgaaggtgtgcgtggacatccccggcaccagcaagctgctgctggagctgcccctggtgatcggcaccatccccctgcaccccttcggcagcagaagcagcagcgtgggcagccacgccagcttcctgctggactggagactgggcgccctgcccgagagacccgaggccccccccgagtacagcgaggtggtggccgacaccgaggaggccgccctgggccagagccccttccccctgccccaggaccccgacatgagcctggagggccccttcttcgcctacatccaggagttcagatacagacccccccccctgtacagcgaggaggaccccaaccccctgctgggcgacatgagacccagatgcatgacctgctag

SEQ ID NO: 12129 - DNA, 1386 bp, Artificial Sequence
  Description of Artificial Sequence: Synthetic coding sequence
atgtacaacaccgtgtggagcatggacagagacgacgccgactggagagaggtgatgatgccctacagcaccgagctgatcttctacatcgagatggacccccccgccctgccccccaagccccccaagcccatgaccagcgccgtgcccaacggcatgaaggacagcagcgtgagcctgcaggacgccgagtggtactggggcgacatcagcagagaggaggtgaacgacaagctgagagacatgcccgacggcaccttcctggtgagagacgccagcaccaagatgcagggcgactacaccctgaccctgagaaagggcggcaacaacaagctgatcaagatctaccacagagacggcaagtacggcttcagcgaccccctgaccttcaacagcgtggtggagctgatcaaccactaccaccacgagagcctggcccagtacaaccccaagctggacgtgaagctgatgtaccccgtgagcagataccagcaggaccagctggtgaaggaggacaacatcgacgccgtgggcaagaagctgcaggagtaccacagccagtaccaggagaagagcaaggagtacgacagactgtacgaggagtacaccagaaccagccaggagatccagatgaagagaaccgccatcgaggccttcaacgagaccatcaagatcttcgaggagcagtgccacacccaggagcagcacagcaaggagtacatcgagagattcagaagagagggcaacgagaaggagatcgagagaatcatgatgaactacgacaagctgaagagcagactgggcgagatccacgacagcaagatgagactggagcaggacctgaagaaccaggccctggacaacagagagatcgacaagaagatgaacagcatcaagcccgacctgatccagctgagaaagatcagagaccagcacctggtgtggctgaaccacaagggcgtgagacagaagagactgaacgtgtggctgggcatcaagaacgaggacgccgacgagaactacttcatcaacgaggaggacgagaacctgccccactacgacgagaagacctggttcgtggaggacatcaacagagtgcaggccgaggacctgctgtacggcaagcccgacggcgccttcctgatcagagagagcagcaagaagggctgctacgcctgcagcgtggtggccgacggcgaggtgaagcactgcgtgatctacagcaccgccagaggctacggcttcgccgagccctacaacctgtacagcagcctgaaggagctggtgctgcactaccagcagaccagcctggtgcagcacaacgacagcctgaacgtgagactggcctaccccgtgcacgcccagatgcccagcctgtgcagatag

SEQ ID NO: 12130 - DNA, 1101 bp, Artificial Sequence
  Description of Artificial Sequence: Synthetic coding sequence
atgtacaacaccgtgtggagcatggacagagacgacgccgactggagagaggtgatgatgccctacagcaccgagctgatcttctacatcgagatggacccccccgccgccgaggtgaacgacaagctgagagacatgcccgacggcaccttcctggtgagagacgccagcaccaagatgcagggcgactacaccctgaccctgagaaagggcggcaacaacaagctgatcaagatctaccacagagacggcaagtacggcttcagcgaccccctgaccttcaacagcgtggtggagctgatcaaccactaccaccacgagagcctggcccagtacaaccccaagctggacgtgaagctgatgtaccccgtgagcagataccagcaggaccagctggtgaaggaggacaacatcgacgccgtgggcaagaagctgcaggagtaccacagccagtaccaggagaagagcaaggagtacgacagactgtacgaggagtacaccagaaccagccaggagatccagatgaagagaaccgccatcgaggccttcaacgagaccatcaagatcttcgaggagcagtgccacacccaggagcagcacagcaaggagtacatcgagagattcagaagagagggcaacgagaaggagatcgagagatggctgaaccacaagggcgtgagacagaagagactgaacgtgtggctgggcatcaagaacgaggacgccgacgagaactacttcatcaacgaggaggacgagaacctgccccactacgacgagaagacctggttcgtggaggacatcaacagagtgcaggccgaggacctgctgtacggcaagcccgacggcgccttcctgatcagagagagcagcaagaagggctgctacgcctgcagcgtggtggccgacggcgaggtgaagcactgcgtgatctacagcaccgccagaggctacggcttcgccgagccctacaacctgtacagcagcctgaaggagctggtgctgcactaccagcagaccagcctggtgcagcacaacgacagcctgaacgtgagactggcctaccccgtgcacgcccagatgcccagcctgtgcagatag

SEQ ID NO: 12131 - DNA, 1209 bp, Artificial Sequence
  Description of Artificial Sequence: Synthetic coding sequence
atgtacaacaccgtgtggagcatggacagagacgacgccgactggagagaggtgatgatgccctacagcaccgagctgatcttctacatcgagatggacccccccgccctgccccccaagccccccaagcccatgaccagcgccgtgcccaacggcatgaaggacagcagcgtgagcctgcaggacgccgagtggtactggggcgacatcagcagagaggaggtgaacgacaagctgagagacatgcccgacggcaccttcctggtgagagacgccagcaccaagatgcagggcgactacaccctgaccctgagaaagggcggcaacaacaagctgatcaagatctaccacagagacggcaagtacggcttcagcgaccccctgaccttcaacagcgtggtggagctgatcaaccactaccaccacgagagcctggcccagtacaaccccaagctggacgtgaagctgatgtaccccgtgagcagataccagcaggaccagctggtgaaggaggacaacatcgacgccgtgggcaagaagctgcaggagtaccacagccagtaccaggagaagagcaaggagtacgacagactgtacgaggagtacaccagaaccagccaggagatccagatgaagagaaccgccatcgaggccttcaacgagaccatcaagatcttcgaggagcagtgccacacccaggagcagcacagcaaggagtacatcgagagattcagaagagagggcaacgagaaggagatcgagagatggctgaaccacaagggcgtgagacagaagagactgaacgtgtggctgggcatcaagaacgaggacgccgacgagaactacttcatcaacgaggaggacgagaacctgccccactacgacgagaagacctggttcgtggaggacatcaacagagtgcaggccgaggacctgctgtacggcaagcccgacggcgccttcctgatcagagagagcagcaagaagggctgctacgcctgcagcgtggtggccgacggcgaggtgaagcactgcgtgatctacagcaccgccagaggctacggcttcgccgagccctacaacctgtacagcagcctgaaggagctggtgctgcactaccagcagaccagcctggtgcagcacaacgacagcctgaacgtgagactggcctaccccgtgcacgcccagatgcccagcctgtgcagatag

SEQ ID NO: 12132 - DNA, 1386 bp, Artificial Sequence; identical to SEQ ID NO: 12129
  Description of Artificial Sequence: Synthetic coding sequence

SEQ ID NO: 12133 - DNA, 1386 bp, Artificial Sequence; identical to SEQ ID NO: 12129
  Description of Artificial Sequence: Synthetic coding sequence

SEQ ID NO: 12134 - DNA, 1209 bp, Artificial Sequence; identical to SEQ ID NO: 12131
  Description of Artificial Sequence: Synthetic coding sequence

SEQ ID NO: 12135 - DNA, 621 bp, Artificial Sequence
  Description of Artificial Sequence: Synthetic coding sequence
atgtacaacaccgtgtggagcatggacagagacgacgccgactggagagaggtgatgatgccctacagcaccgagctgatcttctacatcgagatggacccccccgccctgccccccaagccccccaagcccatgaccagcgccgtgcccaacggcatgaaggacagcagcgtgagcctgcaggacgccgagtggtactggggcgacatcagcagagaggaggtgaacgacaagctgagagacatgcccgacggcaccttcctggtgagagacgccagcaccaagatgcagggcgactacaccctgaccctgagaaagggcggcaacaacaagctgatcaagatctaccacagagacggcaagtacggcttcagcgaccccctgaccttcaacagcgtggtggagctgatcaaccactaccaccacgagagcctggcccagtacaaccccaagctggacgtgaagctgatgtaccccgtgagcagataccagcaggaccagctggtgaaggaggacaacatcgacgccgtgggcaagaagctgcaggagtaccacagccagtaccaggagaagagcaaggagtacgacagactgtacgaggagtacaccagaaccagctag

SEQ ID NO: 12136 - DNA, 1524 bp, Artificial Sequence
  Description of Artificial Sequence: Synthetic coding sequence
atgggccccagcagactggtgagaggccccagaccccagggcatgagaagcccctacagaagacccggcatgggctggcccagacccagattccccagaatgttcaagtgcagcagaagaagataccagcagggcctgagaggcagaaccgccagcagcgccgccatcaaccccgccaccagagccatgggcatcaacaacacccacaccgacaccaccatcgtgtggatcttccccccccaggccctgccccccaagccccccaagcccatgaccagcgccgtgcccaacggcatgaaggacagcagcgtgagcctgcaggacgccgagtggtactggggcgacatcagcagagaggaggtgaacgacaagctgagagacatgcccgacggcaccttcctggtgagagacgccagcaccaagatgcagggcgactacaccctgaccctgagaaagggcggcaacaacaagctgatcaagatctaccacagagacggcaagtacggcttcagcgaccccctgaccttcaacagcgtggtggagctgatcaaccactaccaccacgagagcctggcccagtacaaccccaagctggacgtgaagctgatgtaccccgtgagcagataccagcaggaccagctggtgaaggaggacaacatcgacgccgtgggcaagaagctgcaggagtaccacagccagtaccaggagaagagcaaggagtacgacagactgtacgaggagtacaccagaaccagccaggagatccagatgaagagaaccgccatcgaggccttcaacgagaccatcaagatcttcgaggagcagtgccacacccaggagcagcacagcaaggagtacatcgagagattcagaagagagggcaacgagaaggagatcgagagaatcatgatgaactacgacaagctgaagagcagactgggcgagatccacgacagcaagatgagactggagcaggacctgaagaaccaggccctggacaacagagagatcgacaagaagatgaacagcatcaagcccgacctgatccagctgagaaagatcagagaccagcacctggtgtggctgaaccacaagggcgtgagacagaagagactgaacgtgtggctgggcatcaagaacgaggacgccgacgagaactacttcatcaacgaggaggacgagaacctgccccactacgacgagaagacctggttcgtggaggacatcaacagagtgcaggccgaggacctgctgtacggcaagcccgacggcgccttcctgatcagagagagcagcaagaagggctgctacgcctgcagcgtggtggccgacggcgaggtgaagcactgcgtgatctacagcaccgccagaggctacggcttcgccgagccctacaacctgtacagcagcctgaaggagctggtgctgcactaccagcagaccagcctggtgcagcacaacgacagcctgaacgtgagactggcctaccccgtgcacgcccagatgcccagcctgtgcagatag

SEQ ID NO: 12137 - DNA, 2643 bp, Artificial Sequence
  Description of Artificial Sequence: Synthetic coding sequence
atgcagcccggcgccaccacctgcaccgaggacagaatccagcacgccctggagagatgcctgcacggcctgagcctgagcagaagaagcaccagctggagcgccggcctgtgcctgaactgctggagcctgcaggagctggtgagcagagaccccggccacttcctgatcctgctggagcagatcctgcagaagaccagagaggtgcaggagaagggcacctacgacctgctgacccccctggccctgctgttctacagcaccgtgctgtgcaccccccacttcccccccgacagcgacctgctgctgaaggccgccagcacctaccacagattcctgacctggcccgtgccctactgcagcatctgccaggagctgctgaccttcatcgacgccgagctgaaggcccccggcatcagctaccagagactggtgagagccgagcagggcctgcccatcagaagccacagaagcagcaccgtgaccgtgctgctgctgaaccccgtggaggtgcaggccgagttcctggccgtggccaacaagctgagcacccccggccacagcccccacagcgcctacaccaccctgctgctgcacgccttccaggccaccttcggcgcccactgcgacgtgcccggcctgcactgcagactgcaggccaagaccctggccgagctggaggacatcttcaccgagaccgccgaggcccaggagctggccagcggcatcggcgacgccgccgaggccagaagatggctgagaaccaagctgcaggccgtgggcgagaaggccggcttccccggcgtgctggacaccgccaagcccggcaagctgcacaccatccccatccccgtggccagatgctacacctacagctggagccaggacagcttcgacatcctgcaggagatcctgctgaaggagcaggagctgctgcagcccggcatcctgggcgacgacgaggaggaggaggaggaggaggaggaggtggaggaggacctggagaccgacggccactgcgccgagagagacagcctgctgagcaccagcagcctggccagccacgacagcaccctgagcctggccagcagccaggccagcggccccgccctgagcagacacctgctgaccagcttcgtgagcggcctgagcgacggcatggacagcggctacgtggaggacagcgaggagagcagcagcgagtggccctggagaagaggcagccaggagagaagaggccacagaagacccggccagaagttcatcagaatctacaagctgttcaagagcaccagccagctggtgctgagaagagacagcagaagcctggagggcagcagcgacaccgccctgcccctgagaagagccggcagcctgtgcagccccctggacgagcccgtgagcccccccagcagagcccagagaagcagaagcctgccccagcccaagctgggcacccagctgcccagctggctgctggcccccgccagcagaccccagagaagaagacccttcctgagcggcgacgaggaccccaaggccagcaccctgagagtggtggtgttcggcagcgacagaatcagcggcaaggtggccagagcctacagcaacctgagaagactggagaacaacagacccctgctgaccagattcttcaagctgcagttcttctacgtgcccgtgaagagaagccacggcaccagccccggcgcctgccccccccccagaagccagacccccagcccccccaccgacagccccagacacgccagccccggcgagctgggcaccaccccctgggaggagagcaccaacgacatcagccactacctgggcatgctggacccctggtacgagagaaacgtgctgggcctgatgcacctgccccccgaggtgctgtgccagcagagcctgaaggccgaggcccaggccctggagggcagccccacccagctgcccatcctggccgacatgctgctgtactactgcagattcgccgccagacccgtgctgctgcaggtgtaccagaccgagctgaccttcatcaccggcgagaagaccaccgagatcttcatccacagcctggagctgggccacagcgccgccaccagagccatcaaggccagcggccccggcagcaagagactgggcatcgacggcgacagagaggccgtgcccctgaccctgcagatcatctacagcaagggcgccatcagcggcagaagcagatggagcaacctggagaaggtgtgcaccagcgtgaacctgaacaaggcctgcagaaagcaggaggagctggacagcagcatggaggccctgaccctgaacctgaccgaggtggtgaagagacagaacagcaagagcaagaagggcttcaaccagatcagcaccagccagatcaaggtggacaaggtgcagatcatcggcagcaacagctgccccttcgccgtgtgcctggaccaggacgagagaaagatcctgcagagcgtggtgagatgcgaggtgagcccctgctacaagcccgagaagagcgacctgagcagccccccccagaccccccccgacctgcccgcccaggccgcccccgacctgtgcagcctgctgtgcctgcccatcatgaccttcagcggcgccctgccctag

SEQ ID NO: 12138 - DNA, 2643 bp, Artificial Sequence; identical to SEQ ID NO: 12137
  Description of Artificial Sequence: Synthetic coding sequence

SEQ ID NO: 12139 - DNA, 447 bp, Artificial Sequence
  Description of Artificial Sequence: Synthetic coding sequence
atgaagctgctggtgctggccgtgctgctgaccgtggccgccgccgacagcggcatcagccccagagccgtgtggcagttcagaaagatgatcaagtgcgtgatccccggcagcgaccccttcctggagtacaacaactacggctgctactgcggcctgggcggcagcggcacccccgtggacgagctggacaagtgctgccagacccacgacaactgctacgaccaggccaagaagctggacagctgcaagttcctgctggacaacccctacacccacacctacagctacagctgcagcggcagcgccatcacctgcagcagcaagaacaaggagtgcgaggccttcatctgcaactgcgacagaaacgccgccatctgcttcagcaaggccccctacaacaaggcccacaagaacctggacaccaagaagtactgccagagctag

SEQ ID NO: 12140 - DNA, 435 bp, Artificial Sequence
  Description of Artificial Sequence: Synthetic coding sequence
atgaagaccctgctgctgctggccgtgatcatgatcttcggcctgctgcaggcccacggcaacctggtgaacttccacagaatgatcaagctgaccaccggcaaggaggccgccctgagctacggcttctacggctgccactgcggcgtgggcggcagaggcagccccaaggacgccaccgacagatgctgcgtgacccacgactgctgctacaagagactggagaagagaggctgcggcaccaagttcctgagctacaagttcagcaacagcggcagcagaatcacctgcgccaagcaggacagctgcagaagccagctgtgcgagtgcgacaaggccgccgccacctgcttcgccagaaacaagaccacctacaacaagaagtaccagtactacagcaacaagcactgcagaggcagcacccccagatgctag

SEQ ID NO: 12141 - DNA, 435 bp, Artificial Sequence; identical to SEQ ID NO: 12140
  Description of Artificial Sequence: Synthetic coding sequence

SEQ ID NO: 12142 - DNA, 438 bp, Artificial Sequence
  Description of Artificial Sequence: Synthetic coding sequence
atggagctggccctgctgtgcggcctggtggtgatggccggcgtgatccccatccagggcggcatcctgaacctgaacaagatggtgaagcaggtgaccggcaagatgcccatcctgagctactggccctacggctgccactgcggcctgggcggcagaggccagcccaaggacgccaccgactggtgctgccagacccacgactgctgctacgaccacctgaagacccagggctgcagcatctacaaggactactacagatacaacttcagccagggcaacatccactgcagcgacaagggcagctggtgcgagcagcagctgtgcgcctgcgacaaggaggtggccttctgcctgaagagaaacctggacacctaccagaagagactgagattctactggagaccccactgcagaggccagacccccggctgctag

SEQ ID NO: 12143 - DNA, 429 bp, Artificial Sequence
  Description of Artificial Sequence: Synthetic coding sequence
atgaagagcccccacgtgctggtgttcctgtgcctgctggtggccctggtgaccggcaacctggtgcagttcggcgtgatgatcgagaagatgaccggcaagagcgccctgcagtacaacgactacggctgctactgcggcatcggcggcagccactggcccgtggaccagaccgactggtgctgccacgcccacgactgctgctacggcagactggagaagctgggctgcgagcccaagctggagaagtacctgttcagcgtgagcgagagaggcatcttctgcgccggcagaaccacctgccagagactgacctgcgagtgcgacaagagagccgccctgtgcttcagaagaaacctgggcacctacaacagaaagtacgcccactaccccaacaagctgtgcaccggccccacccccccctgctag

SEQ ID NO: 12144 - DNA, 636 bp, Artificial Sequence
  Description of Artificial Sequence: Synthetic coding sequence
atggccgacggcgccaaggccaaccccaagggcttcaagaagaaggtgctggacagatgcttcagcggctggagaggccccagattcggcgccagctgccccagcagaaccagcagaagcagcctgggcatgaagaagttcttcaccgtggccatcctggccggcagcgtgctgagcaccgcccacggcagcctgctgaacctgaaggccatggtggaggccgtgaccggcagaagcgccatcctgagcttcgtgggctacggctgctactgcggcctgggcggcagaggccagcccaaggacgaggtggactggtgctgccacgcccacgactgctgctaccaggagctgttcgaccagggctgccacccctacgtggaccactacgaccacaccatcgagaacaacaccgagatcgtgtgcagcgacctgaacaagaccgagtgcgacaagcagacctgcatgtgcgacaagaacatggtgctgtgcctgatgaaccagacctacagagaggagtacagaggcttcctgaacgtgtactgccagggccccacccccaactgcagcatctacgagcccccccccgaggaggtgacctgcagccaccagagccccgccccccccgcccccccctag

SEQ ID NO: 12145 - DNA, 936 bp, Artificial Sequence
  Description of Artificial Sequence: Synthetic coding sequence
atgcccgcccccagagcccccagagccctggccgccgccgcccccgccagcggcaaggccaagctgacccaccccggcaaggccatcctggccggcggcctggccggcggcatcgagatctgcatcaccttccccaccgagtacgtgaagacccagctgcagctggacgagagaagccacccccccagatacagaggcatcggcgactgcgtgagacagaccgtgagaagccacggcgtgctgggcctgtacagaggcctgagcagcctgctgtacggcagcatccccaaggccgccgtgagattcggcatgttcgagttcctgagcaaccacatgagagacgcccagggcagactggacagcaccagaggcctgctgtgcggcctgggcgccggcgtggccgaggccgtggtggtggtgtgccccatggagaccatcaaggtgaagttcatccacgaccagaccagccccaaccccaagtacagaggcttcttccacggcgtgagagagatcgtgagagagcagggcctgaagggcacctaccagggcctgaccgccaccgtgctgaagcagggcagcaaccaggccatcagattcttcgtgatgaccagcctgagaaactggtacagaggcgacaaccccaacaagcccatgaaccccctgatcaccggcgtgttcggcgccatcgccggcgccgccagcgtgttcggcaacacccccctggacgtgatcaagaccagaatgcagggcctggaggcccacaagtacagaaacacctgggactgcggcctgcagatcctgaagaaggagggcctgaaggccttctacaagggcaccgtgcccagactgggcagagtgtgcctggacgtggccatcgtgttcgtgatctacgacgaggtggtgaagctgctgaacaaggtgtggaagaccgactag

SEQ ID NO: 12146 - DNA, 2250 bp, Artificial Sequence
  Description of Artificial Sequence: Synthetic coding sequence
atgagcttcatcgacccctaccagcacatcatcgtggagcaccagtacagccacaagttcaccgtggtggtgctgagagccaccaaggtgaccaagggcgccttcggcgacatgctggacacccccgacccctacgtggagctgttcatcagcaccacccccgacagcagaaagagaaccagacacttcaacaacgacatcaaccccgtgtggaacgagaccttcgagttcatcctggaccccaaccaggagaacgtgctggagatcaccctgatggacgccaactacgtgatggacgagaccctgggcaccgccaccttcaccgtgagcagcatgaaggtgggcgagaagaaggaggtgcccttcatcttcaaccaggtgaccgagatggtgctggagatgagcctggaggtgtgcagctgccccgacctgagattcagcatggccctgtgcgaccaggagaagaccttcagacagcagagaaaggagcacatcagagagagcatgaagaagctgctgggccccaagaacagcgagggcctgcacagcgccagagacgtgcccgtggtggccatcctgggcagcggcggcggcttcagagccatggtgggcttcagcggcgtgatgaaggccctgtacgagagcggcatcctggactgcgccacctacgtggccggcctgagcggcagcacctggtacatgagcaccctgtacagccaccccgacttccccgagaagggccccgaggagatcaacgaggagctgatgaagaacgtgagccacaaccccctgctgctgctgaccccccagaaggtgaagagatacgtggagagcctgtggaagaagaagagcagcggccagcccgtgaccttcaccgacatcttcggcatgctgatcggcgagaccctgatccacaacagaatgaacaccaccctgagcagcctgaaggagaaggtgaacaccgcccagtgccccctgcccctgttcacctgcctgcacgtgaagcccgacgtgagcgagctgatgttcgccgactgggtggagttcagcccctacgagatcggcatggccaagtacggcaccttcatggcccccgacctgttcggcagcaagttcttcatgggcaccgtggtgaagaagtacgaggagaaccccctgcacttcctgatgggcgtgtggggcagcgccttcagcatcctgttcaacagagtgctgggcgtgagcggcagccagagcagaggcagcaccatggaggaggagctggagaacatcaccaccaagcacatcgtgagcaacgacagcagcgacagcgacgacgagagccacgagcccaagggcaccgagaacgaggacgccggcagcgactaccagagcgacaaccaggccagctggatccacagaatgatcatggccctggtgagcgacagcgccctgttcaacaccagagagggcagagccggcaaggtgcacaacttcatgctgggcctgaacctgaacaccagctaccccctgagccccctgagcgacttcgccacccaggacagcttcgacgacgacgagctggacgccgccgtggccgaccccgacgagttcgagagaatctacgagcccctggacgtgaagagcaagaagatccacgtggtggacagcggcctgaccttcaacctgccctaccccctgatcctgagaccccagagaggcgtggacctgatcatcagcttcgacttcagcgccagacccagcgacagcagcccccccttcaaggagctgctgctggccgagaagtgggccaagatgaacaagctgcccttccccaagatcgacccctacgtgttcgacagagagggcctgaaggagtgctacgtgttcaagcccaagaaccccgacatggagaaggactgccccaccatcatccacttcgtgctggccaacatcaacttcagaaagtacagagcccccggcgtgcccagagagaccgaggaggagaaggagatcgccgacttcgacatcttcgacgaccccgagagccccttcagcaccttcaacttccagtaccccaaccaggccttcaagagactgcacgacctgatgcacttcaacaccctgaacaacatcgacgtgatcaaggaggccatggtggagagcatcgagtacagaagacagaaccccagcagatgcagcgtgagcctgagcaacgtggaggccagaagattcttcaacaaggagttcctgagcaagcccaaggcctag

SEQ ID NO: 12147 - DNA, 150 bp, Artificial Sequence
  Description of Artificial Sequence: Synthetic coding sequence
atgagcttcatcgacccctaccagcacatcatcgtggagcaccagtacagccacaagttcaccgtggtggtgctgagagccaccaaggtgaccaagggcgccttcggcgacatgcccaaggtgaccaagggcgccttcggcgacatgtag

SEQ ID NO: 12148 - DNA, 2070 bp, Artificial Sequence
  Description of Artificial Sequence: Synthetic coding sequence
atgagcttcatcgacccctaccagcacatcatcgtggagcaccagtacagccacaagttcaccgtggtggtgctgagagccaccaaggtgaccaagggcgccttcggcgacatgctggacacccccgacccctacgtggagctgttcatcagcaccacccccgacagcagaaagagaaccagacacttcaacaacgacatcaaccccgtgtggaacgagaccttcgagttcatcctggaccccaaccaggagaacgtgctggagatcaccctgatggacgccaactacgtgatggacgagaccctgggcaccgccaccttcaccgtgagcagcatgaaggtgggcgagaagaaggaggtgcccttcatcttcaaccaggtgcccgtggtggccatcctgggcagcggcggcggcttcagagccatggtgggcttcagcggcgtgatgaaggccctgtacgagagcggcatcctggactgcgccacctacgtggccggcctgagcggcagcacctggtacatgagcaccctgtacagccaccccgacttccccgagaagggccccgaggagatcaacgaggagctgatgaagaacgtgagccacaaccccctgctgctgctgaccccccagaaggtgaagagatacgtggagagcctgtggaagaagaagagcagcggccagcccgtgaccttcaccgacatcttcggcatgctgatcggcgagaccctgatccacaacagaatgaacaccaccctgagcagcctgaaggagaaggtgaacaccgcccagtgccccctgcccctgttcacctgcctgcacgtgaagcccgacgtgagcgagctgatgttcgccgactgggtggagttcagcccctacgagatcggcatggccaagtacggcaccttcatggcccccgacctgttcggcagcaagttcttcatgggcaccgtggtgaagaagtacgaggagaaccccctgcacttcctgatgggcgtgtggggcagcgccttcagcatcctgttcaacagagtgctgggcgtgagcggcagccagagcagaggcagcaccatggaggaggagctggagaacatcaccaccaagcacatcgtgagcaacgacagcagcgacagcgacgacgagagccacgagcccaagggcaccgagaacgaggacgccggcagcgactaccagagcgacaaccaggccagctggatccacagaatgatcatggccctggtgagcgacagcgccctgttcaacaccagagagggcagagccggcaaggtgcacaacttcatgctgggcctgaacctgaacaccagctaccccctgagccccctgagcgacttcgccacccaggacagcttcgacgacgacgagctggacgccgccgtggccgaccccgacgagttcgagagaatctacgagcccctggacgtgaagagcaagaagatccacgtggtggacagcggcctgaccttcaacctgccctaccccctgatcctgagaccccagagaggcgtggacctgatcatcagcttcgacttcagcgccagacccagcgacagcagcccccccttcaaggagctgctgctggccgagaagtgggccaagatgaacaagctgcccttccccaagatcgacccctacgtgttcgacagagagggcctgaaggagtgctacgtgttcaagcccaagaaccccgacatggagaaggactgccccaccatcatccacttcgtgctggccaacatcaacttcagaaagtacagagcccccggcgtgcccagagagaccgaggaggagaaggagatcgccgacttcgacatcttcgacgaccccgagagccccttcagcaccttcaacttccagtaccccaaccaggccttcaagagactgcacgacctgatgcacttcaacaccctgaacaacatcgacgtgatcaaggaggccatggtggagagcatcgagtacagaagacagaaccccagcagatgcagcgtgagcctgagcaacgtggaggccagaagattcttcaacaaggagttcctgagcaagcccaaggcctag

SEQ ID NO: 12149 - DNA, 2346 bp, Artificial Sequence
  Description of Artificial Sequence: Synthetic coding sequence
atggccgtggccgaggtgagcagaacctgcctgctgaccgtgagagtgctgcaggcccacagactgcccagcaaggacctggtgacccccagcgactgctacgtgaccctgtggctgcccaccgcctgcagccacagactgcagaccagaaccgtgaagaacagcagcagccccgtgtggaaccagagcttccacttcagaatccacagacagctgaagaacgtgatggagctgaaggtgttcgaccaggacctggtgaccggcgacgaccccgtgctgagcgtgctgttcgacgccggcaccctgagagccggcgagttcagaagagagagcttcagcctgagcccccagggcgagggcagactggaggtggagttcagactgcagagcctggccgacagaggcgagtggctggtgagcaacggcgtgctggtggccagagagctgagctgcctgcacgtgcagctggaggagaccggcgaccagaagagcagcgagcacagagtgcagctggtggtgcccggcagctgcgagggcccccaggaggccagcgtgggcaccggcaccttcagattccactgccccgcctgctgggagcaggagctgagcatcagactgcaggacgcccccgaggagcagctgaaggcccccctgagcgccctgcccagcggccaggtggtgagactggtgttccccaccagccaggagcccctgatgagagtggagctgaagaaggaggccggcctgagagagctggccgtgagactgggcttcggcccctgcgccgaggagcaggccttcctgagcagaagaaagcaggtggtggccgccgccctgagacaggccctgcagctggacggcgacctgcaggaggacgagatccccgtggtggccatcatggccaccggcggcggcatcagagccatgaccagcctgtacggccagctggccggcctgaaggagctgggcctgctggactgcgtgagctacatcaccggcgccagcggcagcacctgggccctggccaacctgtacgaggaccccgagtggagccagaaggacctggccggccccaccgagctgctgaagacccaggtgaccaagaacaagctgggcgtgctggcccccagccagctgcagagatacagacaggagctggccgagagagccagactgggctaccccagctgcttcaccaacctgtgggccctgatcaacgaggccctgctgcacgacgagccccacgaccacaagctgagcgaccagagagaggccctgagccacggccagaaccccctgcccatctactgcgccctgaacaccaagggccagagcctgaccaccttcgagttcggcgagtggtgcgagttcagcccctacgaggtgggcttccccaagtacggcgccttcatccccagcgagctgttcggcagcgagttcttcatgggccagctgatgaagagactgcccgagagcagaatctgcttcctggagggcatctggagcaacctgtacgccgccaacctgcaggacagcctgtactgggccagcgagcccagccagttctgggacagatgggtgagaaaccaggccaacctggacaaggagcaggtgcccctgctgaagatcgaggagccccccagcaccgccggcagaatcgccgagttcttcaccgacctgctgacctggagacccctggcccaggccacccacaacttcctgagaggcctgcacttccacaaggactacttccagcacccccacttcagcacctggaaggccaccaccctggacggcctgcccaaccagctgacccccagcgagccccacctgtgcctgctggacgtgggctacctgatcaacaccagctgcctgcccctgctgcagcccaccagagacgtggacctgatcctgagcctggactacaacctgcacggcgccttccagcagctgcagctgctgggcagattctgccaggagcagggcatccccttcccccccatcagccccagccccgaggagcagctgcagcccagagagtgccacaccttcagcgaccccacctgccccggcgcccccgccgtgctgcacttccccctggtgagcgacagcttcagagagtacagcgcccccggcgtgagaagaacccccgaggaggccgccgccggcgaggtgaacctgagcagcagcgacagcccctaccactacaccaaggtgacctacagccaggaggacgtggacaagctgctgcacctgacccactacaacgtgtgcaacaaccaggagcagctgctggaggccctgagacaggccgtgcagagaagaagacagagaagaccccactag

SEQ ID NO: 12150 - DNA, 417 bp, Artificial Sequence
  Description of Artificial Sequence: Synthetic coding sequence
atgaagggcctgctgcccctggcctggttcctggcctgcagcgtgcccgccgtgcagggcggcctgctggacctgaagagcatgatcgagaaggtgaccggcaagaacgccctgaccaactacggcttctacggctgctactgcggctggggcggcagaggcacccccaaggacggcaccgactggtgctgctgggcccacgaccactgctacggcagactggaggagaagggctgcaacatcagaacccagagctacaagtacagattcgcctggggcgtggtgacctgcgagcccggccccttctgccacgtgaacctgtgcgcctgcgacagaaagctggtgtactgcctgaagagaaacctgagaagctacaacccccagtaccagtacttccccaacatcctgtgcagctag

SEQ ID NO: 12151 - DNA, 2421 bp, Artificial Sequence
  Description of Artificial Sequence: Synthetic coding sequence
atgcagttcttcggcagactggtgaacaccttcagcggcgtgaccaacctgttcagcaaccccttcagagtgaaggaggtggccgtggccgactacaccagcagcgacagagtgagagaggagggccagctgatcctgttccagaacacccccaacagaacctgggactgcgtgctggtgaaccccagaaacagccagagcggcttcagactgttccagctggagctggaggccgacgccctggtgaacttccaccagtacagcagccagctgctgcccttctacgagagcagcccccaggtgctgcacaccgaggtgctgcagcacctgaccgacctgatcagaaaccaccccagctggagcgtggcccacctggccgtggagctgggcatcagagagtgcttccaccacagcagaatcatcagctgcgccaactgcgccgagaacgaggagggctgcacccccctgcacctggcctgcagaaagggcgacggcgagatcctggtggagctggtgcagtactgccacacccagatggacgtgaccgactacaagggcgagaccgtgttccactacgccgtgcagggcgacaacagccaggtgctgcagctgctgggcagaaacgccgtggccggcctgaaccaggtgaacaaccagggcctgacccccctgcacctggcctgccagctgggcaagcaggagatggtgagagtgctgctgctgtgcaacgccagatgcaacatcatgggccccaacggctaccccatccacagcgccatgaagttcagccagaagggctgcgccgagatgatcatcagcatggacagcagccagatccacagcaaggaccccagatacggcgccagccccctgcactgggccaagaacgccgagatggccagaatgctgctgaagagaggctgcaacgtgaacagcaccagcagcgccggcaacaccgccctgcacgtggccgtgatgagaaacagattcgactgcgccatcgtgctgctgacccacggcgccaacgccgacgccagaggcgagcacggcaacacccccctgcacctggccatgagcaaggacaacgtggagatgatcaaggccctgatcgtgttcggcgccgaggtggacacccccaacgacttcggcgagacccccaccttcctggccagcaagatcggcagactggtgaccagaaaggccatcctgaccctgctgagaaccgtgggcgccgagtactgcttcccccccatccacggcgtgcccgccgagcagggcagcgccgccccccaccaccccttcagcctggagagagcccagcccccccccatcagcctgaacaacctggagctgcaggacctgatgcacatcagcagagccagaaagcccgccttcatcctgggcagcatgagagacgagaagagaacccacgaccacctgctgtgcctggacggcggcggcgtgaagggcctgatcatcatccagctgctgatcgccatcgagaaggccagcggcgtggccaccaaggacctgttcgactgggtggccggcaccagcaccggcggcatcctggccctggccatcctgcacagcaagagcatggcctacatgagaggcatgtacttcagaatgaaggacgaggtgttcagaggcagcagaccctacgagagcggccccctggaggagttcctgaagagagagttcggcgagcacaccaagatgaccgacgtgagaaagcccaaggtgatgctgaccggcaccctgagcgacagacagcccgccgagctgcacctgttcagaaactacgacgcccccgagaccgtgagagagcccagattcaaccagaacgtgaacctgagaccccccgcccagcccagcgaccagctggtgtggagagccgccagaagcagcggcgccgcccccacctacttcagacccaacggcagattcctggacggcggcctgctggccaacaaccccaccctggacgccatgaccgagatccacgagtacaaccaggacctgatcagaaagggccaggccaacaaggtgaagaagctgagcatcgtggtgagcctgggcaccggcagaagcccccaggtgcccgtgacctgcgtggacgtgttcagacccagcaacccctgggagctggccaagaccgtgttcggcgccaaggagctgggcaagatggtggtggactgctgcaccgaccccgacggcagagccgtggacagagccagagcctggtgcgagatggtgggcatccagtacttcagactgaacccccagctgggcaccgacatcatgctggacgaggtgagcgacaccgtgctggtgaacgccctgtgggagaccgaggtgtacatctacgagcacagagaggagttccagaagctgatccagctgctgctgagcccctag

SEQ ID NO: 12152 - DNA, 1284 bp, Artificial Sequence
  Description of Artificial Sequence: Synthetic coding sequence
atgcagttcttcggcagactggtgaacaccttcagcggcgtgaccaacctgttcagcaaccccttcagagtgaaggaggtggccgtggccgactacaccagcagcgacagagtgagagaggagggccagctgatcctgttccagaacacccccaacagaacctgggactgcgtgctggtgaaccccagaaacagccagagcggcttcagatgcgccaactgcgccgagaacgaggagggctgcacccccctgcacctggcctgcagaaagggcgacggcgagatcctggtggagctggtgcagtactgccacacccagatggacgtgaccgactacaagggcgagaccgtgttccactacgccgtgcagggcgacaacagccaggtgctgcagctgctgggcagaaacgccgtggccggcctgaaccaggtgaacaaccagggcctgacccccctgcacctggcctgccagctgggcaagcaggagatggtgagagtgctgctgctgtgcaacgccagatgcaacatcatgggccccaacggctaccccatccacagcgccatgaagttcagccagaagggctgcgccgagatgatcatcagcatggacagcagccagatccacagcaaggaccccagatacggcgccagccccctgcactgggccaagaacgccgagatggccagaatgctgctgaagagaggctgcaacgtgaacagcaccagcagcgccggcaacaccgccctgcacgtggccgtgatgagaaacagattcgactgcgccatcgtgctgctgacccacggcgccaacgccgacgccagaggcgagcacggcaacacccccctgcacctggccatgagcaaggacaacgtggagatgatcaaggccctgatcgtgttcggcgccgaggtggacacccccaacgacttcggcgagacccccaccttcctggccagcaagatcggcagactggtgaccagaaaggccatcctgaccctgctgagaaccgtgggcgccgagtactgcttcccccccatccacggcgtgcccgccgagcagggcagcgccgccccccaccaccccttcagcctggagagagcccagcccccccccatcagcctgaacaacctgggcagccaccccagccaggccggctggtgggcctggggcgccgccagcgacggcaccaccggcagccacgcccacctgaccggccccgaggccagcgtgcaccccggcctgcacgagggcagagaggccgacagacagaacatggagagctag

SEQ ID NO: 12153 - DNA, 2259 bp, Artificial Sequence
  Description of Artificial Sequence: Synthetic coding sequence
atgcagttcttcggcagactggtgaacaccttcagcggcgtgaccaacctgttcagcaaccccttcagagtgaaggaggtggccgtggccgactacaccagcagcgacagagtgagagaggagggccagctgatcctgttccagaacacccccaacagaacctgggactgcgtgctggtgaaccccagaaacagccagagcggcttcagactgttccagctggagctggaggccgacgccctggtgaacttccaccagtacagcagccagctgctgcccttctacgagagcagcccccaggtgctgcacaccgaggtgctgcagcacctgaccgacctgatcagaaaccaccccagctggagcgtggcccacctggccgtggagctgggcatcagagagtgcttccaccacagcagaatcatcagctgcgccaactgcgccgagaacgaggagggctgcacccccctgcacctggcctgcagaaagggcgacggcgagatcctggtggagctggtgcagtactgccacacccagatggacgtgaccgactacaagggcgagaccgtgttccactacgccgtgcagggcgacaacagccaggtgctgcagctgctgggcagaaacgccgtggccggcctgaaccaggtgaacaaccagggcctgacccccctgcacctggcctgccagctgggcaagcaggagatggtgagagtgctgctgctgtgcaacgccagatgcaacatcatgggccccaacggctaccccatccacagcgccatgaagttcagccagaagggctgcgccgagatgatcatcagcatggacagcagccagatccacagcaaggaccccagatacggcgccagccccctgcactgggccaagaacgccgagatggccagaatgctgctgaagagaggctgcaacgtgaacagcaccagcagcgccggcaacaccgccctgcacgtggccgtgatgagaaacagattcgactgcgccatcgtgctgctgacccacggcgccaacgccgacgccagaggcgagcacggcaacacccccctgcacctggccatgagcaaggacaacgtggagatgatcaaggccctgatcgtgttcggcgccgaggtggacacccccaacgacttcggcgagacccccaccttcctggccagcaagatcggcagacagctgcaggacctgatgcacatcagcagagccagaaagcccgccttcatcctgggcagcatgagagacgagaagagaacccacgaccacctgctgtgcctggacggcggcggcgtgaagggcctgatcatcatccagctgctgatcgccatcgagaaggccagcggcgtggccaccaaggacctgttcgactgggtggccggcaccagcaccggcggcatcctggccctggccatcctgcacagcaagagcatggcctacatgagaggcatgtacttcagaatgaaggacgaggtgttcagaggcagcagaccctacgagagcggccccctggaggagttcctgaagagagagttcggcgagcacaccaagatgaccgacgtgagaaagcccaaggtgatgctgaccggcaccctgagcgacagacagcccgccgagctgcacctgttcagaaactacgacgcccccgagaccgtgagagagcccagattcaaccagaacgtgaacctgagaccccccgcccagcccagcgaccagctggtgtggagagccgccagaagcagcggcgccgcccccacctacttcagacccaacggcagattcctggacggcggcctgctggccaacaaccccaccctggacgccatgaccgagatccacgagtacaaccaggacctgatcagaaagggccaggccaacaaggtgaagaagctgagcatcgtggtgagcctgggcaccggcagaagcccccaggtgcccgtgacctgcgtggacgtgttcagacccagcaacccctgggagctggccaagaccgtgttcggcgccaaggagctgggcaagatggtggtggactgctgcaccgaccccgacggcagagccgtggacagagccagagcctggtgcgagatggtgggcatccagtacttcagactgaacccccagctgggcaccgacatcatgctggacgaggtgagcgacaccgtgctggtgaacgccctgtgggagaccgaggtgtacatctacgagcacagagaggagttccagaagctgatccagctgctgctgagcccctag

SEQ ID NO: 12154 - DNA, 1440 bp, Artificial Sequence
  Description of Artificial Sequence: Synthetic coding sequence
atgcagttcttcggcagactggtgaacaccttcagcggcgtgaccaacctgttcagcaaccccttcagagtgaaggaggtggccgtggccgactacaccagcagcgacagagtgagagaggagggccagctgatcctgttccagaacacccccaacagaacctgggactgcgtgctggtgaaccccagaaacagccagagcggcttcagactgttccagctggagctggaggccgacgccctggtgaacttccaccagtacagcagccagctgctgcccttctacgagagcagcccccaggtgctgcacaccgaggtgctgcagcacctgaccgacctgatcagaaaccaccccagctggagcgtggcccacctggccgtggagctgggcatcagagagtgcttccaccacagcagaatcatcagctgcgccaactgcgccgagaacgaggagggctgcacccccctgcacctggcctgcagaaagggcgacggcgagatcctggtggagctggtgcagtactgccacacccagatggacgtgaccgactacaagggcgagaccgtgttccactacgccgtgcagggcgacaacagccaggtgctgcagctgctgggcagaaacgccgtggccggcctgaaccaggtgaacaaccagggcctgacccccctgcacctggcctgccagctgggcaagcaggagatggtgagagtgctgctgctgtgcaacgccagatgcaacatcatgggccccaacggctaccccatccacagcgccatgaagttcagccagaagggctgcgccgagatgatcatcagcatggacagcagccagatccacagcaaggaccccagatacggcgccagccccctgcactgggccaagaacgccgagatggccagaatgctgctgaagagaggctgcaacgtgaacagcaccagcagcgccggcaacaccgccctgcacgtggccgtgatgagaaacagattcgactgcgccatcgtgctgctgacccacggcgccaacgccgacgccagaggcgagcacggcaacacccccctgcacctggccatgagcaaggacaacgtggagatgatcaaggccctgatcgtgttcggcgccgaggtggacacccccaacgacttcggcgagacccccaccttcctggccagcaagatcggcagactggtgaccagaaaggccatcctgaccctgctgagaaccgtgggcgccgagtactgcttcccccccatccacggcgtgcccgccgagcagggcagcgccgccccccaccaccccttcagcctggagagagcccagcccccccccatcagcctgaacaacctggagctgcaggacctgatgcacatcagcagagccagaaagcccgccttcatcctgggcagcatgagagacgagaagagaaccgacagaacctag

SEQ ID NO: 12155 - DNA, 2259 bp, Artificial Sequence; identical to SEQ ID NO: 12153
  Description of Artificial Sequence: Synthetic coding sequence

SEQ ID NO: 12156 - DNA, 2004 bp, Artificial Sequence
  Description of Artificial Sequence: Synthetic coding sequence
atgcagttcttcggcagactggtgaacaccttcagcggcgtgaccaacctgttcagcaaccccttcagagtgaaggaggtggccgtggccgactacaccagcagcgacagagtgagagaggagggccagctgatcctgttccagaacacccccaacagaacctgggactgcgtgctggtgaaccccagaaacagccagagcggcttcagactgttccagctggagctggaggccgacgccctggtgaacttccaccagtacagcagccagctgggcaagcaggagatggtgagagtgctgctgctgtgcaacgccagatgcaacatcatgggccccaacggctaccccatccacagcgccatgaagttcagccagaagggctgcgccgagatgatcatcagcatggacagcagccagatccacagcaaggaccccagatacggcgccagccccctgcactgggccaagaacgccgagatggccagaatgctgctgaagagaggctgcaacgtgaacagcaccagcagcgccggcaacaccgccctgcacgtggccgtgatgagaaacagattcgactgcgccatcgtgctgctgacccacggcgccaacgccgacgccagaggcgagcacggcaacacccccctgcacctggccatgagcaaggacaacgtggagatgatcaaggccctgatcgtgttcggcgccgaggtggacacccccaacgacttcggcgagacccccaccttcctggccagcaagatcggcagactggtgaccagaaaggccatcctgaccctgctgagaaccgtgggcgccgagtactgcttcccccccatccacggcgtgcccgccgagcagggcagcgccgccccccaccaccccttcagcctggagagagcccagcccccccccatcagcctgaacaacctggagctgcaggacctgatgcacatcagcagagccagaaagcccgccttcatcctgggcagcatgagagacgagaagagaacccacgaccacctgctgtgcctggacggcggcggcgtgaagggcctgatcatcatccagctgctgatcgccatcgagaaggccagcggcgtggccaccaaggacctgttcgactgggtggccggcaccagcaccggcggcatcctggccctggccatcctgcacagcaagagcatggcctacatgagaggcatgtacttcagaatgaaggacgaggtgttcagaggcagcagaccctacgagagcggccccctggaggagttcctgaagagagagttcggcgagcacaccaagatgaccgacgtgagaaagcccaaggtgatgctgaccggcaccctgagcgacagacagcccgccgagctgcacctgttcagaaactacgacgcccccgagaccgtgagagagcccagattcaaccagaacgtgaacctgagaccccccgcccagcccagcgaccagctggtgtggagagccgccagaagcagcggcgccgcccccacctacttcagacccaacggcagattcctggacggcggcctgctggccaacaaccccaccctggacgccatgaccgagatccacgagtacaaccaggacctgatcagaaagggccaggccaacaaggtgaagaagctgagcatcgtggtgagcctgggcaccggcagaagcccccaggtgcccgtgacctgcgtggacgtgttcagacccagcaacccctgggagctggccaagaccgtgttcggcgccaaggagctgggcaagatggtggtggactgctgcaccgaccccgacggcagagccgtggacagagccagagcctggtgcgagatggtgggcatccagtacttcagactgaacccccagctgggcaccgacatcatgctggacgaggtgagcgacaccgtgctggtgaacgccctgtgggagaccgaggtgtacatctacgagcacagagaggagttccagaagctgatccagctgctgctgagcccctag

SEQ ID NO: 12157 - DNA, 501 bp, Artificial Sequence
  Description of Artificial Sequence: Synthetic coding sequence
atgcagttcttcggcagactggtgaacaccttcagcggcgtgaccaacctgttcagcaaccccttcagagtgaaggaggtggccgtggccgactacaccagcagcgacagagtgagagaggagggccagctgatcctgttccagaacacccccaacagaacctgggactgcgtgctggtgaaccccagaaacagccagagcggcttcagatgcgccaactgcgccgagaacgaggagggctgcacccccctgcacctggcctgcagaaagggcgacggcgagatcctggtggagctggtgcagtactgccacacccagatggacgtgaccgactacaagggcgagaccgtgttccactacgccgtgcagggcgacaacagccaggtgctgcagctgctgggcagaaacgccgtggccggcctgaaccaggtgaacaaccagggcctgacccccctgcacctggcctgccagctgggcaagcaggagatggtgagagtgtag

SEQ ID NO: 12158 - DNA, 1299 bp, Artificial Sequence
  Description of Artificial Sequence: Synthetic coding sequence
atgcagttcttcggcagactggtgaacaccttcagcggcgtgaccaacctgttcagcaaccccttcagagtgaaggaggtggccgtggccgactacaccagcagcgacagagtgagagaggagggccagctgatcctgttccagaacacccccaacagaacctgggactgcgtgctggtgaaccccagaaacagccagagcggcttcagactgttccagctggagctggaggccgacgccctggtgaacttccaccagtacagcagccagctgctgcccttctacgagagcagcccccaggtgctgcacaccgaggtgctgcagcacctgaccgacctgatcagaaaccaccccagctggagcgtggcccacctggccgtggagctgggcatcagagagtgcttccaccacagcagaatcatcagagtgagaagcgcccaccaggtgcccggcctgtgggagctgatcagcacccaccacgagatcgagttcagccagcccccccaggccgtgcccatcgccagaagaaccagaagagccgcccacccctgcacctggcccgccgccagagtgatgggcagaagctggtggagctggtgcagcaccgccaccctgagatggatgagccccaccaccagagagagacccagcagcatcatgctgagcagagtgaccatcctgagatgctgcagatgcgccgagatgatcatcagcatggacagcagccagatccacagcaaggaccccagatacggcgccagccccctgcactgggccaagaacgccgagatggccagaatgctgctgaagagaggctgcaacgtgaacagcaccagcagcgccggcaacaccgccctgcacgtggccgtgatgagaaacagattcgactgcgccatcgtgctgctgacccacggcgccaacgccgacgccagaggcgagcacggcaacacccccctgcacctggccatgagcaaggacaacgtggagatgatcaaggccctgatcgtgttcggcgccgaggtggacacccccaacgacttcggcgagacccccaccttcctggccagcaagatcggcagactggtgaccagaaaggccatcctgaccctgctgagaaccgtgggcgccgagtactgcttcccccccatccacggcgtgcccgccgagcagggcagcgccgccccccaccaccccttcagcctggagagagcccagcccccccccatcagcctgaacaacctgggcagccaccccagccaggccggctggtgggcctggggcgccgccagcgacggctag

SEQ ID NO: 12159 - DNA, 243 bp, Artificial Sequence
  Description of Artificial Sequence: Synthetic coding sequence
atgcagttcttcggcagactggtgaacaccttcagcggcgtgaccaacctgttcagcaaccccttcagagtgaaggaggtggccgtggccgactacaccagcagcgacagagtgagagaggagggccagctgatcctgttccagaacacccccaacagaacctgggactgcgtgctggtgaaccccagaaacagccagagcggcttcagactgttccagctggagctggaggccgacgcctag

SEQ ID NO: 12160 - DNA, 498 bp, Artificial Sequence
  Description of Artificial Sequence: Synthetic coding sequence
atgggccccctgcccgtgtgcctgcccatcatgctgctgctgctgctgcccagcctgctgctgctgctgctgctgcccggccccggcagcggcgaggccagcagaatcctgagagtgcacagaagaggcatcctggagctggccggcaccgtgggctgcgtgggccccagaacccccatcgcctacatgaagtacggctgcttctgcggcctgggcggccacggccagcccagagacgccatcgactggtgctgccacggccacgactgctgctacaccagagccgaggaggccggctgcagccccaagaccgagagatacagctggcagtgcgtgaaccagagcgtgctgtgcggccccgccgagaacaagtgccaggagctgctgtgcaagtgcgaccaggagatcgccaactgcctggcccagaccgagtacaacctgaagtacctgttctacccccagttcctgtgcgagcccgacagccccaagtgcgactag

SEQ ID NO: 12161 - DNA, 498 bp, Artificial Sequence; identical to SEQ ID NO: 12160
  Description of Artificial Sequence: Synthetic coding sequence

SEQ ID NO: 12162 - DNA, 570 bp, Artificial Sequence
  Description of Artificial Sequence: Synthetic coding sequence
atggccctgctgagcagacccgccctgaccctgctgctgctgctgatggccgccgtggtgagatgccaggagcaggcccagaccaccgactggagagccaccctgaagaccatcagaaacggcgtgcacaagatcgacacctacctgaacgccgccctggacctgctgggcggcgaggacggcctgtgccagtacaagtgcagcgacggcagcaagcccttccccagatacggctacaagcccagcccccccaacggctgcggcagccccctgttcggcgtgcacctgaacatcggcatccccagcctgaccaagtgctgcaaccagcacgacagatgctacgagacctgcggcaagagcaagaacgactgcgacgaggagttccagtactgcctgagcaagatctgcagagacgtgcagaagaccctgggcctgacccagcacgtgcaggcctgcgagaccaccgtggagctgctgttcgacagcgtgatccacctgggctgcaagccctacctggacagccagagagccgcctgcagatgccactacgaggagaagaccgacctgtag

SEQ ID NO: 12163 - DNA, 213 bp, Artificial Sequence
  Description of Artificial Sequence: Synthetic coding sequence
atggccctgctgagcagacccgccctgaccctgctgctgctgctgatggccgccgtggtgagatgccaggagcaggcccagaccaccgactggagagccaccctgaagaccatcagaaacggcgtgcacaagatcgacacctacctgaacgccgccctggacctgctgggcggcgaggacggcctgtgccagtacaagtgcagcgacgcctag

SEQ ID NO: 12164 - DNA, 588 bp, Artificial Sequence
  Description of Artificial Sequence: Synthetic coding sequence
atgaagctggccagcggcttcctggtgctgtggctgagcctgggcggcggcctggcccagagcgacaccagccccgacaccgaggagagctacagcgactggggcctgagacacctgagaggcagcttcgagagcgtgaacagctacttcgacagcttcctggagctgctgggcggcaagaacggcgtgtgccagtacagatgcagatacggcaaggcccccatgcccagacccggctacaagccccaggagcccaacggctgcggcagctacttcctgggcctgaaggtgcccgagagcatggacctgggcatccccgccatgaccaagtgctgcaaccagctggacgtgtgctacgacacctgcggcgccaacaagtacagatgcgacgccaagttcagatggtgcctgcacagcatctgcagcgacctgaagagaagcctgggcttcgtgagcaaggtggaggccgcctgcgacagcctggtggacaccgtgttcaacaccgtgtggaccctgggctgcagacccttcatgaacagccagagagccgcctgcatctgcgccgaggaggagaaggaggagctgtag

SEQ ID NO: 12165 - DNA, 3876 bp, Artificial Sequence
  Description of Artificial Sequence: Synthetic coding sequence
atggccggcgccgccagcccctgcgccaacggctgcggccccggcgcccccagcgacgccgaggtgctgcacctgtgcagaagcctggaggtgggcaccgtgatgaccctgttctacagcaagaagagccagagacccgagagaaagaccttccaggtgaagctggagaccagacagatcacctggagcagaggcgccgacaagatcgagggcgccatcgacatcagagagatcaaggagatcagacccggcaagaccagcagagacttcgacagataccaggaggaccccgccttcagacccgaccagagccactgcttcgtgatcctgtacggcatggagttcagactgaagaccctgagcctgcaggccaccagcgaggacgaggtgaacatgtggatcaagggcctgacctggctgatggaggacaccctgcaggcccccacccccctgcagatcgagagatggctgagaaagcagttctacagcgtggacagaaacagagaggacagaatcagcgccaaggacctgaagaacatgctgagccaggtgaactacagagtgcccaacatgagattcctgagagagagactgaccgacctggagcagagaagcggcgacatcacctacggccagttcgcccagctgtacagaagcctgatgtacagcgcccagaagaccatggacctgcccttcctggaggccagcaccctgagagccggcgagagacccgagctgtgcagagtgagcctgcccgagttccagcagttcctgctggactaccagggcgagctgtgggccgtggacagactgcaggtgcaggagttcatgctgagcttcctgagagaccccctgagagagatcgaggagccctacttcttcctggacgagttcgtgaccttcctgttcagcaaggagaacagcgtgtggaacagccagctggacgccgtgtgccccgacaccatgaacaaccccctgagccactactggatcagcagcagccacaacacctacctgaccggcgaccagttcagcagcgagagcagcctggaggcctacgccagatgcctgagaatgggctgcagatgcatcgagctggactgctgggacggccccgacggcatgcccgtgatctaccacggccacaccctgaccaccaagatcaagttcagcgacgtgctgcacaccatcaaggagcacgccttcgtggccagcgagtaccccgtgatcctgagcatcgaggaccactgcagcatcgcccagcagagaaacatggcccagtacttcaagaaggtgctgggcgacaccctgctgaccaagcccgtggagatcagcgccgacggcctgcccagccccaaccagctgaagagaaagatcctgatcaagcacaagaagctggccgagggcagcgcctacgaggaggtgcccaccagcatgatgtacagcgagaacgacatcagcaacagcatcaagaacggcatcctgtacctggaggaccccgtgaaccacgagtggtacccccactacttcgtgctgaccagcagcaagatctactacagcgaggagaccagcagcgaccagggcaacgaggacgaggaggagcccaaggaggtgagcagcagcaccgagctgcacagcaacgagaagtggttccacggcaagctgggcgccggcagagacggcagacacatcgccgagagactgctgaccgagtactgcatcgagaccggcgcccccgacggcagcttcctggtgagagagagcgagaccttcgtgggcgactacaccctgagcttctggagaaacggcaaggtgcagcactgcagaatccacagcagacaggacgccggcacccccaagttcttcctgaccgacaacctggtgttcgacagcctgtacgacctgatcacccactaccagcaggtgcccctgagatgcaacgagttcgagatgagactgagcgagcccgtgccccagaccaacgcccacgagagcaaggagtggtaccacgccagcctgaccagagcccaggccgagcacatgctgatgagagtgcccagagacggcgccttcctggtgagaaagagaaacgagcccaacagctacgccatcagcttcagagccgagggcaagatcaagcactgcagagtgcagcaggagggccagaccgtgatgctgggcaacagcgagttcgacagcctggtggacctgatcagctactacgagaagcaccccctgtacagaaagatgaagctgagataccccatcaacgaggaggccctggagaagatcggcaccgccgagcccgactacggcgccctgtacgagggcagaaaccccggcttctacgtggaggccaaccccatgcccaccttcaagtgcgccgtgaaggccctgttcgactacaaggcccagagagaggacgagctgaccttcatcaagagcgccatcatccagaacgtggagaagcaggagggcggctggtggagaggcgactacggcggcaagaagcagctgtggttccccagcaactacgtggaggagatggtgaaccccgtggccctggagcccgagagagagcacctggacgagaacagccccctgggcgacctgctgagaggcgtgctggacgtgcccgcctgccagatcgccatcagacccgagggcaagaacaacagactgttcgtgttcagcatcagcatggccagcgtggcccactggagcctggacgtggccgccgacagccaggaggagctgcaggactgggtgaagaagatcagagaggtggcccagaccgccgacgccagactgaccgagggcaagatcatggagagaagaaagaagatcgccctggagctgagcgagctggtggtgtactgcagacccgtgcccttcgacgaggagaagatcggcaccgagagagcctgctacagagacatgagcagcttccccgagaccaaggccgagaagtacgtgaacaaggccaagggcaagaagttcctgcagtacaacagactgcagctgagcagaatctaccccaagggccagagactggacagcagcaactacgaccccctgcccatgtggatctgcggcagccagctggtggccctgaacttccagacccccgacaagcccatgcagatgaaccaggccctgttcatgaccggcagacactgcggctacgtgctgcagcccagcaccatgagagacgaggccttcgaccccttcgacaagagcagcctgagaggcctggagccctgcgccatcagcatcgaggtgctgggcgccagacacctgcccaagaacggcagaggcatcgtgtgccccttcgtggagatcgaggtggccggcgccgagtacgacagcaccaagcagaagaccgagttcgtggtggacaacggcctgaaccccgtgtggcccgccaagcccttccacttccagatcagcaaccccgagttcgccttcctgagattcgtggtgtacgaggaggacatgttcagcgaccagaacttcctggcccaggccaccttccccgtgaagggcctgaagaccggctacagagccgtgcccctgaagaacaactacagcgaggacctggagctggccagcctgctgatcaagatcgacatcttccccgccaagcaggagaacggcgacctgagccccttcagcggcaccagcctgagagagagaggcagcgacgccagcggccagctgttccacggcagagccagagagggcagcttcgagagcagataccagcagcccttcgaggacttcagaatcagccaggagcacctggccgaccacttcgacagcagagagagaagagcccccagaagaaccagagtgaacggcgacaacagactgtag

SEQ ID NO: 12166 - DNA, 3873 bp, Artificial Sequence
  Description of Artificial Sequence: Synthetic coding sequence
atggccggcgccgccagcccctgcgccaacggctgcggccccggcgcccccagcgacgccgaggtgctgcacctgtgcagaagcctggaggtgggcaccgtgatgaccctgttctacagcaagaagagccagagacccgagagaaagaccttccaggtgaagctggagaccagacagatcacctggagcagaggcgccgacaagatcgagggcgccatcgacatcagagagatcaaggagatcagacccggcaagaccagcagagacttcgacagataccaggaggaccccgccttcagacccgaccagagccactgcttcgtgatcctgtacggcatggagttcagactgaagaccctgagcctgcaggccaccagcgaggacgaggtgaacatgtggatcaagggcctgacctggctgatggaggacaccctgcaggcccccacccccctgcagatcgagagatggctgagaaagcagttctacagcgtggacagaaacagagaggacagaatcagcgccaaggacctgaagaacatgctgagccaggtgaactacagagtgcccaacatgagattcctgagagagagactgaccgacctggagcagagaagcggcgacatcacctacggccagttcgcccagctgtacagaagcctgatgtacagcgcccagaagaccatggacctgcccttcctggaggccagcaccctgagagccggcgagagacccgagctgtgcagagtgagcctgcccgagttccagcagttcctgctggactaccagggcgagctgtgggccgtggacagactgcaggtgcaggagttcatgctgagcttcctgagagaccccctgagagagatcgaggagccctacttcttcctggacgagttcgtgaccttcctgttcagcaaggagaacagcgtgtggaacagccagctggacgccgtgtgccccgacaccatgaacaaccccctgagccactactggatcagcagcagccacaacacctacctgaccggcgaccagttcagcagcgagagcagcctggaggcctacgccagatgcctgagaatgggctgcagatgcatcgagctggactgctgggacggccccgacggcatgcccgtgatctaccacggccacaccctgaccaccaagatcaagttcagcgacgtgctgcacaccatcaaggagcacgccttcgtggccagcgagtaccccgtgatcctgagcatcgaggaccactgcagcatcgcccagcagagaaacatggcccagtacttcaagaaggtgctgggcgacaccctgctgaccaagcccgtggagatcagcgccgacggcctgcccagccccaaccagctgaagagaaagatcctgatcaagcacaagaagctggccgagggcagcgcctacgaggaggtgcccaccagcatgatgtacagcgagaacgacatcagcaacagcatcaagaacggcatcctgtacctggaggaccccgtgaaccacgagtggtacccccactacttcgtgctgaccagcagcaagatctactacagcgaggagaccagcagcgaccagggcaacgaggacgaggaggagcccaaggaggtgagcagcagcaccgagctgcacagcaacgagaagtggttccacggcaagctgggcgccggcagagacggcagacacatcgccgagagactgctgaccgagtactgcatcgagaccggcgcccccgacggcagcttcctggtgagagagagcgagaccttcgtgggcgactacaccctgagcttctggagaaacggcaaggtgcagcactgcagaatccacagcagacaggacgccggcacccccaagttcttcctgaccgacaacctggtgttcgacagcctgtacgacctgatcacccactaccagcaggtgcccctgagatgcaacgagttcgagatgagactgagcgagcccgtgccccagaccaacgcccacgagagcaaggagtggtaccacgccagcctgaccagagcccaggccgagcacatgctgatgagagtgcccagagacggcgccttcctggtgagaaagagaaacgagcccaacagctacgccatcagcttcagagccgagggcaagatcaagcactgcagagtgcagcaggagggccagaccgtgatgctgggcaacagcgagttcgacagcctggtggacctgatcagctactacgagaagcaccccctgtacagaaagatgaagctgagataccccatcaacgaggaggccctggagaagatcggcaccgccgagcccgactacggcgccctgtacgagggcagaaaccccggcttctacgtggaggccaaccccatgcccaccttcaagtgcgccgtgaaggccctgttcgactacaaggcccagagagaggacgagctgaccttcatcaagagcgccatcatccagaacgtggagaagcaggagggcggctggtggagaggcgactacggcggcaagaagcagctgtggttccccagcaactacgtggaggagatggtgaaccccgtggccctggagcccgagagagagcacctggacgagaacagccccctgggcgacctgctgagaggcgtgctggacgtgcccgcctgccagatcgccatcagacccgagggcaagaacaacagactgttcgtgttcagcatcagcatggccagcgtggcccactggagcctggacgtggccgccgacagccaggaggagctgcaggactgggtgaagaagatcagagaggtggcccagaccgccgacgccagactgaccgagggcaagatcatggagagaagaaagaagatcgccctggagctgagcgagctggtggtgtactgcagacccgtgcccttcgacgaggagaagatcggcaccgagagagcctgctacagagacatgagcagcttccccgagaccaaggccgagaagtacgtgaacaaggccaagggcaagaagttcctgcagtacaacagactgcagctgagcagaatctaccccaagggccagagactggacagcagcaactacgaccccctgcccatgtggatctgcggcagccagctggtggccctgaacttccagacccccgacaagcccatgcagatgaaccaggccctgttcatgaccggcagacactgcggctacgtgctgcagcccagcaccatgagagacgaggccttcgaccccttcgacaagagcagcctgagaggcctggagccctgcgccatcagcatcgaggtgctgggcgccagacacctgcccaagaacggcagaggcatcgtgtgccccttcgtggagatcgaggtggccggcgccgagtacgacagcaccaagcagaagaccgagttcgtggtggacaacggcctgaaccccgtgtggcccgccaagcccttccacttccagatcagcaaccccgagttcgccttcctgagattcgtggtgtacgaggaggacatgttcagcgaccagaacttcctggcccaggccaccttccccgtgaagggcctgaagaccggctacagagccgtgcccctgaagaacaactacagcgaggacctggagctggccagcctgctgatcaagatcgacatcttccccgccaaggagaacggcgacctgagccccttcagcggcaccagcctgagagagagaggcagcgacgccagcggccagctgttccacggcagagccagagagggcagcttcgagagcagataccagcagcccttcgaggacttcagaatcagccaggagcacctggccgaccacttcgacagcagagagagaagagcccccagaagaaccagagtgaacggcgacaacagactgtag

SEQ ID NO: 12167 - DNA, 3876 bp, Artificial Sequence; identical to SEQ ID NO: 12165
  Description of Artificial Sequence: Synthetic coding sequence

SEQ ID NO: 12168 - DNA, 3798 bp, Artificial Sequence
  Description of Artificial Sequence: Synthetic coding sequence
atgagcaccaccgtgaacgtggacagcctggccgagtacgagaagagccagatcaagagagccctggagctgggcaccgtgatgaccgtgttcagcttcagaaagagcacccccgagagaagaaccgtgcaggtgatcatggagaccagacaggtggcctggagcaagaccgccgacaagatcgagggcttcctggacatcatggagatcaaggagatcagacccggcaagaacagcaaggacttcgagagagccaaggccgtgagacagaaggaggactgctgcttcaccatcctgtacggcacccagttcgtgctgagcaccctgagcctggccgccgacagcaaggaggacgccgtgaactggctgagcggcctgaagatcctgcaccaggaggccatgaacgccagcacccccaccatcatcgagagctggctgagaaagcagatctacagcgtggaccagaccagaagaaacagcatcagcctgagagagctgaagaccatcctgcccctgatcaacttcaaggtgagcagcgccaagttcctgaaggacaagttcgtggagatcggcgcccacaaggacgagctgagcttcgagcagttccacctgttctacaagaagctgatgttcgagcagcagaagagcatcctggacgagttcaagaaggacagcagcgtgttcatcctgggcaacaccgacagacccgacgccagcgccgtgtacctgcacgacttccagagattcctgatccacgagcagcaggagcactgggcccaggacctgaacaaggtgagagagagaatgaccaagttcatcgacgacaccatgagagagaccgccgagcccttcctgttcgtggacgagttcctgacctacctgttcagcagagagaacagcatctgggacgagaagtacgacgccgtggacatgcaggacatgaacaaccccctgagccactactggatcagcagcagccacaacacctacctgaccggcgaccagctgagaagcgagagcagccccgaggcctacatcagatgcctgagaatgggctgcagatgcatcgagctggactgctgggacggccccgacggcaagcccgtgatctaccacggctggaccagaaccaccaagatcaagttcgacgacgtggtgcaggccatcaaggaccacgccttcgtgaccagcagcttccccgtgatcctgagcatcgaggagcactgcagcgtggagcagcagagacacatggccaaggccttcaaggaggtgttcggcgacctgctgctgaccaagcccaccgaggccagcgccgaccagctgcccagccccagccagctgagagagaagatcatcatcaagcacaagaagctgggccccagaggcgacgtggacgtgaacatggaggacaagaaggacgagcacaagcagcagggcgagctgtacatgtgggacagcatcgaccagaagtggaccagacactactgcgccatcgccgacgccaagctgagcttcagcgacgacatcgagcagaccatggaggaggaggtgccccaggacatcccccccaccgagctgcacttcggcgagaagtggttccacaagaaggtggagaagagaaccagcgccgagaagctgctgcaggagtactgcatggagaccggcggcaaggacggcaccttcctggtgagagagagcgagaccttccccaacgactacaccctgagcttctggagaagcggcagagtgcagcactgcagaatcagaagcaccatggagggcggcaccctgaagtactacctgaccgacaacctgaccttcagcagcatctacgccctgatccagcactacagagagacccacctgagatgcgccgagttcgagctgagactgaccgaccccgtgcccaaccccaacccccacgagagcaagccctggtactacgacagcctgagcagaggcgaggccgaggacatgctgatgagaatccccagagacggcgccttcctgatcagaaagagagagggcagcgacagctacgccatcaccttcagagccagaggcaaggtgaagcactgcagaatcaacagagacggcagacacttcgtgctgggcaccagcgcctacttcgagagcctggtggagctggtgagctactacgagaagcacagcctgtacagaaagatgagactgagataccccgtgacccccgagctgctggagagatacaacatggagagagacatcaacagcctgtacgacgtgagcagaatgtacgtggaccccagcgagatcaaccccagcatgccccagagaaccgtgaaggccctgtacgactacaaggccaagagaagcgacgagctgagcttctgcagaggcgccctgatccacaacgtgagcaaggagcccggcggctggtggaagggcgactacggcaccagaatccagcagtacttccccagcaactacgtggaggacatcagcaccgccgacttcgaggagctggagaagcagatcatcgaggacaaccccctgggcagcctgtgcagaggcatcctggacctgaacacctacaacgtggtgaaggccccccagggcaagaaccagaagagcttcgtgttcatcctggagcccaagcagcagggcgacccccccgtggagttcgccaccgacagagtggaggagctgttcgagtggttccagagcatcagagagatcacctggaagatcgacaccaaggagaacaacatgaagtactgggagaagaaccagagcatcgccatcgagctgagcgacctggtggtgtactgcaagcccaccagcaagaccaaggacaacctggagaaccccgacttcagagagatcagaagcttcgtggagaccaaggccgacagcatcatcagacagaagcccgtggacctgctgaagtacaaccagaagggcctgaccagagtgtaccccaagggccagagagtggacagcagcaactacgaccccttcagactgtggctgtgcggcagccagatggtggccctgaacttccagaccgccgacaagtacatgcagatgaaccacgccctgttcagcctgaacggcagaaccggctacgtgctgcagcccgagagcatgagaaccgagaagtacgaccccatgccccccgagagccagagaaagatcctgatgaccctgaccgtgaaggtgctgggcgccagacacctgcccaagctgggcagaagcatcgcctgccccttcgtggaggtggagatctgcggcgccgagtacgacaacaacaagttcaagaccaccgtggtgaacgacaacggcctgagccccatctgggcccccacccaggagaaggtgaccttcgagatctacgaccccaacctggccttcctgagattcgtggtgtacgaggaggacatgttcagcgaccccaacttcctggcccacgccacctaccccatcaaggccgtgaagagcggcttcagaagcgtgcccctgaagaacggctacagcgaggacatcgagctggccagcctgctggtgttctgcgagatgagacccgtgctggagagcgaggaggagctgtacagcagctgcagacagctgagaagaagacaggaggagctgaacaaccagctgttcctgtacgacacccaccagaacctgagaaacgccaacagagacgccctggtgaaggagttcagcgtgaacgagaaccagctgcagctgtaccaggagaagtgcaacaagagactgagagagaagagagtgagcaacagcaagttctacagctag

SEQ ID NO: 12169 - DNA, 2916 bp, Artificial Sequence
  Description of Artificial Sequence: Synthetic coding sequence
atgagcctgaagaacgagcccagagtgaacaccagcgccctgcagaagatcgccgccgacatgagcaacatcatcgagaacctggacaccagagagctgcacttcgagggcgaggaggtggactacgacgtgagccccagcgaccccaagatccaggaggtgtacatccccttcagcgccatctacaacacccagggcttcaaggagcccaacatccagacctacctgagcggctgccccatcaaggcccaggtgctggaggtggagagattcaccagcaccaccagagtgcccagcatcaacctgtacaccatcgagctgacccacggcgagttcaagtggcaggtgaagagaaagttcaagcacttccaggagttccacagagagctgctgaagtacaaggccttcatcagaatccccatccccaccagaagacacaccttcagaagacagaacgtgagagaggagcccagagagatgcccagcctgcccagaagcagcgagaacatgatcagagaggagcagttcctgggcagaagaaagcagctggaggactacctgaccaagatcctgaagatgcccatgtacagaaactaccacgccaccaccgagttcctggacatcagccagctgagcttcatccacgacctgggccccaagggcatcgagggcatgatcatgaagagaagcggcggccacagaatccccggcctgaactgctgcggccagggcagagcctgctacagatggagcaagagatggctgatcgtgaaggacagcttcctgctgtacatgaagcccgacagcggcgccatcgccttcgtgctgctggtggacaaggagttcaagatcaaggtgggcaagaaggagaccgagaccaagtacggcatcagaatcgacaacctgagcagaaccctgatcctgaagtgcaacagctacagacacgccagatggtggggcggcgccatcgaggagttcatccagaagcacggcaccaacttcctgaaggaccacagattcggcagctacgccgccatccaggagaacgccctggccaagtggtacgtgaacgccaagggctacttcgaggacgtggccaacgccatggaggaggccaacgaggagatcttcatcaccgactggtggctgagccccgagatcttcctgaagagacccgtggtggagggcaacagatggagactggactgcatcctgaagagaaaggcccagcagggcgtgagaatcttcatcatgctgtacaaggaggtggagctggccctgggcatcaacagcgagtacaccaagagaaccctgatgagactgcaccccaacatcaaggtgatgagacaccccgaccacgtgagcagcaccgtgtacctgtgggcccaccacgagaagctggtgatcatcgaccagagcgtggccttcgtgggcggcatcgacctggcctacggcagatgggacgacaacgagcacagactgaccgacgtgggcagcgtgaagagagtgaccagcggccccagcctgggcagcctgccccccgccgccatggagagcatggagagcctgagactgaaggacaagaacgagcccgtgcagaacctgcccatccagaagagcatcgacgacgtggacagcaagctgaagggcatcggcaagcccagaaagttcagcaagttcagcctgtacaagcagctgcacagacaccacctgcacgacgccgacagcatcagcagcatcgacagcaccagcagctacttcaaccactacagaagccaccacaacctgatccacggcctgaagccccacttcaagctgttccaccccagcagcgagagcgagcagggcctgaccagaccccacgccgacaccggcagcatcagaagcctgcagaccggcgtgggcgagctgcacggcgagaccagattctggcacggcaaggactactgcaacttcgtgttcaaggactgggtgcagctggacaagcccttcgccgacttcatcgacagatacagcacccccagaatgccctggcacgacatcgccagcgccgtgcacggcaaggccgccagagacgtggccagacacttcatccagagatggaacttcaccaagatcatgaagagcaagtacagaagcctgagctaccccttcctgctgcccaagagccagaccaccgcccacgagctgagataccaggtgcccggcagcgtgcacgccaacgtgcagctgctgagaagcgccgccgactggagcgccggcatcaagtaccacgaggagagcatccacgccgcctacgtgcacgtgatcgagaacagcagacactacatctacatcgagaaccagttcttcatcagctgcgccgacgacaaggtggtgttcaacaagatcggcgacgccatcgcccagagaatcctgaaggcccacagagagaaccagaagtacagagtgtacgtggtgatccccctgctgcccggcttcgagggcgacatcagcaccggcggcggcaacgccctgcaggccatcatgcacttcaactacagaaccatgtgcagaggcgagaacagcatcctgggccagctgaaggccgagctgggcaaccagtggatcaactacatcagcttctgcggcctgagaacccacgccgagctggagggcaacctggtgaccgagctgatctacgtgcacagcaagctgctgatcgccgacgacaacaccgtgatcatcggcagcgccaacatcaacgacagaagcatgctgggcaagagagacagcgagatggccgtgatcgtgcaggacaccgagaccgtgcccagcgtgatggacggcaaggagtaccaggccggcagattcgccagaggcctgagactgcagtgcttcagaagcaagatgacccccggcgtggaggacccctag

SEQ ID NO: 12170 - DNA, 1794 bp, Artificial Sequence
  Description of Artificial Sequence: Synthetic coding sequence
atgagcctgaagaacgagcccagagtgaacaccagcgccctgcagaagatcgccgccgacatgagcaacatcatcgagaacctggacaccagagagctgcacttcgagggcgaggaggtggactacgacgtgagccccagcgaccccaagatccaggaggtgtacatccccttcagcgccatctacaacacccagggcttcaaggagcccaacatccagacctacctgagcggctgccccatcaaggcccaggtgctggaggtggagagattcaccagcaccaccagagtgcccagcatcaacctgtacaccatcgagctgacccacggcgagttcaagtggcaggtgaagagaaagttcaagcacttccaggagttccacagagagctgctgaagtacaaggccttcatcagaatccccatccccaccagaagacacaccttcagaagacagaacgtgagagaggagcccagagagatgcccagcctgcccagaagcagcgagaacatgatcagagaggagcagttcctgggcagaagaaagcagctggaggactacctgaccaagatcctgaagatgcccatgtacagaaactaccacgccaccaccgagttcctggacatcagccagctgagcttcatccacgacctgggccccaagggcatcgagggcatgatcatgaagagaagcggcggccacagaatccccggcctgaactgctgcggccagggcagagcctgctacagatggagcaagagatggctgatcgtgaaggacagcttcctgctgtacatgaagcccgacagcggcgccatcgccttcgtgctgctggtggacaaggagttcaagatcaaggtgggcaagaaggagaccgagaccaagtacggcatcagaatcgacaacctgagcagaaccctgatcctgaagtgcaacagctacagacacgccagatggtggggcggcgccatcgaggagttcatccagaagcacggcaccaacttcctgaaggaccacagattcggcagctacgccgccatccaggagaacgccctggccaagtggtacgtgaacgccaagggctacttcgaggacgtggccaacgccatggaggaggccaacgaggagatcttcatcaccgactggtggctgagccccgagatcttcctgaagagacccgtggtggagggcaacagatggagactggactgcatcctgaagagaaaggcccagcagggcgtgagaatcttcatcatgctgtacaaggaggtggagctggccctgggcatcaacagcgagtacaccaagagaaccctgatgagactgcaccccaacatcaaggtgatgagacaccccgaccacgtgagcagcaccgtgtacctgtgggcccaccacgagaagctggtgatcatcgaccagagcgtggccttcgtgggcggcatcgacctggcctacggcagatgggacgacaacgagcacagactgaccgacgtgggcagcgtgaagagagtgaccagcggccccagcctgggcagcctgcccatccccggccccagcgtggtgtacagacaggtgtgggagagctgcatgggcaagcccgacagcggcatggagagaaccaccgccatcagcagcagcaagaccggcttcaacctgatcaacctgctgctgatcagcctgaccggcacccccagacccggctgccccggcatgaccctgcccctgcagagcaccggcagaagactggtgatgtggcacgtgaccagcagcagcgccggcaccagccagaagctgtag

SEQ ID NO: 12171 - DNA, 3225 bp, Artificial Sequence
  Description of Artificial Sequence: Synthetic coding sequence
atgagcctgaagaacgagcccagagtgaacaccagcgccctgcagaagatcgccgccgacatgagcaacatcatcgagaacctggacaccagagagctgcacttcgagggcgaggaggtggactacgacgtgagccccagcgaccccaagatccaggaggtgtacatccccttcagcgccatctacaacacccagggcttcaaggagcccaacatccagacctacctgagcggctgccccatcaaggcccaggtgctggaggtggagagattcaccagcaccaccagagtgcccagcatcaacctgtacaccatcgagctgacccacggcgagttcaagtggcaggtgaagagaaagttcaagcacttccaggagttccacagagagctgctgaagtacaaggccttcatcagaatccccatccccaccagaagacacaccttcagaagacagaacgtgagagaggagcccagagagatgcccagcctgcccagaagcagcgagaacatgatcagagaggagcagttcctgggcagaagaaagcagctggaggactacctgaccaagatcctgaagatgcccatgtacagaaactaccacgccaccaccgagttcctggacatcagccagctgagcttcatccacgacctgggccccaagggcatcgagggcatgatcatgaagagaagcggcggccacagaatccccggcctgaactgctgcggccagggcagagcctgctacagatggagcaagagatggctgatcgtgaaggacagcttcctgctgtacatgaagcccgacagcggcgccatcgccttcgtgctgctggtggacaaggagttcaagatcaaggtgggcaagaaggagaccgagaccaagtacggcatcagaatcgacaacctgagcagaaccctgatcctgaagtgcaacagctacagacacgccagatggtggggcggcgccatcgaggagttcatccagaagcacggcaccaacttcctgaaggaccacagattcggcagctacgccgccatccaggagaacgccctggccaagtggtacgtgaacgccaagggctacttcgaggacgtggccaacgccatggaggaggccaacgaggagatcttcatcaccgactggtggctgagccccgagatcttcctgaagagacccgtggtggagggcaacagatggagactggactgcatcctgaagagaaaggcccagcagggcgtgagaatcttcatcatgctgtacaaggaggtggagctggccctgggcatcaacagcgagtacaccaagagaaccctgatgagactgcaccccaacatcaaggtgatgagacaccccgaccacgtgagcagcaccgtgtacctgtgggcccaccacgagaagctggtgatcatcgaccagagcgtggccttcgtgggcggcatcgacctggcctacggcagatgggacgacaacgagcacagactgaccgacgtgggcagcgtgaagagagtgaccagcggccccagcctgggcagcctgccccccgccgccatggagagcatggagagcctgagactgaaggacaagaacgagcccgtgcagaacctgcccatccagaagagcatcgacgacgtggacagcaagctgaagggcatcggcaagcccagaaagttcagcaagttcagcctgtacaagcagctgcacagacaccacctgcacgacgccgacagcatcagcagcatcgacagcaccagcagctacttcaaccactacagaagccaccacaacctgatccacggcctgaagccccacttcaagctgttccaccccagcagcgagagcgagcagggcctgaccagaccccacgccgacaccggcagcatcagaagcctgcagaccggcgtgggcgagctgcacggcgagaccagattctggcacggcaaggactactgcaacttcgtgttcaaggactgggtgcagctggacaagcccttcgccgacttcatcgacagatacagcacccccagaatgccctggcacgacatcgccagcgccgtgcacggcaaggccgccagagacgtggccagacacttcatccagagatggaacttcaccaagatcatgaagagcaagtacagaagcctgagctaccccttcctgctgcccaagagccagaccaccgcccacgagctgagataccaggtgcccggcagcgtgcacgccaacgtgcagctgctgagaagcgccgccgactggagcgccggcatcaagtaccacgaggagagcatccacgccgcctacgtgcacgtgatcgagaacagcagacactacatctacatcgagaaccagttcttcatcagctgcgccgacgacaaggtggtgttcaacaagatcggcgacgccatcgcccagagaatcctgaaggcccacagagagaaccagaagtacagagtgtacgtggtgatccccctgctgcccggcttcgagggcgacatcagcaccggcggcggcaacgccctgcaggccatcatgcacttcaactacagaaccatgtgcagaggcgagaacagcatcctgggccagctgaaggccgagctgggcaaccagtggatcaactacatcagcttctgcggcctgagaacccacgccgagctggagggcaacctggtgaccgagctgatctacgtgcacagcaagctgctgatcgccgacgacaacaccgtgatcatcggcagcgccaacatcaacgacagaagcatgctgggcaagagagacagcgagatggccgtgatcgtgcaggacaccgagaccgtgcccagcgtgatggacggcaaggagtaccaggccggcagattcgccagaggcctgagactgcagtgcttcagagtggtgctgggctacctggacgaccccagcgaggacatccaggaccccgtgagcgacaagttcttcaaggaggtgtgggtgagcaccgccgccagaaacgccaccatctacgacaaggtgttcagatgcctgcccaacgacgaggtgcacaacctgatccagctgagagacttcatcaacaagcccgtgctggccaaggaggaccccatcagagccgaggaggagctgaagaagatcagaggcttcctggtgcagttccccttctacttcctgagcgaggagagcctgctgcccagcgtgggcaccaaggaggccatcgtgcccatggaggtgtggacctag

SEQ ID NO: 12172 - DNA, 3111 bp, Artificial Sequence
  Description of Artificial Sequence: Synthetic coding sequence
atgagcctgaagaacgagcccagagtgaacaccagcgccctgcagaagatcgccgccgacatgagcaacatcatcgagaacctggacaccagagagctgcacttcgagggcgaggaggtggactacgacgtgagccccagcgaccccaagatccaggaggtgtacatccccttcagcgccatctacaacacccagggcttcaaggagcccaacatccagacctacctgagcggctgccccatcaaggcccaggtgctggaggtggagagattcaccagcaccaccagagtgcccagcatcaacctgtacaccatcgagctgacccacggcgagttcaagtggcaggtgaagagaaagttcaagcacttccaggagttccacagagagctgctgaagtacaaggccttcatcagaatccccatccccaccagaagacacaccttcagaagacagaacgtgagagaggagcccagagagatgcccagcctgcccagaagcagcgagaacatgatcagagaggagcagttcctgggcagaagaaagcagctggaggactacctgaccaagatcctgaagatgcccatgtacagaaactaccacgccaccaccgagttcctggacatcagccagctgagcttcatccacgacctgggccccaagggcatcgagggcatgatcatgaagagaagcggcggccacagaatccccggcctgaactgctgcggccagggcagagcctgctacagatggagcaagagatggctgatcgtgaaggacagcttcctgctgtacatgaagcccgacagcggcgccatcgccttcgtgctgctggtggacaaggagttcaagatcaaggtgggcaagaaggagaccgagaccaagtacggcatcagaatcgacaacctgagcagaaccctgatcctgaagtgcaacagctacagacacgccagatggtggggcggcgccatcgaggagttcatccagaagcacggcaccaacttcctgaaggaccacagattcggcagctacgccgccatccaggagaacgccctggccaagtggtacgtgaacgccaagggctacttcgaggacgtggccaacgccatggaggaggccaacgaggagatcttcatcaccgactggtggctgagccccgagatcttcctgaagagacccgtggtggagggcaacagatggagactggactgcatcctgaagagaaaggcccagcagggcgtgagaatcttcatcatgctgtacaaggaggtggagctggccctgggcatcaacagcgagtacaccaagagaaccctgatgagactgcaccccaacatcaaggtgatgagacaccccgaccacgtgagcagcaccgtgtacctgtgggcccaccacgagaagctggtgatcatcgaccagagcgtggccttcgtgggcggcatcgacctggcctacggcagatgggacgacaacgagcacagactgaccgacgtgggcagcgtgaagagagtgaccagcggccccagcctgggcagcctgccccccgccgccatggagagcatggagagcctgagactgaaggacaagaacgagcccgtgcagaacctgcccatccagaagagcatcgacgacgtggacagcaagctgaagggcatcggcaagcccagaaagttcagcaagttcagcctgtacaagcagctgcacagacaccacctgcacgacgccgacagcatcagcagcatcgacagcaccagcaacaccggcagcatcagaagcctgcagaccggcgtgggcgagctgcacggcgagaccagattctggcacggcaaggactactgcaacttcgtgttcaaggactgggtgcagctggacaagcccttcgccgacttcatcgacagatacagcacccccagaatgccctggcacgacatcgccagcgccgtgcacggcaaggccgccagagacgtggccagacacttcatccagagatggaacttcaccaagatcatgaagagcaagtacagaagcctgagctaccccttcctgctgcccaagagccagaccaccgcccacgagctgagataccaggtgcccggcagcgtgcacgccaacgtgcagctgctgagaagcgccgccgactggagcgccggcatcaagtaccacgaggagagcatccacgccgcctacgtgcacgtgatcgagaacagcagacactacatctacatcgagaaccagttcttcatcagctgcgccgacgacaaggtggtgttcaacaagatcggcgacgccatcgcccagagaatcctgaaggcccacagagagaaccagaagtacagagtgtacgtggtgatccccctgctgcccggcttcgagggcgacatcagcaccggcggcggcaacgccctgcaggccatcatgcacttcaactacagaaccatgtgcagaggcgagaacagcatcctgggccagctgaaggccgagctgggcaaccagtggatcaactacatcagcttctgcggcctgagaacccacgccgagctggagggcaacctggtgaccgagctgatctacgtgcacagcaagctgctgatcgccgacgacaacaccgtgatcatcggcagcgccaacatcaacgacagaagcatgctgggcaagagagacagcgagatggccgtgatcgtgcaggacaccgagaccgtgcccagcgtgatggacggcaaggagtaccaggccggcagattcgccagaggcctgagactgcagtgcttcagagtggtgctgggctacctggacgaccccagcgaggacatccaggaccccgtgagcgacaagttcttcaaggaggtgtgggtgagcaccgccgccagaaacgccaccatctacgacaaggtgttcagatgcctgcccaacgacgaggtgcacaacctgatccagctgagagacttcatcaacaagcccgtgctggccaaggaggaccccatcagagccgaggaggagctgaagaagatcagaggcttcctggtgcagttccccttctacttcctgagcgaggagagcctgctgcccagcgtgggcaccaaggaggccatcgtgcccatggaggtgtggacctag

SEQ ID NO: 12173 - DNA, 429 bp, Artificial Sequence
  Description of Artificial Sequence: Synthetic coding sequence
atgagcctgaagaacgagcccagagtgaacaccagcgccctgcagaagatcgccgccgacatgagcaacatcatcgagaacctggacaccagagagctgcacttcgagggcgaggaggtggactacgacgtgagccccagcgaccccaagatccaggaggtgtacatccccttcagcgccatctacaacacccagggcttcaaggagcccaacatccagacctacctgagcggctgccccatcaaggcccaggtgctggaggtggagagattcaccagcaccaccagagtgcccagcatcaacctgtacaccatcgagctgacccacggcgagttcaagtggcaggtgaagagaaagttcaagcacttccaggagttccacagagagctgctgaagtacaaggccttcatcagaatccccatcccctag

SEQ ID NO: 12174 - DNA, 2580 bp, Artificial Sequence
  Description of Artificial Sequence: Synthetic coding sequence
atgtacagcggcgccggccccgccctggccccccccgccccccccccccccatccagggctacgccttcaagcccccccccagacccgacttcggcaccagcggcagaaccatcaagctgcaggccaacttcttcgagatggacatccccaagatcgacatctaccactacgagctggacatcaagcccgagaagtgccccagaagagtgaacagagagatcgtggagcacatggtgcagcacttcaagacccagatcttcggcgacagaaagcccgtgttcgacggcagaaagaacctgtacaccgccatgcccctgcccatcggcagagacaaggtggagctggaggtgaccctgcccggcgagggcaaggacagaatcttcaaggtgagcatcaagtgggtgagctgcgtgagcctgcaggccctgcacgacgccctgagcggcagactgcccagcgtgcccttcgagaccatccaggccctggacgtggtgatgagacacctgcccagcatgagatacacccccgtgggcagaagcttcttcaccgccagcgagggctgcagcaaccccctgggcggcggcagagaggtgtggttcggcttccaccagagcgtgagacccagcctgtggaagatgatgctgaacatcgacgtgagcgccaccgccttctacaaggcccagcccgtgatcgagttcgtgtgcgaggtgctggacttcaagagcatcgaggagcagcagaagcccctgaccgacagccagagagtgaagttcaccaaggagatcaagggcctgaaggtggagatcacccactgcggccagatgaagagaaagtacagagtgtgcaacgtgaccagaagacccgccagccaccagaccttccccctgcagcaggagagcggccagaccgtggagtgcaccgtggcccagtacttcaaggacagacacaagctggtgctgagatacccccacctgccctgcctgcaggtgggccaggagcagaagcacacctacctgcccctggaggtgtgcaacatcgtggccggccagagatgcatcaagaagctgaccgacaaccagaccagcaccatgatcagagccaccgccagaagcgcccccgacagacaggaggagatcagcaagctgatgagaagcgccagcttcaacaccgacccctacgtgagagagttcggcatcatggtgaaggacgagatgaccgacgtgaccggcagagtgctgcagccccccagcatcctgtacggcggcagaaacaaggccatcgccacccccgtgcagggcgtgtgggacatgagaaacaagcagttccacaccggcatcgagatcaaggtgtgggccatcgcctgcttcgccccccagagacagtgcaccgaggtgcacctgaagagcttcaccgagcagctgagaaagatcagcagagacgccggcatgcccatccagggccagccctgcttctgcaagtacgcccagggcgccgacagcgtggagcccatgttcagacacctgaagaacacctacgccggcctgcagctggtggtggtgatcctgcccggcaagacccccgtgtacgccgaggtgaagagagtgggcgacaccgtgctgggcatggccacccagtgcgtgcagatgaagaacgtgcagagaaccaccccccagaccctgagcaacctgtgcctgaagatcaacgtgaagctgggcggcgtgaacaacatcctgctgccccagggcagaccccccgtgttccagcagcccgtgatcttcctgggcgccgacgtgacccacccccccgccggcgacggcaagaagcccagcatcgccgccgtggtgggcagcatggacgcccaccccaacagatactgcgccaccgtgagagtgcagcagcacagacaggagatcatccaggacctggccgccatggtgagagagctgctgatccagttctacaagagcaccagattcaagcccaccagaatcatcttctacagagacggcgtgagcgagggccagttccagcaggtgctgcaccacgagctgctggccatcagagaggcctgcatcaagctggagaaggactaccagcccggcatcaccttcatcgtggtgcagaagagacaccacaccagactgttctgcaccgacaagaacgagagagtgggcaagagcggcaacatccccgccggcaccaccgtggacaccaagatcacccaccccaccgagttcgacttctacctgtgcagccacgccggcatccagggcaccagcagacccagccactaccacgtgctgtgggacgacaacagattcagcagcgacgagctgcagatcctgacctaccagctgtgccacacctacgtgagatgcaccagaagcgtgagcatccccgcccccgcctactacgcccacctggtggccttcagagccagataccacctggtggacaaggagcacgacagcgccgagggcagccacaccagcggccagagcaacggcagagaccaccaggccctggccaaggccgtgcaggtgcaccaggacaccctgagaaccatgtacttcgcctag

SEQ ID NO: 12175 - DNA, 1926 bp, Artificial Sequence
  Description of Artificial Sequence: Synthetic coding sequence
atgctgagcggcatcgaggccgccgccggcgagtacgaggacagcgagctgagatgcagagtggccgtggaggagctgagccccggcggccagcccagaagaagacaggccctgagaaccgccgagctgagcctgggcagaaacgagagaagagagctgatgctgagactgcaggcccccggccccgccggcagacccagatgcttccccctgagagccgccagactgttcaccagattcgccgaggccggcagaagcaccctgagactgcccgcccacgacacccccggcgccggcgccgtgcagctgctgctgagcgactgcccccccgacagactgagaagattcctgagaaccctgagactgaagctggccgccgcccccggccccggccccgccagcgccagagcccagctgctgggccccagacccagagacttcgtgaccatcagccccgtgcagcccgaggagagaagactgagagccgccaccagagtgcccgacaccaccctggtgaagagacccgtggagccccaggccggcgccgagcccagcaccgaggcccccagatggcccctgcccgtgaagagactgagcctgcccagcaccaagccccagctgagcgaggagcaggccgccgtgctgagagccgtgctgaagggccagagcatcttcttcaccggcagcgccggcaccggcaagagctacctgctgaagagaatcctgggcagcctgccccccaccggcaccgtggccaccgccagcaccggcgtggccgcctgccacatcggcggcaccaccctgcacgccttcgccggcatcggcagcggccaggcccccctggcccagtgcgtggccctggcccagagacccggcgtgagacagggctggctgaactgccagagactggtgatcgacgagatcagcatggtggaggccgacctgttcgacaagctggaggccgtggccagagccgtgagacagcagaacaagcccttcggcggcatccagctgatcatctgcggcgacttcctgcagctgccccccgtgaccaagggcagccagccccccagattctgcttccagagcaagagctggaagagatgcgtgcccgtgaccctggagctgaccaaggtgtggagacaggccgaccagaccttcatcagcctgctgcaggccgtgagactgggcagatgcagcgacgaggtgaccagacagctgcaggccaccgccagccacaaggtgggcagagacggcatcgtggccaccagactgtgcacccaccaggacgacgtggccctgaccaacgagagaagactgcaggagctgcccggcaaggtgcacagattcgaggccatggacagcaaccccgagctggccagcaccctggacgcccagtgccccgtgagccagctgctgcagctgaagctgggcgcccaggtgatgctggtgaagaacctgagcgtgagcagaggcctggtgaacggcgccagaggcgtggtggtgggcttcgaggccgagggcagaggcctgccccaggtgagattcctgtgcggcgtgaccgaggtgatccacgccgacagatggaccgtgcaggccaccggcggccagctgctgagcagacagcagctgcccctgcagctggcctgggccatgagcatccacaagagccagggcatgaccctggactgcgtggagatcagcctgggcagagtgttcgccagcggccaggcctacgtggccctgagcagagccagaagcctgcagggcctgagagtgctggacttcgaccccatggccgtgagatgcgaccccagagtgctgcacttctacgccaccctgagaagaggcagaagcctgagcctggagagccccgacgacgacgaggccgccagcgaccaggagaacatggaccccatcctgtag

SEQ ID NO: 12176 - DNA, 2124 bp, Artificial Sequence
  Description of Artificial Sequence: Synthetic coding sequence
atgctgagcggcatcgaggccgccgccggcgagtacgaggacagcgagctgagatgcagagtggccgtggaggagctgagccccggcggccagcccagaagaagacaggccctgagaaccgccgagctgagcctgggcagaaacgagagaagagagctgatgctgagactgcaggcccccggccccgccggcagacccagatgcttccccctgagagccgccagactgttcaccagattcgccgaggccggcagaagcaccctgagactgcccgcccacgacacccccggcgccggcgccgtgcagctgctgctgagcgactgcccccccgacagactgagaagattcctgagaaccctgagactgaagctggccgccgcccccggccccggccccgccagcgccagagcccagctgctgggccccagacccagagacttcgtgaccatcagccccgtgcagcccgaggagagaagactgagagccgccaccagagtgcccgacaccaccctggtgaagagacccgtggagccccaggccggcgccgagcccagcaccgaggcccccagatggcccctgcccgtgaagagactgagcctgcccagcaccaagccccagctgagcgaggagcaggccgccgtgctgagagccgtgctgaagggccagagcatcttcttcaccggcagcgccggcaccggcaagagctacctgctgaagagaatcctgggcagcctgccccccaccggcaccgtggccaccgccagcaccggcgtggccgcctgccacatcggcggcaccaccctgcacgccttcgccggcatcggcagcggccaggcccccctggcccagtgcgtggccctggcccagagacccggcgtgagacagggctggctgaactgccagagactggtgatcgacgagatcagcatggtggaggccgacctgttcgacaagctggaggccgtggccagagccgtgagacagcagaacaagcccttcggcggcatccagctgatcatctgcggcgacttcctgcagctgccccccgtgaccaagggcagccagccccccagattctgcttccagagcaagagctggaagagatgcgtgcccgtgaccctggagctgaccaaggtgtggagacaggccgaccagaccttcatcagcctgctgcaggccgtgagactgggcagatgcagcgacgaggtgaccagacagctgcaggccaccgccagccacaaggtgggcagagacggcatcgtggccaccagactgtgcacccaccaggacgacgtggccctgaccaacgagagaagactgcaggagctgcccggcaaggtgcacagattcgaggccatggacagcaaccccgagctggccagcaccctggacgcccagtgccccgtgagccagctgctgcagctgaagctgggcgcccaggtgatgctggtgaagaacctgagcgtgagcagaggcctggtgaacggcgccagaggcgtggtggtgggcttcgaggccgagggcagaggcctgccccaggtgagattcctgtgcggcgtgaccgaggtgatccacgccgacagatggaccgtgcaggccaccggcggccagctgctgagcagacagcagctgcccctgcagctggcctgggccatgagcatccacaagagccagggcatgaccctggactgcgtggagatcagcctgggcagagtgttcgccagcggccaggcctacgtggccctgagcagagccagaagcctgcagggcctgagagtgctggacttcgaccccatggccgtgagatgcgaccccagagtgctgcacttctacgccaccctgagaagaggcagaagcctgagcctggccgccgagggcagaggcaacgaggacagatgcagcggcagcagcatcagagccctgggcggcgactggtggggcctgagactgggcgccgccagcaagcagagaaccgagctgagatgcgtgagcaccgccagacccagcctggcccagcccagaaccaacaccctgcagagcctgaccaaggagcacaagctgcagaacgtgcacccctacttcaagctgctgttccagggcatcaacagcgtgtggggccactag

SEQ ID NO: 12177 - DNA, 1926 bp, Artificial Sequence; identical to SEQ ID NO: 12175
  Description of Artificial Sequence: Synthetic coding sequence

SEQ ID NO: 12178 - DNA, 801 bp, Artificial Sequence
  Description of Artificial Sequence: Synthetic coding sequence
atgctgagcggcatcgaggccgccgccggcgagtacgaggacagcgagctgagatgcagagtggccgtggaggagctgagccccggcggccagcccagaagaagacaggccctgagaaccgccgagctgagcctgggcagaaacgagagaagagagctgatgctgagactgcaggcccccggccccgccggcagacccagatgcttccccctgagagccgccagactgttcaccagattcgccgaggccggcagaagcaccctgagactgcccgcccacgacacccccggcgccggcgccgtgcagctgctgctgagcgactgcccccccgacagactgagaagattcctgagaaccctgagactgaagctggccgccgcccccggccccggccccgccagcgccagagcccagctgctgggccccagacccagagacttcgtgaccatcagccccgtgcagcccgaggagagaagactgagagccgccaccagagtgcccgacaccaccctggtgaagagacccgtggagccccaggccggcgccgagcccagcaccgaggcccccagatggcccctgcccgtgaagagactgagcctgcccagcaccaagccccagctgagcgaggagcaggccgccgtgctgagagccgtgctgaagggccagagcatcttcttcaccggcagcgccggcagcggcggcagagaggaggtgggcggccagtggtggggcggcatcgaggagcagggcgacctgagcaacttcgcccccgtgcaggagcagggcagccacatctgctag

SEQ ID NO: 12179 - DNA, 987 bp, Artificial Sequence
  Description of Artificial Sequence: Synthetic coding sequence
atgagcatgctggccgagagaagaagaaagcagaagtgggccgtggacccccagaacaccgcctggagcaacgacgacagcaagttcggccagagaatgctggagaagatgggctggagcaagggcaagggcctgggcgcccaggagcagggcgccaccgaccacatcaaggtgcaggtgaagaacaaccacctgggcctgggcgccaccatcaacaacgaggacaactggatcgcccaccaggacgacttcaaccagctgctggccgagctgaacacctgccacggccaggagaccaccgacagcagcgacaagaaggagaagaagagcttcagcctggaggagaagagcaagatcagcaagaacagagtgcactacatgaagttcaccaagggcaaggacctgagcagcagaagcaagaccgacctggactgcatcttcggcaagagacagagcaagaagacccccgagggcgacgccagccccagcacccccgaggagaacgagaccaccaccaccagcgccttcaccatccaggagtacttcgccaagagaatggccgccctgaagaacaagccccaggtgcccgtgcccggcagcgacatcagcgagacccaggtggagagaaagagaggcaagaagagaaacaaggaggccaccggcaaggacgtggagagctacctgcagcccaaggccaagagacacaccgagggcaagcccgagagagccgaggcccaggagagagtggccaagaagaagagcgcccccgccgaggagcagctgagaggcccctgctgggaccagagcagcaaggccagcgcccaggacgccggcgaccacgtgcagccccccgagggcagagacttcaccctgaagcccaagaagagaagaggcaagaagaagctgcagaagcccgtggagatcgccgaggacgccaccctggaggagaccctggtgaagaagaagaagaagaaggacagcaagtag

SEQ ID NO: 12180 - DNA, 519 bp, Artificial Sequence
  Description of Artificial Sequence: Synthetic coding sequence
atgctggccgagagaagaagaaagcagaagtgggccgtggacccccagaacaccgcctggagcaacgacgacagcaagttcggccagagaatgctggagaagatgggctggagcaagggcaagggcctgggcgcccaggagcagggcgccaccgaccacatcaaggtgcaggtgaagaacaaccacctgggcctgggcgccaccatcaacaacgaggacaactggatcgcccaccaggacgacttcaaccagctgctggccgagctgaacacctgccacggccaggagaccaccgacagcagcgacaagaaggagaagaagagcttcagcctggaggagaagagcaagatcagcaagaacagagtgcactacatgaagttcaccaagggcagatgccagagcctgcacagcagaggcgagagaaaccacgacaaccagagactgcaccaccccggcgtgctgtgccaggccgacggcagcaccgaggagcaggcccccggcagcagcagcagagtgtag

SEQ ID NO: 12181 - DNA, 525 bp, Artificial Sequence
  Description of Artificial Sequence: Synthetic coding sequence
atgagcatgctggccgagagaagaagaaagcagaagtgggccgtggacccccagaacaccgcctggagcaacgacgacagcaagttcggccagagaatgctggagaagatgggctggagcaagggcaagggcctgggcgcccaggagcagggcgccaccgaccacatcaaggtgcaggtgaagaacaaccacctgggcctgggcgccaccatcaacaacgaggacaactggatcgcccaccaggacgacttcaaccagctgctggccgagctgaacacctgccacggccaggagaccaccgacagcagcgacaagaaggagaagaagagcttcagcctggaggagaagagcaagatcagcaagaacagagtgcactacatgaagttcaccaagggcagatgccagagcctgcacagcagaggcgagagaaaccacgacaaccagagactgcaccaccccggcgtgctgtgccaggccgacggcagcaccgaggagcaggcccccggcagcagcagcagagtgtag

SEQ ID NO: 12182 - DNA, 972 bp, Artificial Sequence
  Description of Artificial Sequence: Synthetic coding sequence
atgcccgtgcacagcagaggcgacaagaaggagaccaaccaccacgacgagatggaggtggactacgccgagaacgagggcagcagcagcgaggacgaggacaccgagagcagcagcgtgagcgaggacggcgacagcagcgagatggacgacgaggactgcgagagaagaagaatggagtgcctggacgagatgagcaacctggagaagcagttcaccgacctgaaggaccagctgtacaaggagagactgagccaggtggacgccaagctgcaggaggtgatcgccggcaaggcccccgagtacctggagcccctggccaccctgcaggagaacatgcagatcagaaccaaggtggccggcatctacagagagctgtgcctggagagcgtgaagaacaagtacgagtgcgagatccaggccagcagacagcactgcgagagcgagaagctgctgctgtacgacaccgtgcagagcgagctggaggagaagatcagaagactggaggaggacagacacagcatcgacatcaccagcgagctgtggaacgacgagctgcagagcagaaagaagagaaaggaccccttcagccccgacaagaagaagcccgtggtggtgagcggcccctacatcgtgtacatgctgcaggacctggacatcctggaggactggaccaccatcagaaaggccatggccaccctgggcccccacagagtgaagaccgagccccccgtgaagctggagaagcacctgcacagcgccagaagcgaggagggcagactgtactacgacggcgagtggtacatcagaggccagaccatctgcatcgacaagaaggacgagtgccccaccagcgccgtgatcaccaccatcaaccacgacgaggtgtggttcaagagacccgacggcagcaagagcaagctgtacatcagccagctgcagaagggcaagtacagcatcaagcacagctag

SEQ ID NO: 12183 - DNA, 666 bp, Artificial Sequence
  Description of Artificial Sequence: Synthetic coding sequence
atgcccgtgatgagactgttcccctgcttcctgcagctgctggccggcctggccctgcccgccgtgcccccccagcagtgggccctgagcgccggcaacggcagcagcgaggtggaggtggtgcccttccaggaggtgtggggcagaagctactgcagagccctggagagactggtggacgtggtgagcgagtaccccagcgaggtggagcacatgttcagccccagctgcgtgagcctgctgagatgcaccggctgctgcggcgacgagaacctgcactgcgtgcccgtggagaccgccaacgtgaccatgcagctgctgaagatcagaagcggcgacagacccagctacgtggagctgaccttcagccagcacgtgagatgcgagtgcagacacagccccggcagacagagccccgacatgcccggcgacttcagagccgacgcccccagcttcctgccccccagaagaagcctgcccatgctgttcagaatggagtggggctgcgccctgaccggcagccagagcgccgtgtggcccagcagccccgtgcccgaggagatccccagaatgcaccccggcagaaacggcaagaagcagcagagaaagcccctgagagagaagatgaagcccgagagatgcggcgacgccgtgcccagaagatag

SEQ ID NO: 12184 - DNA, 450 bp, Artificial Sequence
  Description of Artificial Sequence: Synthetic coding sequence
atgcccgtgatgagactgttcccctgcttcctgcagctgctggccggcctggccctgcccgccgtgcccccccagcagtgggccctgagcgccggcaacggcagcagcgaggtggaggtggtgcccttccaggaggtgtggggcagaagctactgcagagccctggagagactggtggacgtggtgagcgagtaccccagcgaggtggagcacatgttcagccccagctgcgtgagcctgctgagatgcaccggctgctgcggcgacgagaacctgcactgcgtgcccgtggagaccgccaacgtgaccatgcagctgctgaagatcagaagcggcgacagacccagctacgtggagctgaccttcagccagcacgtgagatgcgagtgcagacccctgagagagaagatgaagcccgagagatgcggcgacgccgtgcccagaagatag

SEQ ID NO: 12185 - DNA, 513 bp, Artificial Sequence
  Description of Artificial Sequence: Synthetic coding sequence
atgcccgtgatgagactgttcccctgcttcctgcagctgctggccggcctggccctgcccgccgtgcccccccagcagtgggccctgagcgccggcaacggcagcagcgaggtggaggtggtgcccttccaggaggtgtggggcagaagctactgcagagccctggagagactggtggacgtggtgagcgagtaccccagcgaggtggagcacatgttcagccccagctgcgtgagcctgctgagatgcaccggctgctgcggcgacgagaacctgcactgcgtgcccgtggagaccgccaacgtgaccatgcagctgctgaagatcagaagcggcgacagacccagctacgtggagctgaccttcagccagcacgtgagatgcgagtgcagacccctgagagagaagatgaagcccgagagaagaagacccaagggcagaggcaagagaagaagagagaagcagagacccaccgactgccacctgtgcggcgacgccgtgcccagaagatag

SEQ ID NO: 12186 - DNA, 477 bp, Artificial Sequence
  Description of Artificial Sequence: Synthetic coding sequence
atggccctggaggtgctgatgctgctggccgtgctgatctggaccggcgccgagaacctgcacgtgaagatcagctgcagcctggactggctgatggtgagcgtgatccccgtggccgagagcagaaacctgtacatcttcgccgacgagctgcacctgggcatgggctgccccgccaacagaatccacacctacgtgtacgagttcatctacctggtgagagactgcggcatcagaaccagagtggtgagcgaggagaccctgctgttccagaccgagctgtacttcacccccagaaacatcgaccacgacccccaggagatccacctggagtgcagcaccagcagaaagagcgtgtggctgacccccgtgagcaccgagaacgagatcaagctggaccccagccccttcatcgccgacttccagaccaccgccgaggagctgggcctgctgagcagcagccccaacctgctgtag

SEQ ID NO: 12187 - DNA, 1188 bp, Artificial Sequence
  Description of Artificial Sequence: Synthetic coding sequence
atgagagccctgctggccagactgctgctgtgcgtgctggtggtgagcgacagcaagggcagcaacgagctgcaccaggtgccctacaagagcaagacctgctacgagggcaacggccacttctacagaggcaaggccagcaccgacaccatgggcagaccctgcctgccctggaacagcgccaccgtgctgcagcagacctaccacgcccacagaagcgacgccctgcagctgggcctgggcaagcacaactactgcagaaaccccgacaacagaagaagaccctggtgctacgtgcaggtgggcctgaagctgctggtgcaggagtgcatggtgcacgactgcgccgacggcaagaagcccagcagcccccccgaggagctgaagttccagtgcggccagaagaccctgagacccagattcaagatcatcggcggcgagttcaccaccatcgagaaccagccctggttcgccgccatctacagaagacacagaggcggcagcgtgacctacgtgtgcggcggcagcctgatcagcccctgctgggtgatcagcgccacccactgcttcatcgactaccccaagaaggaggactacatcgtgtacctgggcagaagcagactgaacagcaacacccagggcgagatgaagttcgaggtggagaacctgatcctgcacaaggactacagcgccgacaccctggcccaccacaacgacatcgccctgctgaagatcagaagcaaggagggcagatgcgcccagcccagcagaaccatccagaccatctgcctgcccagcatgtacaacgacccccagttcggcaccagctgcgagatcaccggcttcggcaaggagaacagcaccgactacctgtaccccgagcagctgaagatgaccgtggtgaagctgatcagccacagagagtgccagcagccccactactacggcagcgaggtgaccaccaagatgctgtgcgccgccgacccccagtggaagaccgacagctgccagggcgacagcggcggccccctggtgtgcagcctgcagggcagaatgaccctgaccggcatcgtgagctggggcagaggctgcgccctgaaggacaagcccggcgtgtacaccagagtgagccacttcctgccctggatcagaagccacaccaaggaggagaacggcctggccctgtag

SEQ ID NO: 12188 - DNA, 1188 bp, Artificial Sequence; identical to SEQ ID NO: 12187
  Description of Artificial Sequence: Synthetic coding sequence

SEQ ID NO: 12189 - DNA, 1296 bp, Artificial Sequence
  Description of Artificial Sequence: Synthetic coding sequence
atgagagccctgctggccagactgctgctgtgcgtgctggtggtgagcgacagcaagggcagcaacgagctgcaccaggtgcccagcaactgcgactgcctgaacggcggcacctgcgtgagcaacaagtacttcagcaacatccactggtgcaactgccccaagaagttcggcggccagcactgcgagatcgacaagagcaagacctgctacgagggcaacggccacttctacagaggcaaggccagcaccgacaccatgggcagaccctgcctgccctggaacagcgccaccgtgctgcagcagacctaccacgcccacagaagcgacgccctgcagctgggcctgggcaagcacaactactgcagaaaccccgacaacagaagaagaccctggtgctacgtgcaggtgggcctgaagctgctggtgcaggagtgcatggtgcacgactgcgccgacggcaagaagcccagcagcccccccgaggagctgaagttccagtgcggccagaagaccctgagacccagattcaagatcatcggcggcgagttcaccaccatcgagaaccagccctggttcgccgccatctacagaagacacagaggcggcagcgtgacctacgtgtgcggcggcagcctgatcagcccctgctgggtgatcagcgccacccactgcttcatcgactaccccaagaaggaggactacatcgtgtacctgggcagaagcagactgaacagcaacacccagggcgagatgaagttcgaggtggagaacctgatcctgcacaaggactacagcgccgacaccctggcccaccacaacgacatcgccctgctgaagatcagaagcaaggagggcagatgcgcccagcccagcagaaccatccagaccatctgcctgcccagcatgtacaacgacccccagttcggcaccagctgcgagatcaccggcttcggcaaggagaacagcaccgactacctgtaccccgagcagctgaagatgaccgtggtgaagctgatcagccacagagagtgccagcagccccactactacggcagcgaggtgaccaccaagatgctgtgcgccgccgacccccagtggaagaccgacagctgccagggcgacagcggcggccccctggtgtgcagcctgcagggcagaatgaccctgaccggcatcgtgagctggggcagaggctgcgccctgaaggacaagcccggcgtgtacaccagagtgagccacttcctgccctggatcagaagccacaccaaggaggagaacggcctggccctgtag

SEQ ID NO: 12190 - DNA, 1245 bp, Artificial Sequence
  Description of Artificial Sequence: Synthetic coding sequence
atggtgttccacctgagaaccagatacgagcaggccaactgcgactgcctgaacggcggcacctgcgtgagcaacaagtacttcagcaacatccactggtgcaactgccccaagaagttcggcggccagcactgcgagatcgacaagagcaagacctgctacgagggcaacggccacttctacagaggcaaggccagcaccgacaccatgggcagaccctgcctgccctggaacagcgccaccgtgctgcagcagacctaccacgcccacagaagcgacgccctgcagctgggcctgggcaagcacaactactgcagaaaccccgacaacagaagaagaccctggtgctacgtgcaggtgggcctgaagctgctggtgcaggagtgcatggtgcacgactgcgccgacggcaagaagcccagcagcccccccgaggagctgaagttccagtgcggccagaagaccctgagacccagattcaagatcatcggcggcgagttcaccaccatcgagaaccagccctggttcgccgccatctacagaagacacagaggcggcagcgtgacctacgtgtgcggcggcagcctgatcagcccctgctgggtgatcagcgccacccactgcttcatcgactaccccaagaaggaggactacatcgtgtacctgggcagaagcagactgaacagcaacacccagggcgagatgaagttcgaggtggagaacctgatcctgcacaaggactacagcgccgacaccctggcccaccacaacgacatcgccctgctgaagatcagaagcaaggagggcagatgcgcccagcccagcagaaccatccagaccatctgcctgcccagcatgtacaacgacccccagttcggcaccagctgcgagatcaccggcttcggcaaggagaacagcaccgactacctgtaccccgagcagctgaagatgaccgtggtgaagctgatcagccacagagagtgccagcagccccactactacggcagcgaggtgaccaccaagatgctgtgcgccgccgacccccagtggaagaccgacagctgccagggcgacagcggcggccccctggtgtgcagcctgcagggcagaatgaccctgaccggcatcgtgagctggggcagaggctgcgccctgaaggacaagcccggcgtgtacaccagagtgagccacttcctgccctggatcagaagccacaccaaggaggagaacggcctggccctgtag

SEQ ID NO: 12191 - DNA, 3984 bp, Artificial Sequence
  Description of Artificial Sequence: Synthetic coding sequence
atggaggcccccctgcagaccggcatggtgctgggcgtgatgatcggcgccggcgtggccgtggtggtgaccgccgtgctgatcctgctggtggtgagaagactgagagtgcccaagacccccgcccccgacggccccagatacagattcagaaagagagacaaggtgctgttctacggcagaaagatcatgagaaaggtgagccagagcaccagcagcctggtggacaccagcgtgagcgccaccagcagacccagaatgagaaagaagctgaagatgctgaacatcgccaagaagatcctgagaatccagaaggagacccccaccctgcagagaaaggagcccccccccgccgtgctggaggccgacctgaccgagggcgacctggccaacagccacctgcccagcgaggtgctgtacatgctgaagaacgtgagagtgctgggccacttcgagaagcccctgttcctggagctgtgcagacacatggtgttccagagactgggccagggcgactacgtgttcagacccggccagcccgacgccagcatctacgtggtgcaggacggcctgctggagctgtgcctgcccggccccgacggcaaggagtgcgtggtgaaggaggtggtgcccggcgacagcgtgaacagcctgctgagcatcctggacgtgatcaccggccaccagcacccccagagaaccgtgagcgccagagccgccagagacagcaccgtgctgagactgcccgtggaggccttcagcgccgtgttcaccaagtaccccgagagcctggtgagagtggtgcagatcatcatggtgagactgcagagagtgaccttcctggccctgcacaactacctgggcctgaccaacgagctgttcagccacgagatccagcccctgagactgttccccagccccggcctgcccaccagaaccagccccgtgagaggcagcaagagaatggtgagcaccagcgccaccgacgagcccagagagacccccggcagaccccccgaccccaccggcgcccccctgcccggccccaccggcgaccccgtgaagcccaccagcctggagacccccagcgcccccctgctgagcagatgcgtgagcatgcccggcgacatcagcggcctgcagggcggccccagaagcgacttcgacatggcctacgagagaggcagaatcagcgtgagcctgcaggaggaggccagcggcggcagcctggccgcccccgccagaacccccacccaggagcccagagagcagcccgccggcgcctgcgagtacagctactgcgaggacgagagcgccaccggcggctgccccttcggcccctaccagggcagacagaccagcagcatcttcgaggccgccaagcaggagctggccaagctgatgagaatcgaggaccccagcctgctgaacagcagagtgctgctgcaccacgccaaggccggcaccatcatcgccagacagggcgaccaggacgtgagcctgcacttcgtgctgtggggctgcctgcacgtgtaccagagaatgatcgacaaggccgaggacgtgtgcctgttcgtggcccagcccggcgagctggtgggccagctggccgtgctgaccggcgagcccctgatcttcaccctgagagcccagagagactgcaccttcctgagaatcagcaagagcgacttctacgagatcatgagagcccagcccagcgtggtgctgagcgccgcccacaccgtggccgccagaatgagccccttcgtgagacagatggacttcgccatcgactggaccgccgtggaggccggcagagccctgtacagacagggcgacagaagcgactgcacctacatcgtgctgaacggcagactgagaagcgtgatccagagaggcagcggcaagaaggagctggtgggcgagtacggcagaggcgacctgatcggcgtggtggaggccctgaccagacagcccagagccaccaccgtgcacgccgtgagagacaccgagctggccaagctgcccgagggcaccctgggccacatcaagagaagatacccccaggtggtgaccagactgatccacctgctgagccagaagatcctgggcaacctgcagcagctgcagggccccttccccgccggcagcggcctgggcgtgcccccccacagcgagctgaccaaccccgccagcaacctggccaccgtggccatcctgcccgtgtgcgccgaggtgcccatggtggccttcaccctggagctgcagcacgccctgcaggccatcggccccaccctgctgctgaacagcgacatcatcagagccagactgggcgccagcgccctggacagcatccaggagttcagactgagcggctggctggcccagcaggaggacgcccacagaatcgtgctgtaccagaccgacgccagcctgaccccctggaccgtgagatgcctgagacaggccgactgcatcctgatcgtgggcctgggcgaccaggagcccaccctgggccagctggagcagatgctggagaacaccgccgtgagagccctgaagcagctggtgctgctgcacagagaggagggcgccggccccaccagaaccgtggagtggctgaacatgagaagctggtgcagcggccacctgcacctgagatgccccagaagactgttcagcagaagaagccccgccaagctgcacgagctgtacgagaaggtgttcagcagaagagccgacagacacagcgacttcagcagactggccagagtgctgaccggcaacaccatcgccctggtgctgggcggcggcggcgccagaggctgcagccacatcggcgtgctgaaggccctggaggaggccggcgtgcccgtggacctggtgggcggcaccagcatcggcagcttcatcggcgccctgtacgccgaggagagaagcgccagcagaaccaagcagagagccagagagtgggccaagagcatgaccagcgtgctggagcccgtgctggacctgacctaccccgtgaccagcatgttcaccggcagcgccttcaacagaagcatccacagagtgttccaggacaagcagatcgaggacctgtggctgccctacttcaacgtgaccaccgacatcaccgccagcgccatgagagtgcacaaggacggcagcctgtggagatacgtgagagccagcatgaccctgagcggctacctgccccccctgtgcgaccccaaggacggccacctgctgatggacggcggctacatcaacaacctgcccgccgacatcgccagaagcatgggcgccaagaccgtgatcgccatcgacgtgggcagccaggacgagaccgacctgagcacctacggcgacagcctgagcggctggtggctgctgtggaagagactgaacccctgggccgacaaggtgaaggtgcccgacatggccgagatccagagcagactggcctacgtgagctgcgtgagacagctggaggtggtgaagagcagcagctactgcgagtacctgagaccccccatcgactgcttcaagaccatggacttcggcaagttcgaccagatctacgacgtgggctaccagtacggcaaggccgtgttcggcggctggagcagaggcaacgtgatcgagaagatgctgaccgacagaagaagcaccgacctgaacgagagcagaagagccgacgtgctggccttccccagcagcggcttcaccgacctggccgagatcgtgagcagaatcgagccccccaccagctacgtgagcgacggctgcgccgacggcgaggagagcgactgcctgaccgagtacgaggaggacgccggccccgactgcagcagagacgagggcggcagccccgagggcgccagccccagcaccgccagcgagatggaggaggagaagagcatcctgagacagagaagatgcctgccccaggagccccccggcagcgccaccgacgcctag

SEQ ID NO: 12192 - DNA, 846 bp, Artificial Sequence
  Description of Artificial Sequence: Synthetic coding sequence
atgggccacccccccctgctgcccctgctgctgctgctgcacacctgcgtgcccgccagctggggcctgagatgcatgcagtgcaagaccaacggcgactgcagagtggaggagtgcgccctgggccaggacctgtgcagaaccaccatcgtgagactgtgggaggagggcgaggagctggagctggtggagaagagctgcacccacagcgagaagaccaacagaaccctgagctacagaaccggcctgaagatcaccagcctgaccgaggtggtgtgcggcctggacctgtgcaaccagggcaacagcggcagagccgtgacctacagcagaagcagatacctggagtgcatcagctgcggcagcagcgacatgagctgcgagagaggcagacaccagagcctgcagtgcagaagccccgaggagcagtgcctggacgtggtgacccactggatccaggagggcgaggagggcagacccaaggacgacagacacctgagaggctgcggctacctgcccggctgccccggcagcaacggcttccacaacaacgacaccttccacttcctgaagtgctgcaacaccaccaagtgcaacgagggccccatcctggagctggagaacctgccccagaacggcagacagtgctacagctgcaagggcaacagcacccacggctgcagcagcgaggagaccttcctgatcgactgcagaggccccatgaaccagtgcctggtggccaccggcacccacgagagaagcctgtggggcagctggctgccctgcaagagcaccaccgccctgagacccccctgctgcgaggaggcccaggccacccacgtgtag

SEQ ID NO: 12193 - DNA, 1008 bp, Artificial Sequence
  Description of Artificial Sequence: Synthetic coding sequence
atgggccacccccccctgctgcccctgctgctgctgctgcacacctgcgtgcccgccagctggggcctgagatgcatgcagtgcaagaccaacggcgactgcagagtggaggagtgcgccctgggccaggacctgtgcagaaccaccatcgtgagactgtgggaggagggcgaggagctggagctggtggagaagagctgcacccacagcgagaagaccaacagaaccctgagctacagaaccggcctgaagatcaccagcctgaccgaggtggtgtgcggcctggacctgtgcaaccagggcaacagcggcagagccgtgacctacagcagaagcagatacctggagtgcatcagctgcggcagcagcgacatgagctgcgagagaggcagacaccagagcctgcagtgcagaagccccgaggagcagtgcctggacgtggtgacccactggatccaggagggcgaggagggcagacccaaggacgacagacacctgagaggctgcggctacctgcccggctgccccggcagcaacggcttccacaacaacgacaccttccacttcctgaagtgctgcaacaccaccaagtgcaacgagggccccatcctggagctggagaacctgccccagaacggcagacagtgctacagctgcaagggcaacagcacccacggctgcagcagcgaggagaccttcctgatcgactgcagaggccccatgaaccagtgcctggtggccaccggcacccacgagcccaagaaccagagctacatggtgagaggctgcgccaccgccagcatgtgccagcacgcccacctgggcgacgccttcagcatgaaccacatcgacgtgagctgctgcaccaagagcggctgcaaccaccccgacctggacgtgcagtacagaagcggcgccgccccccagcccggccccgcccacctgagcctgaccatcaccctgctgatgaccgccagactgtggggcggcaccctgctgtggacctag

SEQ ID NO: 12194 - DNA, 1038 bp, Artificial Sequence
  Description of Artificial Sequence: Synthetic coding sequence
atgagcctgttcggcctgctgctgctgaccagcgccctggccggccagagacagggcacccaggccgagagcaacctgagcagcaagttccagttcagcagcaacaaggagcagaacggcgtgcaggacccccagcacgagagaatcatcaccgtgagcaccaacggcagcatccacagccccagattcccccacacctaccccagaaacaccgtgctggtgtggagactggtggccgtggaggagaacgtgtggatccagctgaccttcgacgagagattcggcctggaggaccccgaggacgacatctgcaagtacgacttcgtggaggtggaggagcccagcgacggcaccatcctgggcagatggtgcggcagcggcaccgtgcccggcaagcagatcagcaagggcaaccagatcagaatcagattcgtgagcgacgagtacttccccagcgagcccggcttctgcatccactacaacatcgtgatgccccagttcaccgaggccgtgagccccagcgtgctgccccccagcgccctgcccctggacctgctgaacaacgccatcaccgccttcagcaccctggaggacctgatcagatacctggagcccgagagatggcagctggacctggaggacctgtacagacccacctggcagctgctgggcaaggccttcgtgttcggcagaaagagcagagtggtggacctgaacctgctgaccgaggaggtgagactgtacagctgcacccccagaaacttcagcgtgagcatcagagaggagctgaagagaaccgacaccatcttctggcccggctgcctgctggtgaagagatgcggcggcaactgcgcctgctgcctgcacaactgcaacgagtgccagtgcgtgcccagcaaggtgaccaagaagtaccacgaggtgctgcagctgagacccaagaccggcgtgagaggcctgcacaagagcctgaccgacgtggccctggagcaccacgaggagtgcgactgcgtgtgcagaggcagcaccggcggctag

SEQ ID NO: 12195 - DNA, 549 bp, Artificial Sequence
  Description of Artificial Sequence: Synthetic coding sequence
atgccccagttcaccgaggccgtgagccccagcgtgctgccccccagcgccctgcccctggacctgctgaacaacgccatcaccgccttcagcaccctggaggacctgatcagatacctggagcccgagagatggcagctggacctggaggacctgtacagacccacctggcagctgctgggcaaggccttcgtgttcggcagaaagagcagagtggtggacctgaacctgctgaccgaggaggtgagactgtacagctgcacccccagaaacttcagcgtgagcatcagagaggagctgaagagaaccgacaccatcttctggcccggctgcctgctggtgaagagatgcggcggcaactgcgcctgctgcctgcacaactgcaacgagtgccagtgcgtgcccagcaaggtgaccaagaagtaccacgaggtgctgcagctgagacccaagaccggcgtgagaggcctgcacaagagcctgaccgacgtggccctggagcaccacgaggagtgcgactgcgtgtgcagaggcagcaccggcggctag

SEQ ID NO: 12196 - DNA, 573 bp, Artificial Sequence
  Description of Artificial Sequence: Synthetic coding sequence
atgatgcagtacacctggctgctgaccaagcagttcaccgaggccgtgagccccagcgtgctgccccccagcgccctgcccctggacctgctgaacaacgccatcaccgccttcagcaccctggaggacctgatcagatacctggagcccgagagatggcagctggacctggaggacctgtacagacccacctggcagctgctgggcaaggccttcgtgttcggcagaaagagcagagtggtggacctgaacctgctgaccgaggaggtgagactgtacagctgcacccccagaaacttcagcgtgagcatcagagaggagctgaagagaaccgacaccatcttctggcccggctgcctgctggtgaagagatgcggcggcaactgcgcctgctgcctgcacaactgcaacgagtgccagtgcgtgcccagcaaggtgaccaagaagtaccacgaggtgctgcagctgagacccaagaccggcgtgagaggcctgcacaagagcctgaccgacgtggccctggagcaccacgaggagtgcgactgcgtgtgcagaggcagcaccggcggctag

SEQ ID NO: 12197 - DNA, 504 bp, Artificial Sequence
  Description of Artificial Sequence: Synthetic coding sequence
atgagcctgttcggcctgctgctgctgaccagcgccctggccggccagagacagggcacccaggccgagagcaacctgagcagcaagttccagttcagcagcaacaaggagcagaacggcgtgcaggacccccagcacgagagaatcatcaccgtgagcaccaacggcagcatccacagccccagattcccccacacctaccccagaaacaccgtgctggtgtggagactggtggccgtggaggagaacgtgtggatccagctgaccttcgacgagagattcggcctggaggaccccgaggacgacatctgcaagtacgacttcgtggaggtggaggagcccagcgacggcaccatcctgggcagatggtgcggcagcggcaccgtgcccggcaagcagatcagcaagggcaaccagatcagaatcagattcgtgagcgacgagtacttccccagcgagcccagcaacagaggcggcaagatcatccagctgcacaccagctag

SEQ ID NO: 12198 - DNA, 2217 bp, Artificial Sequence
  Description of Artificial Sequence: Synthetic coding sequence
atgcagcccagatgggcccagggcgccaccatgtggctgggcgtgctgctgaccctgctgctgtgcagcagcctggagggccaggagaacagcttcaccatcaacagcgtggacatgaagagcctgcccgactggaccgtgcagaacggcaagaacctgaccctgcagtgcttcgccgacgtgagcaccaccagccacgtgaagccccagcaccagatgctgttctacaaggacgacgtgctgttctacaacatcagcagcatgaagagcaccgagagctacttcatccccgaggtgagaatctacgacagcggcacctacaagtgcaccgtgatcgtgaacaacaaggagaagaccaccgccgagtaccaggtgctggtggagggcgtgcccagccccagagtgaccctggacaagaaggaggccatccagggcggcatcgtgagagtgaactgcagcgtgcccgaggagaaggcccccatccacttcaccatcgagaagctggagctgaacgagaagatggtgaagctgaagagagagaagaacagcagagaccagaacttcgtgatcctggagttccccgtggaggagcaggacagagtgctgagcttcagatgccaggccagaatcatcagcggcatccacatgcagaccagcgagagcaccaagagcgagctggtgaccgtgaccgagagcttcagcacccccaagttccacatcagccccaccggcatgatcatggagggcgcccagctgcacatcaagtgcaccatccaggtgacccacctggcccaggagttccccgagatcatcatccagaaggacaaggccatcgtggcccacaacagacacggcaacaaggccgtgtacagcgtgatggccatggtggagcacagcggcaactacacctgcaaggtggagagcagcagaatcagcaaggtgagcagcatcgtggtgaacatcaccgagctgttcagcaagcccgagctggagagcagcttcacccacctggaccagggcgagagactgaacctgagctgcagcatccccggcgccccccccgccaacttcaccatccagaaggaggacaccatcgtgagccagacccaggacttcaccaagatcgccagcaagagcgacagcggcacctacatctgcaccgccggcatcgacaaggtggtgaagaagagcaacaccgtgcagatcgtggtgtgcgagatgctgagccagcccagaatcagctacgacgcccagttcgaggtgatcaagggccagaccatcgaggtgagatgcgagagcatcagcggcaccctgcccatcagctaccagctgctgaagaccagcaaggtgctggagaacagcaccaagaacagcaacgaccccgccgtgttcaaggacaaccccaccgaggacgtggagtaccagtgcgtggccgacaactgccacagccacgccaagatgctgagcgaggtgctgagagtgaaggtgatcgcccccgtggacgaggtgcagatcagcatcctgagcagcaaggtggtggagagcggcgaggacatcgtgctgcagtgcgccgtgaacgagggcagcggccccatcacctacaagttctacagagagaaggagggcaagcccttctaccagatgaccagcaacgccacccaggccttctggaccaagcagaaggccagcaaggagcaggagggcgagtactactgcaccgccttcaacagagccaaccacgccagcagcgtgcccagaagcaagatcctgaccgtgagagtgatcctggccccctggaagaagggcctgatcgccgtggtgatcatcggcgtgatcatcgccctgctgatcatcgccgccaagtgctacttcctgagaaaggccaaggccaagcagatgcccgtggagatgagcagacccgccgtgcccctgctgaacagcaacaacgagaagatgagcgaccccaacatggaggccaacagccactacggccacaacgacgacgtgagaaaccacgccatgaagcccatcaacgacaacaaggagcccctgaacagcgacgtgcagtacaccgaggtgcaggtgagcagcgccgagagccacaaggacctgggcaagaaggacaccgagaccgtgtacagcgaggtgagaaaggccgtgcccgacgccgtggagagcagatacagcagaaccgagggcagcctggacggcacctag

SEQ ID NO: 12199 - DNA, 636 bp, Artificial Sequence
  Description of Artificial Sequence: Synthetic coding sequence
atgagaaccctggcctgcctgctgctgctgggctgcggctacctggcccacgtgctggccgaggaggccgagatccccagagaggtgatcgagagactggccagaagccagatccacagcatcagagacctgcagagactgctggagatcgacagcgtgggcagcgaggacagcctggacaccagcctgagagcccacggcgtgcacgccaccaagcacgtgcccgagaagagacccctgcccatcagaagaaagagaagcatcgaggaggccgtgcccgccgtgtgcaagaccagaaccgtgatctacgagatccccagaagccaggtggaccccaccagcgccaacttcctgatctggcccccctgcgtggaggtgaagagatgcaccggctgctgcaacaccagcagcgtgaagtgccagcccagcagagtgcaccacagaagcgtgaaggtggccaaggtggagtacgtgagaaagaagcccaagctgaaggaggtgcaggtgagactggaggagcacctggagtgcgcctgcgccaccaccagcctgaaccccgactacagagaggaggacaccggcagacccagagagagcggcaagaagagaaagagaaagagactgaagcccacctag

SEQ ID NO: 12200 - DNA, 591 bp, Artificial Sequence
  Description of Artificial Sequence: Synthetic coding sequence
atgagaaccctggcctgcctgctgctgctgggctgcggctacctggcccacgtgctggccgaggaggccgagatccccagagaggtgatcgagagactggccagaagccagatccacagcatcagagacctgcagagactgctggagatcgacagcgtgggcagcgaggacagcctggacaccagcctgagagcccacggcgtgcacgccaccaagcacgtgcccgagaagagacccctgcccatcagaagaaagagaagcatcgaggaggccgtgcccgccgtgtgcaagaccagaaccgtgatctacgagatccccagaagccaggtggaccccaccagcgccaacttcctgatctggcccccctgcgtggaggtgaagagatgcaccggctgctgcaacaccagcagcgtgaagtgccagcccagcagagtgcaccacagaagcgtgaaggtggccaaggtggagtacgtgagaaagaagcccaagctgaaggaggtgcaggtgagactggaggagcacctggagtgcgcctgcgccaccaccagcctgaaccccgactacagagaggaggacaccgacgtgagatag

SEQ ID NO: 12201 - DNA, 162 bp, Artificial Sequence
  Description of Artificial Sequence: Synthetic coding sequence
atgagaaccctggcctgcctgctgctgctgggctgcggctacctggcccacgtgctggccgaggaggccgagatccccagagaggtgatcgagagactggccagaagccagatccacagcatcagagacctgcagagactgctggagatcgacagcgtgtag

SEQ ID NO: 12202 - DNA, 3270 bp, Artificial Sequence
  Description of Artificial Sequence: Synthetic coding sequence
atgggcaccagccaccccgccttcctggtgctgggctgcctgctgaccggcctgagcctgatcctgtgccagctgagcctgcccagcatcctgcccaacgagaacgagaaggtggtgcagctgaacagcagcttcagcctgagatgcttcggcgagagcgaggtgagctggcagtaccccatgagcgaggaggagagcagcgacgtggagatcagaaacgaggagaacaacagcggcctgttcgtgaccgtgctggaggtgagcagcgccagcgccgcccacaccggcctgtacacctgctactacaaccacacccagaccgaggagaacgagctggagggcagacacatctacatctacgtgcccgaccccgacgtggccttcgtgcccctgggcatgaccgactacctggtgatcgtggaggacgacgacagcgccatcatcccctgcagaaccaccgaccccgagacccccgtgaccctgcacaacagcgagggcgtggtgcccgccagctacgacagcagacagggcttcaacggcaccttcaccgtgggcccctacatctgcgaggccaccgtgaagggcaagaagttccagaccatccccttcaacgtgtacgccctgaaggccaccagcgagctggacctggagatggaggccctgaagaccgtgtacaagagcggcgagaccatcgtggtgacctgcgccgtgttcaacaacgaggtggtggacctgcagtggacctaccccggcgaggtgaagggcaagggcatcaccatgctggaggagatcaaggtgcccagcatcaagctggtgtacaccctgaccgtgcccgaggccaccgtgaaggacagcggcgactacgagtgcgccgccagacaggccaccagagaggtgaaggagatgaagaaggtgaccatcagcgtgcacgagaagggcttcatcgagatcaagcccaccttcagccagctggaggccgtgaacctgcacgaggtgaagcacttcgtggtggaggtgagagcctaccccccccccagaatcagctggctgaagaacaacctgaccctgatcgagaacctgaccgagatcaccaccgacgtggagaagatccaggagatcagatacagaagcaagctgaagctgatcagagccaaggaggaggacagcggccactacaccatcgtggcccagaacgaggacgccgtgaagagctacaccttcgagctgctgacccaggtgcccagcagcatcctggacctggtggacgaccaccacggcagcaccggcggccagaccgtgagatgcaccgccgagggcacccccctgcccgacatcgagtggatgatctgcaaggacatcaagaagtgcaacaacgagaccagctggaccatcctggccaacaacgtgagcaacatcatcaccgagatccacagcagagacagaagcaccgtggagggcagagtgaccttcgccaaggtggaggagaccatcgccgtgagatgcctggccaagaacctgctgggcgccgagaacagagagctgaagctggtggcccccaccctgagaagcgagctgaccgtggccgccgccgtgctggtgctgctggtgatcgtgatcatcagcctgatcgtgctggtggtgatctggaagcagaagcccagatacgagatcagatggagagtgatcgagagcatcagccccgacggccacgagtacatctacgtggaccccatgcagctgccctacgacagcagatgggagttccccagagacggcctggtgctgggcagagtgctgggcagcggcgccttcggcaaggtggtggagggcaccgcctacggcctgagcagaagccagcccgtgatgaaggtggccgtgaagatgctgaagcccaccgccagaagcagcgagaagcaggccctgatgagcgagctgaagatcatgacccacctgggcccccacctgaacatcgtgaacctgctgggcgcctgcaccaagagcggccccatctacatcatcaccgagtactgcttctacggcgacctggtgaactacctgcacaagaacagagacagcttcctgagccaccaccccgagaagcccaagaaggagctggacatcttcggcctgaaccccgccgacgagagcaccagaagctacgtgatcctgagcttcgagaacaacggcgactacatggacatgaagcaggccgacaccacccagtacgtgcccatgctggagagaaaggaggtgagcaagtacagcgacatccagagaagcctgtacgacagacccgccagctacaagaagaagagcatgctggacagcgaggtgaagaacctgctgagcgacgacaacagcgagggcctgaccctgctggacctgctgagcttcacctaccaggtggccagaggcatggagttcctggccagcaagaactgcgtgcacagagacctggccgccagaaacgtgctgctggcccagggcaagatcgtgaagatctgcgacttcggcctggccagagacatcatgcacgacagcaactacgtgagcaagggcagcaccttcctgcccgtgaagtggatggcccccgagagcatcttcgacaacctgtacaccaccctgagcgacgtgtggagctacggcatcctgctgtgggagatcttcagcctgggcggcaccccctaccccggcatgatggtggacagcaccttctacaacaagatcaagagcggctacagaatggccaagcccgaccacgccaccagcgaggtgtacgagatcatggtgaagtgctggaacagcgagcccgagaagagacccagcttctaccacctgagcgagatcgtggagaacctgctgcccggccagtacaagaagagctacgagaagatccacctggacttcctgaagagcgaccaccccgccgtggccagaatgagagtggacagcgacaacgcctacatcggcgtgacctacaagaacgaggaggacaagctgaaggactgggagggcggcctggacgagcagagactgagcgccgacagcggctacatcatccccctgcccgacatcgaccccgtgcccgaggaggaggacctgggcaagagaaacagacacagcagccagaccagcgaggagagcgccatcgagaccggcagcagcagcagcaccttcatcaagagagaggacgagaccatcgaggacatcgacatgatggacgacatcggcatcgacagcagcgacctggtggaggacagcttcctgtag

SEQ ID NO: 12203 - DNA, 480 bp, Artificial Sequence
  Description of Artificial Sequence: Synthetic coding sequence
atgggcaccagccaccccgccttcctggtgctgggctgcctgctgaccggcctgagcctgatcctgtgccagctgagcctgcccagcatcctgcccaacgagaacgagaaggtggtgcagctgaacagcagcttcagcctgagatgcttcggcgagagcgaggtgagctggcagtaccccatgagcgaggaggagagcagcgacgtggagatcagaaacgaggagaacaacagcggcctgttcgtgaccgtgctggaggtgagcagcgccagcgccgcccacaccggcctgtacacctgctactacaaccacacccagaccgaggagaacgagctggagggcagacacatctacatctacgtgcccgaccccgacgtggccttcgtgcccctgggcatgaccgactacctggtgatcgtggaggacgacgacagcgccatcatcccctgcagaaccaccgaccccgagacccccgtgtag

SEQ ID NO: 12204 - DNA, 477 bp, Artificial Sequence
  Description of Artificial Sequence: Synthetic coding sequence
atgggcaccagccaccccgccttcctggtgctgggctgcctgctgaccggcctgagcctgatcctgtgccagctgagcctgcccagcatcctgcccaacgagaacgagaaggtggtgcagctgaacagcagcttcagcctgagatgcttcggcgagagcgaggtgagctggcagtaccccatgagcgaggaggagagcagcgacgtggagatcagaaacgaggagaacaacagcggcctgttcgtgaccgtgctggaggtgagcagcgccagcgccgcccacaccggcctgtacacctgctactacaaccacacccagaccgaggagaacgagctggagggcagacacatctacatctacgtgcccgaccccgacgtggccttcgtgcccctgggcatgaccgactacctggtgatcgtggaggacgacgacagcgccatcatcccctgcagaaccaccgaccccgagaccccctag

SEQ ID NO: 12205 - DNA, 657 bp, Artificial Sequence
  Description of Artificial Sequence: Synthetic coding sequence
atgggcaccagccaccccgccttcctggtgctgggctgcctgctgaccggcctgagcctgatcctgtgccagctgagcctgcccagcatcctgcccaacgagaacgagaaggtggtgcagctgaacagcagcttcagcctgagatgcttcggcgagagcgaggtgagctggcagtaccccatgagcgaggaggagagcagcgacgtggagatcagaaacgaggagaacaacagcggcctgttcgtgaccgtgctggaggtgagcagcgccagcgccgcccacaccggcctgtacacctgctactacaaccacacccagaccgaggagaacgagctggagggcagacacatctacatctacgtgcccgaccccgacgtggccttcgtgcccctgggcatgaccgactacctggtgatcgtggaggacgacgacagcgccatcatcccctgcagaaccaccgaccccgagacccccgtgaccctgcacaacagcgagggcgtggtgcccgccagctacgacagcagacagggcttcaacggcaccttcaccgtgggcccctacatctgcgaggccaccgtgaagggcaagaagttccagaccatccccttcaacgtgtacgccctgaagggcacctgcatcatcagcttcctgctgtag

SEQ ID NO: 12206 - DNA, 465 bp, Artificial Sequence
  Description of Artificial Sequence: Synthetic coding sequence
atgggcaccagccaccccgccttcctggtgctgggctgcctgctgaccggcctgagcctgatcctgtgccagctgagcctgcccagcatcctgcccaacgagaacgagaaggtggtgcagctgaacagcagcttcagcctgagatgcttcggcgagagcgaggtgagctggcagtaccccatgagcgaggaggagagcagcgacgtggagatcagaaacgaggagaacaacagcggcctgttcgtgaccgtgctggaggtgagcagcgccagcgccgcccacaccggcctgtacacctgctactacaaccacacccagaccgaggagaacgagctggagggcagacacatctacatctacgtgcccgaccccgacgtggccttcgtgcccctgggcatgaccgactacctggtgatcgtggaggacgacgacagcgccatcatcccctgcagaaccaccgactag

SEQ ID NO: 12207 - DNA, 3321 bp, Artificial Sequence
  Description of Artificial Sequence: Synthetic coding sequence
atgagactgcccggcgccatgcccgccctggccctgaagggcgagctgctgctgctgagcctgctgctgctgctggagccccagatcagccagggcctggtggtgaccccccccggccccgagctggtgctgaacgtgagcagcaccttcgtgctgacctgcagcggcagcgcccccgtggtgtgggagagaatgagccaggagcccccccaggagatggccaaggcccaggacggcaccttcagcagcgtgctgaccctgaccaacctgaccggcctggacaccggcgagtacttctgcacccacaacgacagcagaggcctggagaccgacgagagaaagagactgtacatcttcgtgcccgaccccaccgtgggcttcctgcccaacgacgccgaggagctgttcatcttcctgaccgagatcaccgagatcaccatcccctgcagagtgaccgacccccagctggtggtgaccctgcacgagaagaagggcgacgtggccctgcccgtgccctacgaccaccagagaggcttcagcggcatcttcgaggacagaagctacatctgcaagaccaccatcggcgacagagaggtggacagcgacgcctactacgtgtacagactgcaggtgagcagcatcaacgtgagcgtgaacgccgtgcagaccgtggtgagacagggcgagaacatcaccctgatgtgcatcgtgatcggcaacgaggtggtgaacttcgagtggacctaccccagaaaggagagcggcagactggtggagcccgtgaccgacttcctgctggacatgccctaccacatcagaagcatcctgcacatccccagcgccgagctggaggacagcggcacctacacctgcaacgtgaccgagagcgtgaacgaccaccaggacgagaaggccatcaacatcaccgtggtggagagcggctacgtgagactgctgggcgaggtgggcaccctgcagttcgccgagctgcacagaagcagaaccctgcaggtggtgttcgaggcctaccccccccccaccgtgctgtggttcaaggacaacagaaccctgggcgacagcagcgccggcgagatcgccctgagcaccagaaacgtgagcgagaccagatacgtgagcgagctgaccctggtgagagtgaaggtggccgaggccggccactacaccatgagagccttccacgaggacgccgaggtgcagctgagcttccagctgcagatcaacgtgcccgtgagagtgctggagctgagcgagagccaccccgacagcggcgagcagaccgtgagatgcagaggcagaggcatgccccagcccaacatcatctggagcgcctgcagagacctgaagagatgccccagagagctgccccccaccctgctgggcaacagcagcgaggaggagagccagctggagaccaacgtgacctactgggaggaggagcaggagttcgaggtggtgagcaccctgagactgcagcacgtggacagacccctgagcgtgagatgcaccctgagaaacgccgtgggccaggacacccaggaggtgatcgtggtgccccacagcctgcccttcaaggtggtggtgatcagcgccatcctggccctggtggtgctgaccatcatcagcctgatcatcctgatcatgctgtggcagaagaagcccagatacgagatcagatggaaggtgatcgagagcgtgagcagcgacggccacgagtacatctacgtggaccccatgcagctgccctacgacagcacctgggagctgcccagagaccagctggtgctgggcagaaccctgggcagcggcgccttcggccaggtggtggaggccaccgcccacggcctgagccacagccaggccaccatgaaggtggccgtgaagatgctgaagagcaccgccagaagcagcgagaagcaggccctgatgagcgagctgaagatcatgagccacctgggcccccacctgaacgtggtgaacctgctgggcgcctgcaccaagggcggccccatctacatcatcaccgagtactgcagatacggcgacctggtggactacctgcacagaaacaagcacaccttcctgcagcaccacagcgacaagagaagaccccccagcgccgagctgtacagcaacgccctgcccgtgggcctgcccctgcccagccacgtgagcctgaccggcgagagcgacggcggctacatggacatgagcaaggacgagagcgtggactacgtgcccatgctggacatgaagggcgacgtgaagtacgccgacatcgagagcagcaactacatggccccctacgacaactacgtgcccagcgcccccgagagaacctgcagagccaccctgatcaacgagagccccgtgctgagctacatggacctggtgggcttcagctaccaggtggccaacggcatggagttcctggccagcaagaactgcgtgcacagagacctggccgccagaaacgtgctgatctgcgagggcaagctggtgaagatctgcgacttcggcctggccagagacatcatgagagacagcaactacatcagcaagggcagcaccttcctgcccctgaagtggatggcccccgagagcatcttcaacagcctgtacaccaccctgagcgacgtgtggagcttcggcatcctgctgtgggagatcttcaccctgggcggcaccccctaccccgagctgcccatgaacgagcagttctacaacgccatcaagagaggctacagaatggcccagcccgcccacgccagcgacgagatctacgagatcatgcagaagtgctgggaggagaagttcgagatcagaccccccttcagccagctggtgctgctgctggagagactgctgggcgagggctacaagaagaagtaccagcaggtggacgaggagttcctgagaagcgaccaccccgccatcctgagaagccaggccagactgcccggcttccacggcctgagaagccccctggacaccagcagcgtgctgtacaccgccgtgcagcccaacgagggcgacaacgactacatcatccccctgcccgaccccaagcccgaggtggccgacgagggccccctggagggcagccccagcctggccagcagcaccctgaacgaggtgaacaccagcagcaccatcagctgcgacagccccctggagccccaggacgagcccgagcccgagccccagctggagctgcaggtggagcccgagcccgagctggagcagctgcccgacagcggctgccccgcccccagagccgaggccgaggacagcttcctgtag

SEQ ID NO: 12208 - DNA, 525 bp, Artificial Sequence
  Description of Artificial Sequence: Synthetic coding sequence
atgagactgcccggcgccatgcccgccctggccctgaagggcgagctgctgctgctgagcctgctgctgctgctggagccccagatcagccagggcctggtggtgaccccccccggccccgagctggtgctgaacgtgagcagcaccttcgtgctgacctgcagcggcagcgcccccgtggtgtgggagagaatgagccaggagcccccccaggagatggccaaggcccaggacggcaccttcagcagcgtgctgaccctgaccaacctgaccggcctggacaccggcgagtacttctgcacccacaacgacagcagaggcctggagaccgacgagagaaagagactgtacatcttcgtgcccgaccccaccgtgggcttcctgcccaacgacgccgaggagctgttcatcttcctgaccgagatcaccgagatcaccatcccctgcagagtgaccgacccccagctggtggtgaccctgcacgagaagaagggcgacgtggccctgcccgtgccctacgactag

SEQ ID NO: 12209 - DNA, 2331 bp, Artificial Sequence
  Description of Artificial Sequence: Synthetic coding sequence
gccgccagcgagcccgacaccgccggcagcgtgagaggcctgcccaccgcccactgccccgtggtggacaacagaaccctgggcgacagcagcgccggcgagatcgccctgagcaccagaaacgtgagcgagaccagatacgtgagcgagctgaccctggtgagagtgaaggtggccgaggccggccactacaccatgagagccttccacgaggacgccgaggtgcagctgagcttccagctgcagatcaacgtgcccgtgagagtgctggagctgagcgagagccaccccgacagcggcgagcagaccgtgagatgcagaggcagaggcatgccccagcccaacatcatctggagcgcctgcagagacctgaagagatgccccagagagctgccccccaccctgctgggcaacagcagcgaggaggagagccagctggagaccaacgtgacctactgggaggaggagcaggagttcgaggtggtgagcaccctgagactgcagcacgtggacagacccctgagcgtgagatgcaccctgagaaacgccgtgggccaggacacccaggaggtgatcgtggtgccccacagcctgcccttcaaggtggtggtgatcagcgccatcctggccctggtggtgctgaccatcatcagcctgatcatcctgatcatgctgtggcagaagaagcccagatacgagatcagatggaaggtgatcgagagcgtgagcagcgacggccacgagtacatctacgtggaccccatgcagctgccctacgacagcacctgggagctgcccagagaccagctggtgctgggcagaaccctgggcagcggcgccttcggccaggtggtggaggccaccgcccacggcctgagccacagccaggccaccatgaaggtggccgtgaagatgctgaagagcaccgccagaagcagcgagaagcaggccctgatgagcgagctgaagatcatgagccacctgggcccccacctgaacgtggtgaacctgctgggcgcctgcaccaagggcggccccatctacatcatcaccgagtactgcagatacggcgacctggtggactacctgcacagaaacaagcacaccttcctgcagcaccacagcgacaagagaagaccccccagcgccgagctgtacagcaacgccctgcccgtgggcctgcccctgcccagccacgtgagcctgaccggcgagagcgacggcggctacatggacatgagcaaggacgagagcgtggactacgtgcccatgctggacatgaagggcgacgtgaagtacgccgacatcgagagcagcaactacatggccccctacgacaactacgtgcccagcgcccccgagagaacctgcagagccaccctgatcaacgagagccccgtgctgagctacatggacctggtgggcttcagctaccaggtggccaacggcatggagttcctggccagcaagaactgcgtgcacagagacctggccgccagaaacgtgctgatctgcgagggcaagctggtgaagatctgcgacttcggcctggccagagacatcatgagagacagcaactacatcagcaagggcagcaccttcctgcccctgaagtggatggcccccgagagcatcttcaacagcctgtacaccaccctgagcgacgtgtggagcttcggcatcctgctgtgggagatcttcaccctgggcggcaccccctaccccgagctgcccatgaacgagcagttctacaacgccatcaagagaggctacagaatggcccagcccgcccacgccagcgacgagatctacgagatcatgcagaagtgctgggaggagaagttcgagatcagaccccccttcagccagctggtgctgctgctggagagactgctgggcgagggctacaagaagaagtaccagcaggtggacgaggagttcctgagaagcgaccaccccgccatcctgagaagccaggccagactgcccggcttccacggcctgagaagccccctggacaccagcagcgtgctgtacaccgccgtgcagcccaacgagggcgacaacgactacatcatccccctgcccgaccccaagcccgaggtggccgacgagggccccctggagggcagccccagcctggccagcagcaccctgaacgaggtgaacaccagcagcaccatcagctgcgacagccccctggagccccaggacgagcccgagcccgagccccagctggagctgcaggtggagcccgagcccgagctggagcagctgcccgacagcggctgccccgcccccagagccgaggccgaggacagcttcctgtag

SEQ ID NO: 12210 - DNA, 891 bp, Artificial Sequence
  Description of Artificial Sequence: Synthetic coding sequence
atgggcctgagccacagcaagacccacctgagagtgatcaaggtggcccccctgcagaacaaggaggtggagacccccagcgccggcagagtggacttcgccttcaaccagaacctggaggagaagaccagctacagcctggccagactgcaggaccagaacaaggccctggagggccagctgccccccctgcaggagaactggtacggcagatacagcaccgccagcagagacatgtacttcgacatccccctggagcacagagagaccagcatcatcaagagacaccccccccagagactgcagaagctggagcccatcgacctgcccagagtgatcaccagcggcagactgctgagccagagagaggccagaaccatgcacaaggccaagcaggtgctggagaagaagatgcagacccccatgtacaccagcgagaacagacagtacctgcacaagatgcaggtgctggagatgatcagaaagagacaggaggcccagatggagctgaagaagagcctgcacggcgaggccagaatcaacaagcagagccccagagaccacaaggccaagaagaccctgcagagcacccccagaaacgacgaccacgacctgctgaccatgctgcccgacgagatcctgaacagaggccccggcaacagcaagaacaccgagttcctgaagcaccaggccgtgaacaactactgcccctggaagatcggcaagatggagacctggctgcacgagcaggaggcccagggccagctgctgtgggacagcagcagcagcgacagcgacgagcagggcaaggacgagaagaagcccagagccctggtgagaaccagaaccgagagaatccccctgttcgacgagttcttcgaccaggagtag

SEQ ID NO: 12211 - DNA, 1734 bp, Artificial Sequence
  Description of Artificial Sequence: Synthetic coding sequence
atgcccgagggcgcccagggcctgagcctgagcaagcccagccccagcctgggctgcggcagaagaggcgaggtgtgcgactgcggcaccgtgtgcgagaccagaaccgcccccgccgcccccaccatggccagccccagaggcagcggcagcagcaccagcctgagcaccgtgggcagcgagggcgaccccgcccccggccccacccccgcctgcagcgccagcagacccgagcccctgcccggcccccccatcagactgcacctgagccccgtgggcatccccggcagcgccagacccagcagactggagagagtggccagagagatcgtggagaccgagagagcctacgtgagagacctgagaagcatcgtggaggactacctgggccccctgctggacggcggcgtgctgggcctgagcgtggagcaggtgggcaccctgttcgccaacatcgaggacatctacgagttcagcagcgagctgctggaggacctggagaacagcagcagcgccggcggcatcgccgagtgcttcgtgcagagaagcgaggacttcgacatctacaccctgtactgcatgaactaccccagcagcctggccctgctgagagagctgagcctgagcccccccgccgccctgtggctgcaggagagacaggcccagctgagacacagcctgcccctgcagagcttcctgctgaagcccgtgcagagaatcctgaagtaccacctgctgctgcaggagctgggcaagcactgggccgagggccccggcaccggcggcagagagatggtggaggaggccatcgtgagcatgaccgccgtggcctggtacatcaacgacatgaagagaaagcaggagcacgccgccagactgcaggaggtgcagagaagactgggcggctggaccggccccgagctgagcgccttcggcgagctggtgctggagggcgccttcagaggcggcggcggcggcggccccagactgagaggcggcgagagactgctgttcctgttcagcagaatgctgctggtggccaagagaagaggcctggagtacacctacaagggccacatcttctgctgcaacctgagcgtgagcgagagccccagagaccccctgggcttcaaggtgagcgacctgaccatccccaagcacagacacctgctgcaggccaagaaccaggaggagaagagactgtggatccactgcctgcagagactgttcttcgagaaccaccccgccagcatccccgccaaggccaagcaggtgctgctggagaacagcctgcactgcgcccccaagagcaagcccgtgctggagcccctgaccccccccctgggcagccccagacccagagacgccagaagcttcacccccggcagaagaaacaccgcccccagccccggccccagcgtgatcagaagaggcagaagacagagcgagcccgtgaaggacccctacgtgatgttcccccagaacgccaagcccggcttcaagcacgccggcagcgagggcgagctgtacccccccgagagccagccccccgtgagcggcagcgccccccccgaggacctggaggacgccggcccccccaccctggaccccagcggcaccagcatcaccgaggagatcctggagctgctgaaccagagaggcctgagagaccccggcgagagcatgggcctgcacagagcccagggcgcccccgacgcccccttccacatgtag

SEQ ID NO: 12212 - DNA, 4161 bp, Artificial Sequence
  Description of Artificial Sequence: Synthetic coding sequence
atgcccgagggcgcccagggcctgagcctgagcaagcccagccccagcctgggctgcggcagaagaggcgaggtgtgcgactgcggcaccgtgtgcgagaccagaaccgcccccgccgcccccaccatggccagccccagaggcagcggcagcagcaccagcctgagcaccgtgggcagcgagggcgaccccgcccccggccccacccccgcctgcagcgccagcagacccgagcccctgcccggcccccccatcagactgcacctgagccccgtgggcatccccggcagcgccagacccagcagactggagagagtggccagagagatcgtggagaccgagagagcctacgtgagagacctgagaagcatcgtggaggactacctgggccccctgctggacggcggcgtgctgggcctgagcgtggagcaggtgggcaccctgttcgccaacatcgaggacatctacgagttcagcagcgagctgctggaggacctggagaacagcagcagcgccggcggcatcgccgagtgcttcgtgcagagaagcgaggacttcgacatctacaccctgtactgcatgaactaccccagcagcctggccctgctgagagagctgagcctgagcccccccgccgccctgtggctgcaggagagacaggcccagctgagacacagcctgcccctgcagagcttcctgctgaagcccgtgcagagaatcctgaagtaccacctgctgctgcaggagctgggcaagcactgggccgagggccccggcaccggcggcagagagatggtggaggaggccatcgtgagcatgaccgccgtggcctggtacatcaacgacatgaagagaaagcaggagcacgccgccagactgcaggaggtgcagagaagactgggcggctggaccggccccgagctgagcgccttcggcgagctggtgctggagggcgccttcagaggcggcggcggcggcggccccagactgagaggcggcgagagactgctgttcctgttcagcagaatgctgctggtggccaagagaagaggcctggagtacacctacaagggccacatcttctgctgcaacctgagcgtgagcgagagccccagagaccccctgggcttcaaggtgagcgacctgaccatccccaagcacagacacctgctgcaggccaagaaccaggaggagaagagactgtggatccactgcctgcagagactgttcttcgagaaccaccccgccagcatccccgccaaggccaagcaggtgctgctggagaacagcctgcactgcgcccccaagagcaagcccgtgctggagcccctgaccccccccctgggcagccccagacccagagacgccagaagcttcacccccggcagaagaaacaccgcccccagccccggccccagcgtgatcagaagaggcagaagacagagcgagcccgtgaaggacccctacgtgatgttcccccagaacgccaagcccggcttcaagcacgccggcagcgagggcgagctgtacccccccgagagccagccccccgtgagcggcagcgccccccccgaggacctggaggacgccggcccccccaccctggaccccagcggcaccagcatcaccgaggagatcctggagctgctgaaccagagaggcctgagagaccccggccccagcacccacgacatccccaagttccccggcgacagccaggtgcccggcgacagcgagaccctgaccttccaggccctgcccagcagagacagcagcgaggaggaggaggaggaggaggagggcctggagatggacgagagaggccccagccccctgcacgtgctggagggcctggagagcagcatcgccgccgagatgcccagcatcccctgcctgaccaagatccccgacgtgcccaacctgcccgagatccccagcagatgcgagatccccgagggcagcagactgcccagcctgagcgacatcagcgacgtgttcgagatgccctgcctgcccgccatccccagcgtgcccaacacccccagcctgagcagcacccccaccctgagctgcgacagctggctgcagggccccctgcaggagcccgccgaggcccccgccaccagaagagagctgttcagcggcagcaaccccggcaagctgggcgagccccccagcggcggcaaggccggccccgaggaggacgaggagggcgtgagcttcaccgacttccagccccaggacgtgacccagcaccagggcttccccgacgagctggccttcagaagctgcagcgagatcagaagcgcctggcaggccctggagcagggccagctggccagacccggcttccccgagcccctgctgatcctggaggacagcgacctgggcggcgacagcggcagcggcaaggccggcgcccccagcagcgagagaaccgccagcagagtgagagagctggccagactgtacagcgagagaatccagcagatgcagagagccgagaccagagccagcgccaacgcccccagaagaagacccagagtgctggcccagccccagcccagcccctgcctgccccaggagcaggccgagcccggcctgctgcccgccttcggccacgtgctggtgtgcgagctggccttccccctgacctgcgcccaggagagcgtgcccctgggccccgccgtgtgggtgcaggccgccatccccctgagcaagcagggcggcagccccgacggccagggcctgcacgtgagcaacctgcccaagcaggacctgcccggcatccacgtgagcgccgccaccctgctgcccgagcagggcggcagcagacacgtgcaggcccccgccgccacccccctgcccaagcaggagggccccctgcacctgcaggtgcccgccctgaccaccttcagcgaccagggccaccccgagatccaggtgcccgccaccacccccctgcccgagcacagaagccacatggtgatccccgcccccagcaccgccttctgccccgagcagggccactgcgccgacatccacgtgcccaccacccccgccctgcccaaggagatctgcagcgacttcaccgtgagcgtgaccacccccgtgcccaagcaggagggccacctggacagcgagagccccaccaacatccccctgaccaagcagggcggcagcagagacgtgcagggccccgaccccgtgtgcagccagcccatccagcccctgagctggcacggcagcagcctggacccccagggccccggcgacaccctgccccccctgccctgccacctgcccgacctgcagatccccggcaccagccccctgcccgcccacggcagccacctggaccacagaatccccgccaacgcccccctgagcctgagccaggagctgcccgacacccaggtgcccgccaccacccccctgcccctgccccaggtgctgaccgacatctgggtgcaggccctgcccaccagccccaagcagggcagcctgcccgacatccagggccccgccgccgccccccccctgcccgagcccagcctgaccgacacccaggtgcagaagctgacccccagcctggagcagaagagcctgatcgacgcccacgtgcccgccgccacccccctgcccgagagaggcggcagcctggacatccagggcctgagccccacccccgtgcagaccaccatggtgctgagcaagcccggcggcagcctggccagccacgtggccagactggagagcagcgacctgacccccccccacagccccccccccagcagcagacagctgctgggccccaacgccgccgccctgagcagatacctggccgccagctacatcagccagagcctggccagaagacagggccccggcggcggcgcccccgccgccagcagaggcagctggagcagcgcccccaccagcagagccagcagcccccccccccagccccagcccccccccccccccgccagaagactgagctacgccaccaccgtgaacatccacgtgggcggcggcggcagactgagacccgccaaggcccaggtgagactgaaccaccccgccctgctggccagcacccaggagagcatgggcctgcacagagcccagggcgcccccgacgcccccttccacatgtag

SEQ ID NO: 12213 - DNA, 1734 bp, Artificial Sequence; identical to SEQ ID NO: 12211
  Description of Artificial Sequence: Synthetic coding sequence

SEQ ID NO: 12214 - DNA, 4074 bp, Artificial Sequence
  Description of Artificial Sequence: Synthetic coding sequence
atgcccgagggcgcccagggcctgagcctgagcaagcccagccccagcctgggctgcggcagaagaggcgaggtgtgcgactgcggcaccgtgtgcgagaccagaaccgcccccgccgcccccaccatggccagccccagaggcagcggcagcagcaccagcctgagcaccgtgggcagcgagggcgaccccgcccccggccccacccccgcctgcagcgccagcagacccgagcccctgcccggcccccccatcagactgcacctgagccccgtgggcatccccggcagcgccagacccagcagactggagagagtggccagagagatcgtggagaccgagagagcctacgtgagagacctgagaagcatcgtggaggactacctgggccccctgctggacggcggcgtgctgggcctgagcgtggagcaggtgggcaccctgttcgccaacatcgaggacatctacgagttcagcagcgagctgctggaggacctggagaacagcagcagcgccggcggcatcgccgagtgcttcgtgcagagaagcgaggacttcgacatctacaccctgtactgcatgaactaccccagcagcctggccctgctgagagagctgagcctgagcccccccgccgccctgtggctgcaggagagacaggcccagctgagacacagcctgcccctgcagagcttcctgctgaagcccgtgcagagaatcctgaagtaccacctgctgctgcaggagctgggcaagcactgggccgagggccccggcaccggcggcagagagatggtggaggaggccatcgtgagcatgaccgccgtggcctggtacatcaacgacatgaagagaaagcaggagcacgccgccagactgcaggaggtgcagagaagactgggcggctggaccggccccgagctgagcgccttcggcgagctggtgctggagggcgccttcagaggcggcggcggcggcggccccagactgagaggcggcgagagactgctgttcctgttcagcagaatgctgctggtggccaagagaagaggcctggagtacacctacaagggccacatcttctgctgcaacctgagcgtgagcgagagccccagagaccccctgggcttcaaggtgagcgacctgaccatccccaagcacagacacctgctgcaggccaagaaccaggaggagaagagactgtggatccactgcctgcagagactgttcttcgagaaccaccccgccagcatccccgccaaggccaagcaggtgctgctggagaacagcctgcactgcgcccccaagagcaagcccgtgctggagcccctgaccccccccctgggcagccccagacccagagacgccagaagcttcacccccggcagaagaaacaccgccaagcccggcttcaagcacgccggcagcgagggcgagctgtacccccccgagagccagccccccgtgagcggcagcgccccccccgaggacctggaggacgccggcccccccaccctggaccccagcggcaccagcatcaccgaggagatcctggagctgctgaaccagagaggcctgagagaccccggccccagcacccacgacatccccaagttccccggcgacagccaggtgcccggcgacagcgagaccctgaccttccaggccctgcccagcagagacagcagcgaggaggaggaggaggaggaggagggcctggagatggacgagagaggccccagccccctgcacgtgctggagggcctggagagcagcatcgccgccgagatgcccagcatcccctgcctgaccaagatccccgacgtgcccaacctgcccgagatccccagcagatgcgagatccccgagggcagcagactgcccagcctgagcgacatcagcgacgtgttcgagatgccctgcctgcccgccatccccagcgtgcccaacacccccagcctgagcagcacccccaccctgagctgcgacagctggctgcagggccccctgcaggagcccgccgaggcccccgccaccagaagagagctgttcagcggcagcaaccccggcaagctgggcgagccccccagcggcggcaaggccggccccgaggaggacgaggagggcgtgagcttcaccgacttccagccccaggacgtgacccagcaccagggcttccccgacgagctggccttcagaagctgcagcgagatcagaagcgcctggcaggccctggagcagggccagctggccagacccggcttccccgagcccctgctgatcctggaggacagcgacctgggcggcgacagcggcagcggcaaggccggcgcccccagcagcgagagaaccgccagcagagtgagagagctggccagactgtacagcgagagaatccagcagatgcagagagccgagaccagagccagcgccaacgcccccagaagaagacccagagtgctggcccagccccagcccagcccctgcctgccccaggagcaggccgagcccggcctgctgcccgccttcggccacgtgctggtgtgcgagctggccttccccctgacctgcgcccaggagagcgtgcccctgggccccgccgtgtgggtgcaggccgccatccccctgagcaagcagggcggcagccccgacggccagggcctgcacgtgagcaacctgcccaagcaggacctgcccggcatccacgtgagcgccgccaccctgctgcccgagcagggcggcagcagacacgtgcaggcccccgccgccacccccctgcccaagcaggagggccccctgcacctgcaggtgcccgccctgaccaccttcagcgaccagggccaccccgagatccaggtgcccgccaccacccccctgcccgagcacagaagccacatggtgatccccgcccccagcaccgccttctgccccgagcagggccactgcgccgacatccacgtgcccaccacccccgccctgcccaaggagatctgcagcgacttcaccgtgagcgtgaccacccccgtgcccaagcaggagggccacctggacagcgagagccccaccaacatccccctgaccaagcagggcggcagcagagacgtgcagggccccgaccccgtgtgcagccagcccatccagcccctgagctggcacggcagcagcctggacccccagggccccggcgacaccctgccccccctgccctgccacctgcccgacctgcagatccccggcaccagccccctgcccgcccacggcagccacctggaccacagaatccccgccaacgcccccctgagcctgagccaggagctgcccgacacccaggtgcccgccaccacccccctgcccctgccccaggtgctgaccgacatctgggtgcaggccctgcccaccagccccaagcagggcagcctgcccgacatccagggccccgccgccgccccccccctgcccgagcccagcctgaccgacacccaggtgcagaagctgacccccagcctggagcagaagagcctgatcgacgcccacgtgcccgccgccacccccctgcccgagagaggcggcagcctggacatccagggcctgagccccacccccgtgcagaccaccatggtgctgagcaagcccggcggcagcctggccagccacgtggccagactggagagcagcgacctgacccccccccacagccccccccccagcagcagacagctgctgggccccaacgccgccgccctgagcagatacctggccgccagctacatcagccagagcctggccagaagacagggccccggcggcggcgcccccgccgccagcagaggcagctggagcagcgcccccaccagcagagccagcagcccccccccccagccccagcccccccccccccccgccagaagactgagctacgccaccaccgtgaacatccacgtgggcggcggcggcagactgagacccgccaaggcccaggtgagactgaaccaccccgccctgctggccagcacccaggagagcatgggcctgcacagagcccagggcgcccccgacgcccccttccacatgtag

SEQ ID NO: 12215 - DNA, 597 bp, Artificial Sequence
  Description of Artificial Sequence: Synthetic coding sequence
atgcccgagggcgcccagggcctgagcctgagcaagcccagccccagcctgggctgcggcagaagaggcgaggtgtgcgactgcggcaccgtgtgcgagaccagaaccgccgcccccgccgcccccaccatggccagccccagaggcagcggcagcagcaccagcctgagcaccgtgggcagcgagggcgaccccgcccccggccccacccccgcctgcagcgccagcagacccgagcccctgcccggcccccccatcagactgcacctgagccccgtgggcatccccggcagcgccagacccagcagactggagagagtggccagagagatcgtggagaccgagagagcctacgtgagagacctgagaagcatcgtggaggactacctgggccccctgctggacggcggcgtgctgggcctgagcgtggagcaggtgggcaccctgttcgccaacatcgaggacatctacgagttcagcagcgagctgctggaggacctggagaacagcagcagcgccggcggcatcgccgagtgcttcgtgcagagaagcgaggacttcgacatctacaccctgtactgcatgaactacccctag

SEQ ID NO: 12216 - DNA, 3714 bp, Artificial Sequence
  Description of Artificial Sequence: Synthetic coding sequence
atgcccgagggcgcccagggcctgagcctgagcaagcccagccccagcctgggctgcggcagaagaggcgaggtgtgcgactgcggcaccgtgtgcgagaccagaaccggcagcgccagacccagcagactggagagagtggccagagagatcgtggagaccgagagagcctacgtgagagacctgagaagcatcgtggaggactacctgggccccctgctggacggcggcgtgctgggcctgagcgtggagcaggtgggcaccctgttcgccaacatcgaggacatctacgagttcagcagcgagctgctggaggacctggagaacagcagcagcgccggcggcatcgccgagtgcttcgtgcagagaagcgaggacttcgacatctacaccctgtactgcatgaactaccccagcagcctggccctgctgagagagctgagcctgagcccccccgccgccctgtggctgcaggagagacaggcccagctgagacacagcctgcccctgcagagcttcctgctgaagcccgtgcagagaatcctgaagtaccacctgctgctgcaggagctgggcaagcactgggccgagggccccggcaccggcggcagagagatggtggaggaggccatcgtgagcatgaccgccgtggcctggtacatcaacgacatgaagagaaagcaggagcacgccgccagactgcaggaggtgcagagaagactgggcggctggaccggccccgagctgagcgccttcggcgagctggtgctggagggcgccttcagaggcggcggcggcggcggccccagactgagaggcggcgagagactgctgttcctgttcagcagaatgctgctggtggccaagagaagaggcctggagtacacctacaagggccacatcttctgctgcaacctgagcgtgagcgagagccccagagaccccctgggcttcaaggtgagcgacctgaccatccccaagcacagacacctgctgcaggccaagaaccaggaggagaagagactgtggatccactgcctgcagagactgttcttcgagaaccaccccgccagcatccccgccaaggccaagcaggtgctgctggagaacagcctgcactgcgcccccaagagcaagcccgtgctggagcccctgaccccccccctgggcagccccagacccagagacgccagaagcttcacccccggcagaagaaacaccgcccccagccccggccccagcgtgatcagaagaggcagaagacagagcgagcccgtgaaggacccctacgtgatgttcccccagaacgccaagcccggcttcaagcacgccggcagcgagggcgagctgtacccccccgagagccagccccccgtgagcggcagcgccccccccgaggacctggaggacgccggcccccccaccctggaccccagcggcaccagcatcaccgaggagatcctggagctgctgaaccagagaggcctgagagaccccggccccagcacccacgacatccccaagttccccggcgacagccaggtgcccggcgacagcgagaccctgaccttccaggccctgcccagcagagacagcagcgaggaggaggaggaggaggaggagggcctggagatggacgagagaggccccagccccctgcacgtgctggagggcctggagagcagcatcgccgccgagatgcccagcatcccctgcctgaccaagatccccgacgtgcccaacctgcccgagatccccagcagatgcgagatccccgagggcagcagactgcccagcctgagcgacatcagcgacgtgttcgagatgccctgcctgcccgccatccccagcgtgcccaacacccccagcctgagcagcacccccaccctgagctgcgacagctggctgcagggccccctgcaggagcccgccgaggcccccgccaccagaagagagctgttcagcggcagcaaccccggcaagctgggcgagccccccagcggcggcaaggccggccccgaggaggacgaggagggcgtgagcttcaccgacttccagccccaggacgtgacccagcaccagggcttccccgacgagctggccttcagaagctgcagcgagatcagaagcgcctggcaggccctggagcagggccagctggccagacccggcttccccgagcccctgctgatcctggaggacagcgacctgggcggcgacagcggcagcggcaaggccggcgcccccagcagcgagagaaccgccagcagagtgagagagctggccagactgtacagcgagagaatccagcagatgcagagagccgagaccagagccagcgccaacgcccccagaagaagacccagagtgctggcccagccccagcccagcccctgcctgccccaggagcaggccgagcccggcctgctgcccgccttcggccacgtgctggtgtgcgagctggccttccccctgacctgcgcccaggagagcgtgcccctgggccccgccgtgtgggtgcaggccgccatccccctgagcaagcagggcggcagccccgacggccagggcctgcacgtgagcaacctgcccaagcaggacctgcccggcatccacgtgagcgccgccaccctgctgcccgagcagggcggcagcagacacgtgcaggcccccgccgccacccccctgcccaagcaggagggccccctgcacctgcaggtgcccgccctgaccaccttcagcgaccagggccaccccgagatccaggtgcccgccaccacccccctgcccgagcacagaagccacatggtgatccccgcccccagcaccgccttctgccccgagcagggccactgcgccgacatccacgtgcccaccacccccgccctgcccaaggagatctgcagcgacttcaccgtgagcgtgaccacccccgtgcccaagcaggagggccacctggacagcgagagccccaccaacatccccctgaccaagcagggcggcagcagagacgtgcagggccccgaccccgtgtgcagccagcccatccagcccctgagctggcacggcagcagcctggacccccagggccccggcgacaccctgccccccctgccctgccacctgcccgacctgcagatccccggcaccagccccctgcccgcccacggcagccacctggaccacagaatccccgccaacgcccccctgagcctgagccaggagctgcccgacacccaggtgcccgccaccacccccctgcccctgccccaggtgctgaccgacatctgggtgcaggccctgcccaccagccccaagcagggcagcctgcccgacatccagggccccgccgccgccccccccctgcccgagcccagcctgaccgacacccaggtgcagaagctgacccccagcctggagcagaagagcctgatcgacgcccacgtgcccgccgccacccccctgcccgagagaggcggcagcctggacatccagggcctgagccccacccccgtgcagaccaccatggtgctgagcaagcccggcggcagcctggccagccacgtggccagaaacctgtgggccttcaccggccccagaggcctgctgatgccccccagcacctgcgagcccggccacgaggccagcctgaagcagggcttccagcccgacgccatcgacccccagaacctgacctggaagagcagacactag

SEQ ID NO: 12217 - DNA, 1128 bp, Artificial Sequence
  Description of Artificial Sequence: Synthetic coding sequence
atgatgaagaagaacaacagcgccaagagaggcccccaggacggcaaccagcagcccgccccccccgagaaggtgggctgggtgagaaagttctgcggcaagggcatcttcagagagatctggaagaacagatacgtggtgctgaagggcgaccagctgtacatcagcgagaaggaggtgaaggacgagaagaacatccaggaggtgttcgacctgagcgactacgagaagtgcgaggagctgagaaagagcaagagcagaagcaagaagaaccacagcaagttcaccctggcccacagcaagcagcccggcaacaccgcccccaacctgatcttcctggccgtgagccccgaggagaaggagagctggatcaacgccctgaacagcgccatcaccagagccaagaacagaatcctggacgaggccagcaccagcaccagcgacggcatgctgaccctggacctgatccaggaggaggaccccagccccgaggagcccaccagctgcgccgagagcttcagagtggacctggacaagagcgtggcccagctggccggcagcagaagaagagccgacagcgacagaatccagcccagcgccgacagagccagcagcctgagcagaccctgggagaagaccgacaagggcgccacctacaccccccaggcccccaagaagctgacccccaccgagaagggcagatgcgccagcctggaggagatcctgagccagagagacgccgccagcgccagaaccctgcagctgagagccgaggagccccccacccccgccctgcccaaccccggccagctgagcagaatccaggacctggtggccagaaagctggaggagacccaggagctgctggccgaggtgcagggcctgggcgacggcaagagaaaggccaaggacccccccagaagcccccccgacagcgagagcgagcagctgctgctggagaccgagagactgctgggcgaggccagcagcaactggagccaggccaagagagtgctgcaggaggtgagagagctgagagacctgtacagacagatggacctgcagacccccgacagccacctgagacagaccaccccccacagccagtacagaaagagcctgatgtag

SEQ ID NO: 12218 - DNA, 1230 bp, Artificial Sequence
  Description of Artificial Sequence: Synthetic coding sequence
atgatgaagaagaacaacagcgccaagagaggcccccaggacggcaaccagcagcccgccccccccgagaaggtgggctgggtgagaaagttctgcggcaagggcatcttcagagagatctggaagaacagatacgtggtgctgaagggcgaccagctgtacatcagcgagaaggaggtgaaggacgagaagaacatccaggaggtgttcgacctgagcgactacgagaagtgcgaggagctgagaaagagcaagagcagaagcaagaagaaccacagcaagttcaccctggcccacagcaagcagcccggcaacaccgcccccaacctgatcttcctggccgtgagccccgaggagaaggagagctggatcaacgccctgaacagcgccatcaccagagccaagaacagaatcctggacgaggtgaccgtggaggaggacagctacctggcccaccccaccagagacagagccaagatccagcacagcagaagaccccccaccagaggccacctgatggccgtggccagcaccagcaccagcgacggcatgctgaccctggacctgatccaggaggaggaccccagccccgaggagcccaccagctgcgccgagagcttcagagtggacctggacaagagcgtggcccagctggccggcagcagaagaagagccgacagcgacagaatccagcccagcgccgacagagccagcagcctgagcagaccctgggagaagaccgacaagggcgccacctacaccccccaggcccccaagaagctgacccccaccgagaagggcagatgcgccagcctggaggagatcctgagccagagagacgccgccagcgccagaaccctgcagctgagagccgaggagccccccacccccgccctgcccaaccccggccagctgagcagaatccaggacctggtggccagaaagctggaggagacccaggagctgctggccgaggtgcagggcctgggcgacggcaagagaaaggccaaggacccccccagaagcccccccgacagcgagagcgagcagctgctgctggagaccgagagactgctgggcgaggccagcagcaactggagccaggccaagagagtgctgcaggaggtgagagagctgagagacctgtacagacagatggacctgcagacccccgacagccacctgagacagaccaccccccacagccagtacagaaagagcctgatgtag

SEQ ID NO: 12219 - DNA, 681 bp, Artificial Sequence
  Description of Artificial Sequence: Synthetic coding sequence
atgctgaccctggacctgatccaggaggaggaccccagccccgaggagcccaccagctgcgccgagagcttcagagtggacctggacaagagcgtggcccagctggccggcagcagaagaagagccgacagcgacagaatccagcccagcgccgacagagccagcagcctgagcagaccctgggagaagaccgacaagggcgccacctacaccccccaggcccccaagaagctgacccccaccgagaagggcagatgcgccagcctggaggagatcctgagccagagagacgccgccagcgccagaaccctgcagctgagagccgaggagccccccacccccgccctgcccaaccccggccagctgagcagaatccaggacctggtggccagaaagctggaggagacccaggagctgctggccgaggtgcagggcctgggcgacggcaagagaaaggccaaggacccccccagaagcccccccgacagcgagagcgagcagctgctgctggagaccgagagactgctgggcgaggccagcagcaactggagccaggccaagagagtgctgcaggaggtgagagagctgagagacctgtacagacagatggacctgcagacccccgacagccacctgagacagaccaccccccacagccagtacagaaagagcctgatgtag

SEQ ID NO: 12220 - DNA, 675 bp, Artificial Sequence
  Description of Artificial Sequence: Synthetic coding sequence
atgcccagcaccctgcccagccccgagcccagaaccgtgagctggatgagcaccagcctgcaggtgaccgtggaggaggacagctacctggcccaccccaccagagacagagccaagatccagcacagcagaagaccccccaccagaggccacctgatggccgtggccagcaccagcaccagcgacggcatgctgaccctggacctgatccaggaggaggaccccagccccgaggagcccaccagctgcgccgagagcttcagagtggacctggacaagagcgtggcccagctggccggcagcagaagaagagccgacagcgacagaatccagcccagcgccgacagagccagcagcctgagcagaccctgggagaagaccgacaagggcgccacctacaccccccaggcccccaagaagctgacccccaccgagaagggcagatgcgccagcctggaggagatcctgagccagagagacgccgccagcgccagaaccctgcagctgagagccgaggagccccccacccccgccctgcccaaccccggccagctgagcagaatccaggacctggtggccagaaagctggaggagacccaggagctgctggccgaggtgcagggcctgggcgacggcaagagaaaggccaaggacccccccagaagccccccctag

SEQ ID NO: 12221 - DNA, 384 bp, Artificial Sequence
  Description of Artificial Sequence: Synthetic coding sequence
atgaccgccgccgccaccgccaccgtgctgaaggagggcgtgctggagaagagaagcggcggcctgctgcagctgtggaagagaaagagatgcgtgctgaccgagagaggcctgcagctgttcgaggccaagggcaccggcggcagacccaaggagctgagcttcgccagaatcaaggccgtggagtgcgtggagagcaccggcagacacatctacttcaccctggtgaccgagggcggcggcgagatcgacttcagatgccccctggaggaccccggctggaacgcccagatcaccctgggcctggtgaagttcaagaaccagcaggccatccagaccgtgagagccagacagagcctgggcaccggcaccctggtgagctag

SEQ ID NO: 12222 - DNA, 384 bp, Artificial Sequence; identical to SEQ ID NO: 12221
  Description of Artificial Sequence: Synthetic coding sequence

SEQ ID NO: 12223 - DNA, 1710 bp, Artificial Sequence
  Description of Artificial Sequence: Synthetic coding sequence
atgagcttcggcatcctgaagcccgacctgagaatcgtgttcgtgcacaacaaggccgtgatctggcagaagagcagagtgagcgaccacaagatggccctgatgagcgtgctgggcaccgccgtgatgaacaacatggagagcttccagtaccacagcgaggagagccagatctacctgagcggcttcctgcccaagtgcgacgccgaccacagcttcaccagcctgagcacccccgagagaagcttcatcttcatcaacagcagacccgtgcaccagaaggacatcctgaagctgatcagacaccactacaacctgaagtgcctgaaggagagcaccagactgtaccccgtgttcttcctgaagatcgacgtgcccaccgccgacgtggacgtgaacctgacccccgacaagagccaggtgctgctgcagaacaaggagagcgtgctgatcgccctggagaacctgatgaccacctgctacggccccctgcccagcaccaacagctacgagaacaacaagaccgacgtgagcgccgccgacatcgtgctgagcaagaccgccgagaccgacgtgctgttcaacaaggtggagagcagcggcaagaactacagcaacgtggacaccagcgtgatccccttccagaacgacatgcacaacgacgagagcggcaagaacaccgacgactgcctgaaccaccagatcagcatcggcgacttcggctacggccactgcagcagcgagatcagcaacatcgacaagaacaccaagaacgccttccaggacatcagcatgagcaacgtgagctgggagaacagccagaccgagtacagcaagacctgcttcatcagcagcgtgaagcacacccagagcgagaacggcaacaaggaccacatcgacgagagcggcgagaacgaggaggaggccggcctggagaacagcagcgagatcagcgccgacgagtggagcagaggcaacatcctgaagaacagcgtgggcgagaacatcgagcccgtgaagatcctggtgcccgagaagagcctgccctgcaaggtgagcaacaacaactaccccatccccgagcagatgaacctgaacgaggacagctgcaacaagaagagcaacgtgatcgacaacaagagcggcaaggtgaccgcctacgacctgctgagcaacagagtgatcaagaagcccatgagcgccagcgccctgttcgtgcaggaccacagaccccagttcctgatcgagaaccccaagaccagcctggaggacgccaccctgcagatcgaggagctgtggaagaccctgagcgaggaggagaagctgaagtacgaggagaaggccaccaaggacctggagagatacaacagccagatgaagagagccatcgagcaggagagccagatgagcctgaaggacggcagaaagaagatcaagcccaccagcgcctggaacctggcccagaagcacaagctgaagaccagcctgagcaaccagcccaagctggacgagctgctgcagagccagatcgagaagagaagaagccagaacatcaagatggtgcagatccccttcagcatgaagaacctgaagatcaacttcaagaagcagaacaaggtggacctggaggagaaggacgagccctgcctgatccacaacctgagattccccgacgcctggctgatgaccagcaagaccgagagcttctag

SEQ ID NO: 12224 - DNA, 2271 bp, Artificial Sequence
  Description of Artificial Sequence: Synthetic coding sequence
atgagcttcggcatcctgaagcccgacctgagaatcgtgttcgtgcacaacaaggccgtgatctggcagaagagcagagtgagcgaccacaagatggccctgatgagcgtgctgggcaccgccgtgatgaacaacatggagagcttccagtaccacagcgaggagagccagatctacctgagcggcttcctgcccaagtgcgacgccgaccacagcttcaccagcctgagcacccccgagagaagcttcatcttcatcaacagcagacccgtgcaccagaaggacatcctgaagctgatcagacaccactacaacctgaagtgcctgaaggagagcaccagactgtaccccgtgttcttcctgaagatcgacgtgcccaccgccgacgtggacgtgaacctgacccccgacaagagccaggtgctgctgcagaacaaggagagcgtgctgatcgccctggagaacctgatgaccacctgctacggccccctgcccagcaccaacagctacgagaacaacaagaccgacgtgagcgccgccgacatcgtgctgagcaagaccgccgagaccgacgtgctgttcaacaaggtggagagcagcggcaagaactacagcaacgtggacaccagcgtgatccccttccagaacgacatgcacaacgacgagagcggcaagaacaccgacgactgcctgaaccaccagatcagcatcggcgacttcggctacggccactgcagcagcgagatcagcaacatcgacaagaacaccaagaacgccttccaggacatcagcatgagcaacgtgagctgggagaacagccagaccgagtacagcaagacctgcttcatcagcagcgtgaagcacacccagagcgagaacggcaacaaggaccacatcgacgagagcggcgagaacgaggaggaggccggcctggagaacagcagcgagatcagcgccgacgagtggagcagaggcaacatcctgaagaacagcgtgggcgagaacatcgagcccgtgaagatcctggtgcccgagaagagcctgccctgcaaggtgagcaacaacaactaccccatccccgagcagatgaacctgaacgaggacagctgcaacaagaagagcaacgtgatcgacaacaagagcggcaaggtgaccgcctacgacctgctgagcaacagagtgatcaagaagcccatgagcgccagcgccctgttcgtgcaggaccacagaccccagttcctgatcgagaaccccaagaccagcctggaggacgccaccctgcagatcgaggagctgtggaagaccctgagcgaggaggagaagctgaagtacgaggagaaggccaccaaggacctggagagatacaacagccagatgaagagagccatcgagcaggagagccagatgagcctgaaggacggcagaaagaagatcaagcccaccagcgcctggaacctggcccagaagcacaagctgaagaccagcctgagcaaccagcccaagctggacgagctgctgcagagccagatcgagaagagaagaagccagaacatcaagatggtgcagatccccttcagcatgaagaacctgaagatcaacttcaagaagcagaacaaggtggacctggaggagaaggacgagccctgcctgatccacaacctgagattccccgacgcctggctgatgaccagcaagaccgaggtgatgctgctgaacccctacagagtggaggaggccctgctgttcaagagactgctggagaaccacaagctgcccgccgagcccctggagaagcccatcatgctgaccgagagcctgttcaacggcagccactacctggacgtgctgtacaagatgaccgccgacgaccagagatacagcggcagcacctacctgagcgaccccagactgaccgccaacggcttcaagatcaagctgatccccggcgtgagcatcaccgagaactacctggagatcgagggcatggccaactgcctgcccttctacggcgtggccgacctgaaggagatcctgaacgccatcctgaacagaaacgccaaggaggtgtacgagtgcagacccagaaaggtgatcagctacctggagggcgaggccgtgagactgagcagacagctgcccatgtacctgagcaaggaggacatccaggacatcatctacagaatgaagcaccagttcggcaacgagatcaaggagtgcgtgcacggcagacccttcttccaccacctgacctacctgcccgagaccacctag

SEQ ID NO: 12225 - DNA, 222 bp, Artificial Sequence
  Description of Artificial Sequence: Synthetic coding sequence
atgaagcagctgcccgccgccaccgtgagactgctgagcagcagccagatcatcaccagcgtggtgagcgtggtgaaggagctgatcgagaacagcctggacgccggcgccaccagcgtggacgtgaagctggagaactacggcttcgacaagatcgaggtgagagacaacggcgagggcatcaaggccgtggacgcccccgtgatggccatgaagtactag

SEQ ID NO: 12226 - DNA, 585 bp, Artificial Sequence
  Description of Artificial Sequence: Synthetic coding sequence
atgaagcagctgcccgccgccaccgtgagactgctgagcagcagccagatcatcaccagcgtggtgagcgtggtgaaggagctgatcgagaacagcctggacgccggcgccaccagcgtggacgtgaagctggagaactacggcttcgacaagatcgaggtgagagacaacggcgagggcatcaaggccgtggacgcccccgtgatggccatgaagtactacaccagcaagatcaacagccacgaggacctggagaacctgaccacctacggcttcagaggcgaggccctgggcagcatctgctgcatcgccgaggtgctgatcaccaccagaaccgccgccgacaacttcagcacccagtacgtgctggacggcagcggccacatcctgagccagaagcccagccacctgggccagggcaccaccgtgaccgccctgagactgttcaagaacctgcccgtgagaaagcagttctacagcaccgccaagaagtgcaaggacgagatcaagaagatccaggacctgctgatgagcttcggcatcctgaagcccgacctgagaatcgtgttcgtgcacaacaagtag

SEQ ID NO: 12227 - DNA, 2271 bp, Artificial Sequence; identical to SEQ ID NO: 12224
  Description of Artificial Sequence: Synthetic coding sequence

SEQ ID NO: 12228 - DNA, 2799 bp, Artificial Sequence
  Description of Artificial Sequence: Synthetic coding sequence
atgaagcagctgcccgccgccaccgtgagactgctgagcagcagccagatcatcaccagcgtggtgagcgtggtgaaggagctgatcgagaacagcctggacgccggcgccaccagcgtggacgtgaagctggagaactacggcttcgacaagatcgaggtgagagacaacggcgagggcatcaaggccgtggacgcccccgtgatggccatgaagtactacaccagcaagatcaacagccacgaggacctggagaacctgaccacctacggcttcagaggcgaggccctgggcagcatctgctgcatcgccgaggtgctgatcaccaccagaaccgccgccgacaacttcagcacccagtacgtgctggacggcagcggccacatcctgagccagaagcccagccacctgggccagggcaccaccgtgaccgccctgagactgttcaagaacctgcccgtgagaaagcagttctacagcaccgccaagaagtgcaaggacgagatcaagaagatccaggacctgctgatgagcttcggcatcctgaagcccgacctgagaatcgtgttcgtgcacaacaaggccgtgatctggcagaagagcagagtgagcgaccacaagatggccctgatgagcgtgctgggcaccgccgtgatgaacaacatggagagcttccagtaccacagcgaggagagccagatctacctgagcggcttcctgcccaagtgcgacgccgaccacagcttcaccagcctgagcacccccgagagaagcttcatcttcatcaacagcagacccgtgcaccagaaggacatcctgaagctgatcagacaccactacaacctgaagtgcctgaaggagagcaccagactgtaccccgtgttcttcctgaagatcgacgtgcccaccgccgacgtggacgtgaacctgacccccgacaagagccaggtgctgctgcagaacaaggagagcgtgctgatcgccctggagaacctgatgaccacctgctacggccccctgcccagcaccaacagctacgagaacaacaagaccgacgtgagcgccgccgacatcgtgctgagcaagaccgccgagaccgacgtgctgttcaacaaggtggagagcagcggcaagaactacagcaacgtggacaccagcgtgatccccttccagaacgacatgcacaacgacgagagcggcaagaacaccgacgactgcctgaaccaccagatcagcatcggcgacttcggctacggccactgcagcagcgagatcagcaacatcgacaagaacaccaagaacgccttccaggacatcagcatgagcaacgtgagctgggagaacagccagaccgagtacagcaagacctgcttcatcagcagcgtgaagcacacccagagcgagaacggcaacaaggaccacatcgacgagagcggcgagaacgaggaggaggccggcctggagaacagcagcgagatcagcgccgacgagtggagcagaggcaacatcctgaagaacagcgtgggcgagaacatcgagcccgtgaagatcctggtgcccgagaagagcctgccctgcaaggtgagcaacaacaactaccccatccccgagcagatgaacctgaacgaggacagctgcaacaagaagagcaacgtgatcgacaacaagagcggcaaggtgaccgcctacgacctgctgagcaacagagtgatcaagaagcccatgagcgccagcgccctgttcgtgcaggaccacagaccccagttcctgatcgagaaccccaagaccagcctggaggacgccaccctgcagatcgaggagctgtggaagaccctgagcgaggaggagaagctgaagtacgaggagaaggccaccaaggacctggagagatacaacagccagatgaagagagccatcgagcaggagagccagatgagcctgaaggacggcagaaagaagatcaagcccaccagcgcctggaacctggcccagaagcacaagctgaagaccagcctgagcaaccagcccaagctggacgagctgctgcagagccagatcgagaagagaagaagccagaacatcaagatggtgcagatccccttcagcatgaagaacctgaagatcaacttcaagaagcagaacaaggtggacctggaggagaaggacgagccctgcctgatccacaacctgagattccccgacgcctggctgatgaccagcaagaccgaggtgatgctgctgaacccctacagagtggaggaggccctgctgttcaagagactgctggagaaccacaagctgcccgccgagcccctggagaagcccatcatgctgaccgagagcctgttcaacggcagccactacctggacgtgctgtacaagatgaccgccgacgaccagagatacagcggcagcacctacctgagcgaccccagactgaccgccaacggcttcaagatcaagctgatccccggcgtgagcatcaccgagaactacctggagatcgagggcatggccaactgcctgcccttctacggcgtggccgacctgaaggagatcctgaacgccatcctgaacagaaacgccaaggaggtgtacgagtgcagacccagaaaggtgatcagctacctggagggcgaggccgtgagactgagcagacagctgcccatgtacctgagcaaggaggacatccaggacatcatctacagaatgaagcaccagttcggcaacgagatcaaggagtgcgtgcacggcagacccttcttccaccacctgacctacctgcccgagaccacctag

SEQ ID NO: 12229 - DNA, 135 bp, Artificial Sequence
  Description of Artificial Sequence: Synthetic coding sequence
atgaagcagctgcccgccgccaccgtgagactgctgagcagcagccagatcatcaccagcgtggtgagcgtggtgaaggagctgatcgagaacagcctggacgccggcgccaccagcgtggacgtgaagctgtag

SEQ ID NO: 12230 - DNA, 2313 bp, Artificial Sequence
  Description of Artificial Sequence: Synthetic coding sequence
atgaagcagctgcccgccgccaccgtgagactgctgagcagcagccagatcatcaccagcgtggtgagcgtggtgaaggagctgatcgagaacagcctggacgccggcgccaccagcgtggacgtgaagctggagaactacggcttcgacaagatcgaggtgagagacaacggcgagggcatcaaggccgtggacgcccccgtgatggccatgaagtactacaccagcaagatcaacagccacgaggacctggagaacctgaccacctacggcttcagaggcgaggccctgggcagcatctgctgcatcgccgaggtgctgatcaccaccagaaccgccgccgacaacttcagcacccagtacgtgctggacggcagcggccacatcctgagccagaagcccagccacctgggccagggcaccaccgtgaccgccctgagactgttcaagaacctgcccgtgagaaagcagttctacagcaccgccaagaagtgcaaggacgagatcaagaagatccaggacctgctgatgagcttcggcatcctgaagcccgacctgagaatcgtgttcgtgcacaacaaggccgtgatctggcagaagagcagagtgagcgaccacaagatggccctgatgagcgtgctgggcaccgccgtgatgaacaacatggagagcttccagtaccacagcgaggagagccagatctacctgagcggcttcctgcccaagtgcgacgccgaccacagcttcaccagcctgagcacccccgagagaagcttcatcttcatcaacagcagacccgtgcaccagaaggacatcctgaagctgatcagacaccactacaacctgaagtgcctgaaggagagcaccagactgtaccccgtgttcttcctgaagatcgacgtgcccaccgccgacgtggacgtgaacctgacccccgacaagagccaggtgctgctgcagaacaaggagagcgtgctgatcgccctggagaacctgatgaccacctgctacggccccctgcccagcaccaacagctacgagaacaacaagaccgacgtgagcgccgccgacatcgtgctgagcaagaccgccgagaccgacgtgctgttcaacaaggtggagagcagcggcaagaactacagcaacgtggacaccagcgtgatccccttccagaacgacatgcacaacgacgagagcggcaagaacaccgacgactgcctgaaccaccagatcagcatcggcgacttcggctacggccactgcagcagcgagatcagcaacatcgacaagaacaccaagaacgccttccaggacatcagcatgagcaacgtgagctgggagaacagccagaccgagtacagcaagacctgcttcatcagcagcgtgaagcacacccagagcgagaacggcaacaaggaccacatcgacgagagcggcgagaacgaggaggaggccggcctggagaacagcagcgagatcagcgccgacgagtggagcagaggcaacatcctgaagaacagcgtgggcgagaacatcgagcccgtgaagatcctggtgcccgagaagagcctgccctgcaaggtgagcaacaacaactaccccatccccgagcagatgaacctgaacgaggacagctgcaacaagaagagcaacgtgatcgacaacaagagcggcaaggtgaccgcctacgacctgctgagcaacagagtgatcaagaagcccatgagcgccagcgccctgttcgtgcaggaccacagaccccagttcctgatcgagaaccccaagaccagcctggaggacgccaccctgcagatcgaggagctgtggaagaccctgagcgaggaggagaagctgaacctgttcaacggcagccactacctggacgtgctgtacaagatgaccgccgacgaccagagatacagcggcagcacctacctgagcgaccccagactgaccgccaacggcttcaagatcaagctgatccccggcgtgagcatcaccgagaactacctggagatcgagggcatggccaactgcctgcccttctacggcgtggccgacctgaaggagatcctgaacgccatcctgaacagaaacgccaaggaggtgtacgagtgcagacccagaaaggtgatcagctacctggagggcgaggccgtgagactgagcagacagctgcccatgtacctgagcaaggaggacatccaggacatcatctacagaatgaagcaccagttcggcaacgagatcaaggagtgcgtgcacggcagacccttcttccaccacctgacctacctgcccgagaccacctag

SEQ ID NO: 12231 - DNA, 2682 bp, Artificial Sequence
  Description of Artificial Sequence: Synthetic coding sequence
atgaagcagctgcccgccgccaccgtgagactgctgagcagcagccagatcatcaccagcgtggtgagcgtggtgaaggagctgatcgagaacagcctggacgccggcgccaccagcgtggacgtgaagctggagaactacggcttcgacaagatcgaggtgagagacaacggcgagggcatcaaggccgtggacgcccccgtgatggccatgaagtactacaccagcaagatcaacagccacgaggacctggagaacctgaccacctacggcttcagaggcgaggccctgggcagcatctgctgcatcgccgaggtgctgatcaccaccagaaccgccgccgacaacttcagcacccagtacgtgctggacggcagcggccacatcctgagccagaagcccagccacctgggccagggcaccaccgtgaccgccctgagactgttcaagaacctgcccgtgagaaagcagttctacagcaccgccaagaagtgcaaggacgagatcaagaagatccaggacctgctgatgagcttcggcatcctgaagcccgacctgagaatcgtgttcgtgcacaacaagatctacctgagcggcttcctgcccaagtgcgacgccgaccacagcttcaccagcctgagcacccccgagagaagcttcatcttcatcaacagcagacccgtgcaccagaaggacatcctgaagctgatcagacaccactacaacctgaagtgcctgaaggagagcaccagactgtaccccgtgttcttcctgaagatcgacgtgcccaccgccgacgtggacgtgaacctgacccccgacaagagccaggtgctgctgcagaacaaggagagcgtgctgatcgccctggagaacctgatgaccacctgctacggccccctgcccagcaccaacagctacgagaacaacaagaccgacgtgagcgccgccgacatcgtgctgagcaagaccgccgagaccgacgtgctgttcaacaaggtggagagcagcggcaagaactacagcaacgtggacaccagcgtgatccccttccagaacgacatgcacaacgacgagagcggcaagaacaccgacgactgcctgaaccaccagatcagcatcggcgacttcggctacggccactgcagcagcgagatcagcaacatcgacaagaacaccaagaacgccttccaggacatcagcatgagcaacgtgagctgggagaacagccagaccgagtacagcaagacctgcttcatcagcagcgtgaagcacacccagagcgagaacggcaacaaggaccacatcgacgagagcggcgagaacgaggaggaggccggcctggagaacagcagcgagatcagcgccgacgagtggagcagaggcaacatcctgaagaacagcgtgggcgagaacatcgagcccgtgaagatcctggtgcccgagaagagcctgccctgcaaggtgagcaacaacaactaccccatccccgagcagatgaacctgaacgaggacagctgcaacaagaagagcaacgtgatcgacaacaagagcggcaaggtgaccgcctacgacctgctgagcaacagagtgatcaagaagcccatgagcgccagcgccctgttcgtgcaggaccacagaccccagttcctgatcgagaaccccaagaccagcctggaggacgccaccctgcagatcgaggagctgtggaagaccctgagcgaggaggagaagctgaagtacgaggagaaggccaccaaggacctggagagatacaacagccagatgaagagagccatcgagcaggagagccagatgagcctgaaggacggcagaaagaagatcaagcccaccagcgcctggaacctggcccagaagcacaagctgaagaccagcctgagcaaccagcccaagctggacgagctgctgcagagccagatcgagaagagaagaagccagaacatcaagatggtgcagatccccttcagcatgaagaacctgaagatcaacttcaagaagcagaacaaggtggacctggaggagaaggacgagccctgcctgatccacaacctgagattccccgacgcctggctgatgaccagcaagaccgaggtgatgctgctgaacccctacagagtggaggaggccctgctgttcaagagactgctggagaaccacaagctgcccgccgagcccctggagaagcccatcatgctgaccgagagcctgttcaacggcagccactacctggacgtgctgtacaagatgaccgccgacgaccagagatacagcggcagcacctacctgagcgaccccagactgaccgccaacggcttcaagatcaagctgatccccggcgtgagcatcaccgagaactacctggagatcgagggcatggccaactgcctgcccttctacggcgtggccgacctgaaggagatcctgaacgccatcctgaacagaaacgccaaggaggtgtacgagtgcagacccagaaaggtgatcagctacctggagggcgaggccgtgagactgagcagacagctgcccatgtacctgagcaaggaggacatccaggacatcatctacagaatgaagcaccagttcggcaacgagatcaaggagtgcgtgcacggcagacccttcttccaccacctgacctacctgcccgagaccacctag

SEQ ID NO: 12232 - DNA, 2589 bp, Artificial Sequence
  Description of Artificial Sequence: Synthetic coding sequence
atggagagagccgagagcagcagcaccgagcccgccaaggccatcaagcccatcgacagaaagagcgtgcaccagatctgcagcggccaggtggtgctgagcctgagcaccgccgtgaaggagctggtggagaacagcctggacgccggcgccaccaacatcgacctgaagctgaaggactacggcgtggacctgatcgaggtgagcgacaacggctgcggcgtggaggaggagaacttcgagggcctgaccctgaagcaccacaccagcaagatccaggagttcgccgacctgacccaggtggagaccttcggcttcagaggcgaggccctgagcagcctgtgcgccctgagcgacgtgaccatcagcacctgccacgccagcgccaaggtgggcaccagactgatgttcgaccacaacggcaagatcatccagaagaccccctaccccagacccagaggcaccaccgtgagcgtgcagcagctgttcagcaccctgcccgtgagacacaaggagttccagagaaacatcaagaaggagtacgccaagatggtgcaggtgctgcacgcctactgcatcatcagcgccggcatcagagtgagctgcaccaaccagctgggccagggcaagagacagcccgtggtgtgcaccggcggcagccccagcatcaaggagaacatcggcagcgtgttcggccagaagcagctgcagagcctgatccccttcgtgcagctgccccccagcgacagcgtgtgcgaggagtacggcctgagctgcagcgacgccctgcacaacctgttctacatcagcggcttcatcagccagtgcacccacggcgtgggcagaagcagcaccgacagacagttcttcttcatcaacagaagaccctgcgaccccgccaaggtgtgcagactggtgaacgaggtgtaccacatgtacaacagacaccagtaccccttcgtggtgctgaacatcagcgtggacagcgagtgcgtggacatcaacgtgacccccgacaagagacagatcctgctgcaggaggagaagctgctgctggccgtgctgaagaccagcctgatcggcatgttcgacagcgacgtgaacaagctgaacgtgagccagcagcccctgctggacgtggagggcaacctgatcaagatgcacgccgccgacctggagaagcccatggtggagaagcaggaccagagccccagcctgagaaccggcgaggagaagaaggacgtgagcatcagcagactgagagaggccttcagcctgagacacaccaccgagaacaagccccacagccccaagacccccgagcccagaagaagccccctgggccagaagagaggcatgctgagcagcagcaccagcggcgccatcagcgacaagggcgtgctgagaccccagaaggaggccgtgagcagcagccacggccccagcgaccccaccgacagagccgaggtggagaaggacagcggccacggcagcaccagcgtggacagcgagggcttcagcatccccgacaccggcagccactgcagcagcgagtacgccgccagcagccccggcgacagaggcagccaggagcacgtggacagccaggagaaggcccccaagaccgacgacagcttcagcgacgtggactgccacagcaaccaggaggacaccggctgcaagttcagagtgctgccccagcccaccaacctggccacccccaacaccaagagattcaagaaggaggagatcctgagcagcagcgacatctgccagaagctggtgaacacccaggacatgagcgccagccaggtggacgtggccgtgaagatcaacaagaaggtggtgcccctggacttcagcatgagcagcctggccaagagaatcaagcagctgcaccacgaggcccagcagagcgagggcgagcagaactacagaaagttcagagccaagatctgccccggcgagaaccaggccgccgaggacgagctgagaaaggagatcagcaagaccatgttcgccgagatggagatcatcggccagttcaacctgggcttcatcatcaccaagctgaacgaggacatcttcatcgtggaccagcacgccaccgacgagaagtacaacttcgagatgctgcagcagcacaccgtgctgcagggccagagactgatcgccccccagaccctgaacctgaccgccgtgaacgaggccgtgctgatcgagaacctggagatcttcagaaagaacggcttcgacttcgtgatcgacgagaacgcccccgtgaccgagagagccaagctgatcagcctgcccaccagcaagaactggaccttcggcccccaggacgtggacgagctgatcttcatgctgagcgacagccccggcgtgatgtgcagacccagcagagtgaagcagatgttcgccagcagagcctgcagaaagagcgtgatgatcggcaccgccctgaacaccagcgagatgaagaagctgatcacccacatgggcgagatggaccacccctggaactgcccccacggcagacccaccatgagacacatcgccaacctgggcgtgatcagccagaactag

SEQ ID NO: 12233 - DNA, 1386 bp, Artificial Sequence
  Description of Artificial Sequence: Synthetic coding sequence
atggagagagccgagagcagcagcaccgagcccgccaaggccatcaagcccatcgacagaaagagcgtgcaccagatctgcagcggccaggtggtgctgagcctgagcaccgccgtgaaggagctggtggagaacagcctggacgccggcgccaccaacatcgacctgaagctgaaggactacggcgtggacctgatcgaggtgagcgacaacggctgcggcgtggaggaggagaacttcgagggcctgaccctgaagcaccacaccagcaagatccaggagttcgccgacctgacccaggtggagaccttcggcttcagaggcgaggccctgagcagcctgtgcgccctgagcgacgtgaccatcagcacctgccacgccagcgccaaggtgggcaccagactgatgttcgaccacaacggcaagatcatccagaagaccccctaccccagacccagaggcaccaccgtgagcgtgcagcagctgttcagcaccctgcccgtgagacacaaggagttccagagaaacatcaagaaggagtacgccaagatggtgcaggtgctgcacgcctactgcatcatcagcgccggcatcagagtgagctgcaccaaccagctgggccagggcaagagacagcccgtggtgtgcaccggcggcagccccagcatcaaggagaacatcggcagcgtgttcggccagaagcagctgcagagcctgatccccttcgtgcagctgccccccagcgacagcgtgtgcgaggagtacggcctgagctgcagcgacgccctgcacaacctgttctacaagaccatgttcgccgagatggagatcatcggccagttcaacctgggcttcatcatcaccaagctgaacgaggacatcttcatcgtggaccagcacgccaccgacgagaagtacaacttcgagatgctgcagcagcacaccgtgctgcagggccagagactgatcgccccccagaccctgaacctgaccgccgtgaacgaggccgtgctgatcgagaacctggagatcttcagaaagaacggcttcgacttcgtgatcgacgagaacgcccccgtgaccgagagagccaagctgatcagcctgcccaccagcaagaactggaccttcggcccccaggacgtggacgagctgatcttcatgctgagcgacagccccggcgtgatgtgcagacccagcagagtgaagcagatgttcgccagcagagcctgcagaaagagcgtgatgatcggcaccgccctgaacaccagcgagatgaagaagctgatcacccacatgggcgagatggaccacccctggaactgcccccacggcagacccaccatgagacacatcgccaacctgggcgtgatcagccagaactag

SEQ ID NO: 12234 - DNA, 2448 bp, Artificial Sequence
  Description of Artificial Sequence: Synthetic coding sequence
atggagagagccgagagcagcagaagcaagctgaaggactacggcgtggacctgatcgaggtgagcgacaacggctgcggcgtggaggaggagaacttcgagggcctgaccctgaagcaccacaccagcaagatccaggagttcgccgacctgacccaggtggagaccttcggcttcagaggcgaggccctgagcagcctgtgcgccctgagcgacgtgaccatcagcacctgccacgccagcgccaaggtgggcaccagactgatgttcgaccacaacggcaagatcatccagaagaccccctaccccagacccagaggcaccaccgtgagcgtgcagcagctgttcagcaccctgcccgtgagacacaaggagttccagagaaacatcaagaaggagtacgccaagatggtgcaggtgctgcacgcctactgcatcatcagcgccggcatcagagtgagctgcaccaaccagctgggccagggcaagagacagcccgtggtgtgcaccggcggcagccccagcatcaaggagaacatcggcagcgtgttcggccagaagcagctgcagagcctgatccccttcgtgcagctgccccccagcgacagcgtgtgcgaggagtacggcctgagctgcagcgacgccctgcacaacctgttctacatcagcggcttcatcagccagtgcacccacggcgtgggcagaagcagcaccgacagacagttcttcttcatcaacagaagaccctgcgaccccgccaaggtgtgcagactggtgaacgaggtgtaccacatgtacaacagacaccagtaccccttcgtggtgctgaacatcagcgtggacagcgagtgcgtggacatcaacgtgacccccgacaagagacagatcctgctgcaggaggagaagctgctgctggccgtgctgaagaccagcctgatcggcatgttcgacagcgacgtgaacaagctgaacgtgagccagcagcccctgctggacgtggagggcaacctgatcaagatgcacgccgccgacctggagaagcccatggtggagaagcaggaccagagccccagcctgagaaccggcgaggagaagaaggacgtgagcatcagcagactgagagaggccttcagcctgagacacaccaccgagaacaagccccacagccccaagacccccgagcccagaagaagccccctgggccagaagagaggcatgctgagcagcagcaccagcggcgccatcagcgacaagggcgtgctgagaccccagaaggaggccgtgagcagcagccacggccccagcgaccccaccgacagagccgaggtggagaaggacagcggccacggcagcaccagcgtggacagcgagggcttcagcatccccgacaccggcagccactgcagcagcgagtacgccgccagcagccccggcgacagaggcagccaggagcacgtggacagccaggagaaggcccccaagaccgacgacagcttcagcgacgtggactgccacagcaaccaggaggacaccggctgcaagttcagagtgctgccccagcccaccaacctggccacccccaacaccaagagattcaagaaggaggagatcctgagcagcagcgacatctgccagaagctggtgaacacccaggacatgagcgccagccaggtggacgtggccgtgaagatcaacaagaaggtggtgcccctggacttcagcatgagcagcctggccaagagaatcaagcagctgcaccacgaggcccagcagagcgagggcgagcagaactacagaaagttcagagccaagatctgccccggcgagaaccaggccgccgaggacgagctgagaaaggagatcagcaagaccatgttcgccgagatggagatcatcggccagttcaacctgggcttcatcatcaccaagctgaacgaggacatcttcatcgtggaccagcacgccaccgacgagaagtacaacttcgagatgctgcagcagcacaccgtgctgcagggccagagactgatcgccccccagaccctgaacctgaccgccgtgaacgaggccgtgctgatcgagaacctggagatcttcagaaagaacggcttcgacttcgtgatcgacgagaacgcccccgtgaccgagagagccaagctgatcagcctgcccaccagcaagaactggaccttcggcccccaggacgtggacgagctgatcttcatgctgagcgacagccccggcgtgatgtgcagacccagcagagtgaagcagatgttcgccagcagagcctgcagaaagagcgtgatgatcggcaccgccctgaacaccagcgagatgaagaagctgatcacccacatgggcgagatggaccacccctggaactgcccccacggcagacccaccatgagacacatcgccaacctgggcgtgatcagccagaactag

SEQ ID NO: 12235 - DNA, 1719 bp, Artificial Sequence
  Description of Artificial Sequence: Synthetic coding sequence
atggagagagccgagagcagcagcaccgagcccgccaaggccatcaagcccatcgacagaaagagcgtgcaccagatctgcagcggccaggtggtgctgagcctgagcaccgccgtgaaggagctggtggagaacagcctggacgccggcgccaccaacatcgacctgaagctgaaggactacggcgtggacctgatcgaggtgagcgacaacggctgcggcgtggaggaggagaacttcgagggcctgaccctgaagcaccacaccagcaagatccaggagttcgccgacctgacccaggtggagaccttcggcttcagaggcgaggccctgagcagcctgtgcgccctgagcgacgtgaccatcagcacctgccacgccagcgccaaggtgggcaccagactgatgttcgaccacaacggcaagatcatccagaagaccccctaccccagacccagaggcaccaccgtgagcgtgcagcagctgttcagcaccctgcccgtgagacacaaggagttccagagaaacatcaagaaggagtacgccaagatggtgcaggtgctgcacgcctactgcatcatcagcgccggcatcagagtgagctgcaccaaccagctgggccagggcaagagacagcccgtggtgtgcaccggcggcagccccagcatcaaggagaacatcggcagcgtgttcggccagaagcagctgcagagcctgatccccttcgtgcagctgccccccagcgacagcgtgtgcgaggagtacggcctgagctgcagcgacgccctgcacaacctgttctacatcagcggcttcatcagccagtgcacccacggcgtgggcagaagcagcaccgacagacagttcttcttcatcaacagaagaccctgcgaccccgccaaggtgtgcagactggtgaacgaggtgtaccacatgtacaacagacaccagtaccccttcgtggtgctgaacatcagcgtggacagcgagtgcgtggacatcaacgtgacccccgacaagagacagatcctgctgcaggaggagaagctgctgctggccgtgctgaagaccagcctgatcggcatgttcgacagcgacgtgaacaagctgaacgtgagccagcagcccctgctggacgtggagggcaacctgatcaagatgcacgccgccgacctggagaagcccatggtggagaagcaggaccagagccccagcctgagaaccggcgaggagaagaaggacgtgagcatcagcagactgagagaggccttcagcctgagacacaccaccgagaacaagccccacagccccaagacccccgagcccagaagaagccccctgggccagaagagaggcatgctgagcagcagcaccagcggcgccatcagcgacaagggcgtgctgagaccccagaaggaggccgtgagcagcagccacggccccagcgaccccaccgacagagccgaggtggagaaggacagcggccacggcagcaccagcgtggacagcgagggcttcagcatccccgacaccggcagccactgcagcagcgagtacgccgccagcagccccggcgacagaggcagccaggagcacgtggacagccaggagaaggcccccaagaccgacgacagcttcagcgacgtggactgccacagcaaccaggaggacaccggcctgaagaccggccccagcgaccccagaaccagcatgaactag

SEQ ID NO: 12236 - DNA, 2271 bp, Artificial Sequence
  Description of Artificial Sequence: Synthetic coding sequence
atgtggggcagaagaagaaagctgagaagactgaacgacgtgaccatcagcacctgccacgccagcgccaaggtgggcaccagactgatgttcgaccacaacggcaagatcatccagaagaccccctaccccagacccagaggcaccaccgtgagcgtgcagcagctgttcagcaccctgcccgtgagacacaaggagttccagagaaacatcaagaaggagtacgccaagatggtgcaggtgctgcacgcctactgcatcatcagcgccggcatcagagtgagctgcaccaaccagctgggccagggcaagagacagcccgtggtgtgcaccggcggcagccccagcatcaaggagaacatcggcagcgtgttcggccagaagcagctgcagagcctgatccccttcgtgcagctgccccccagcgacagcgtgtgcgaggagtacggcctgagctgcagcgacgccctgcacaacctgttctacatcagcggcttcatcagccagtgcacccacggcgtgggcagaagcagcaccgacagacagttcttcttcatcaacagaagaccctgcgaccccgccaaggtgtgcagactggtgaacgaggtgtaccacatgtacaacagacaccagtaccccttcgtggtgctgaacatcagcgtggacagcgagtgcgtggacatcaacgtgacccccgacaagagacagatcctgctgcaggaggagaagctgctgctggccgtgctgaagaccagcctgatcggcatgttcgacagcgacgtgaacaagctgaacgtgagccagcagcccctgctggacgtggagggcaacctgatcaagatgcacgccgccgacctggagaagcccatggtggagaagcaggaccagagccccagcctgagaaccggcgaggagaagaaggacgtgagcatcagcagactgagagaggccttcagcctgagacacaccaccgagaacaagccccacagccccaagacccccgagcccagaagaagccccctgggccagaagagaggcatgctgagcagcagcaccagcggcgccatcagcgacaagggcgtgctgagaccccagaaggaggccgtgagcagcagccacggccccagcgaccccaccgacagagccgaggtggagaaggacagcggccacggcagcaccagcgtggacagcgagggcttcagcatccccgacaccggcagccactgcagcagcgagtacgccgccagcagccccggcgacagaggcagccaggagcacgtggacagccaggagaaggcccccaagaccgacgacagcttcagcgacgtggactgccacagcaaccaggaggacaccggctgcaagttcagagtgctgccccagcccaccaacctggccacccccaacaccaagagattcaagaaggaggagatcctgagcagcagcgacatctgccagaagctggtgaacacccaggacatgagcgccagccaggtggacgtggccgtgaagatcaacaagaaggtggtgcccctggacttcagcatgagcagcctggccaagagaatcaagcagctgcaccacgaggcccagcagagcgagggcgagcagaactacagaaagttcagagccaagatctgccccggcgagaaccaggccgccgaggacgagctgagaaaggagatcagcaagaccatgttcgccgagatggagatcatcggccagttcaacctgggcttcatcatcaccaagctgaacgaggacatcttcatcgtggaccagcacgccaccgacgagaagtacaacttcgagatgctgcagcagcacaccgtgctgcagggccagagactgatcgccccccagaccctgaacctgaccgccgtgaacgaggccgtgctgatcgagaacctggagatcttcagaaagaacggcttcgacttcgtgatcgacgagaacgcccccgtgaccgagagagccaagctgatcagcctgcccaccagcaagaactggaccttcggcccccaggacgtggacgagctgatcttcatgctgagcgacagccccggcgtgatgtgcagacccagcagagtgaagcagatgttcgccagcagagcctgcagaaagagcgtgatgatcggcaccgccctgaacaccagcgagatgaagaagctgatcacccacatgggcgagatggaccacccctggaactgcccccacggcagacccaccatgagacacatcgccaacctgggcgtgatcagccagaactag

SEQ ID NO: 12237 - DNA, 1812 bp, Artificial Sequence
  Description of Artificial Sequence: Synthetic coding sequence
atgagcgccgccgtgaccgccggcaagctggccagagcccccgccgaccccggcaaggccggcgtgcccggcgtggccgcccccggcgcccccgccgccgccccccccgccaaggagatccccgaggtgctggtggaccccagaagcagaagaagatacgtgagaggcagattcctgggcaagggcggcttcgccaagtgcttcgagatcagcgacgccgacaccaaggaggtgttcgccggcaagatcgtgcccaagagcctgctgctgaagccccaccagagagagaagatgagcatggagatcagcatccacagaagcctggcccaccagcacgtggtgggcttccacggcttcttcgaggacaacgacttcgtgttcgtggtgctggagctgtgcagaagaagaagcctgctggagctgcacaagagaagaaaggccctgaccgagcccgaggccagatactacctgagacagatcgtgctgggctgccagtacctgcacagaaacagagtgatccacagagacctgaagctgggcaacctgttcctgaacgaggacctggaggtgaagatcggcgacttcggcctggccaccaaggtggagtacgacggcgagagaaagaagaccctgtgcggcacccccaactacatcgcccccgaggtgctgagcaagaagggccacagcttcgaggtggacgtgtggagcatcggctgcatcatgtacaccctgctggtgggcaagccccccttcgagaccagctgcctgaaggagacctacctgagaatcaagaagaacgagtacagcatccccaagcacatcaaccccgtggccgccagcctgatccagaagatgctgcagaccgaccccaccgccagacccaccatcaacgagctgctgaacgacgagttcttcaccagcggctacatccccgccagactgcccatcacctgcctgaccatcccccccagattcagcatcgcccccagcagcctggaccccagcaacagaaagcccctgaccgtgctgaacaagggcctggagaaccccctgcccgagagacccagagagaaggaggagcccgtggtgagagagaccggcgaggtggtggactgccacctgagcgacatgctgcagcagctgcacagcgtgaacgccagcaagcccagcgagagaggcctggtgagacaggaggaggccgaggaccccgcctgcatccccatcttctgggtgagcaagtgggtggactacagcgacaagtacggcctgggctaccagctgtgcgacaacagcgtgggcgtgctgttcaacgacagcaccagactgatcctgtacaacgacggcgacagcctgcagtacatcgagagagacggcaccgagagctacctgaccgtgagcagccaccccaacagcctgatgaagaagatcaccctgctgaagtacttcagaaactacatgagcgagcacctgctgaaggccggcgccaacatcacccccagagagggcgacgagctggccagactgccctacctgagaacctggttcagaaccagaagcgccatcatcctgcacctgagcaacggcagcgtgcagatcaacttcttccaggaccacaccaagctgatcctgtgccccctgatggccgccgtgacctacatcgacgagaagagagacttcagaacctacagactgagcctgctggaggagtacggctgctgcaaggagctggccagcagactgagatacgccagaaccatggtggacaagctgctgagcagcagaagcgccagcaacagactgaaggccagctag

SEQ ID NO: 12238 - DNA, 744 bp, Artificial Sequence
  Description of Artificial Sequence: Synthetic coding sequence
atgagcgccgccgtgaccgccggcaagctggccagagcccccgccgaccccggcaaggccggcgtgcccggcgtggccgcccccggcgcccccgccgccgccccccccgccaaggagatccccgaggtgctggtggaccccagaagcagaagaagatacgtgagaggcagattcctgggcaagggcggcttcgccaagtgcttcgagatcagcgacgccgacaccaaggaggtgttcgccggcaagatcgtgcccaagagcctgctgctgaagccccaccagagagagaagatgagcatggagatcagcatccacagaagcctggcccaccagcacgtggtgggcttccacggcttcttcgaggacaacgacttcgtgttcgtggtgctggagctgtgcagaagaagaagcctgctggagctgcacaagagaagaaaggccctgaccgagcccgaggccagatactacctgagacagatcgtgctgggctgccagtacctgcacagaaacagagtgatccacagagacctgaagctgggcaacctgttcctgaacgaggacctggaggtgaagatcggcgacttcggcctggccaccaaggtggagtacgacggcgagagaaagaagaccctgtgcggcacccccaactacatcgcccccgccgtgccctgcctgcagtgcgccccccagcccagatggctgggcagagccgccagcagcctgcaggtgggcgtggccgtgtag

SEQ ID NO: 12239 - DNA, 1521 bp, Artificial Sequence
  Description of Artificial Sequence: Synthetic coding sequence
atgagcatggagatcagcatccacagaagcctggcccaccagcacgtggtgggcttccacggcttcttcgaggacaacgacttcgtgttcgtggtgctggagctgtgcagaagaagaagcctgctggagctgcacaagagaagaaaggccctgaccgagcccgaggccagatactacctgagacagatcgtgctgggctgccagtacctgcacagaaacagagtgatccacagagacctgaagctgggcaacctgttcctgaacgaggacctggaggtgaagatcggcgacttcggcctggccaccaaggtggagtacgacggcgagagaaagaagaccctgtgcggcacccccaactacatcgcccccgaggtgctgagcaagaagggccacagcttcgaggtggacgtgtggagcatcggctgcatcatgtacaccctgctggtgggcaagccccccttcgagaccagctgcctgaaggagacctacctgagaatcaagaagaacgagtacagcatccccaagcacatcaaccccgtggccgccagcctgatccagaagatgctgcagaccgaccccaccgccagacccaccatcaacgagctgctgaacgacgagttcttcaccagcggctacatccccgccagactgcccatcacctgcctgaccatcccccccagattcagcatcgcccccagcagcctggaccccagcaacagaaagcccctgaccgtgctgaacaagggcctggagaaccccctgcccgagagacccagagagaaggaggagcccgtggtgagagagaccggcgaggtggtggactgccacctgagcgacatgctgcagcagctgcacagcgtgaacgccagcaagcccagcgagagaggcctggtgagacaggaggaggccgaggaccccgcctgcatccccatcttctgggtgagcaagtgggtggactacagcgacaagtacggcctgggctaccagctgtgcgacaacagcgtgggcgtgctgttcaacgacagcaccagactgatcctgtacaacgacggcgacagcctgcagtacatcgagagagacggcaccgagagctacctgaccgtgagcagccaccccaacagcctgatgaagaagatcaccctgctgaagtacttcagaaactacatgagcgagcacctgctgaaggccggcgccaacatcacccccagagagggcgacgagctggccagactgccctacctgagaacctggttcagaaccagaagcgccatcatcctgcacctgagcaacggcagcgtgcagatcaacttcttccaggaccacaccaagctgatcctgtgccccctgatggccgccgtgacctacatcgacgagaagagagacttcagaacctacagactgagcctgctggaggagtacggctgctgcaaggagctggccagcagactgagatacgccagaaccatggtggacaagctgctgagcagcagaagcgccagcaacagactgaaggccagctag

SEQ ID NO: 12240 - DNA, 1941 bp, Artificial Sequence
  Description of Artificial Sequence: Synthetic coding sequence
atggagcccgccgccggcttcctgagccccagacccttccagagagccgccgccgcccccgccccccccgccggccccggccccccccccagcgccctgagaggccccgagctggagatgctggccggcctgcccaccagcgaccccggcagactgatcaccgaccccagaagcggcagaacctacctgaagggcagactgctgggcaagggcggcttcgccagatgctacgaggccaccgacaccgagaccggcagcgcctacgccgtgaaggtgatcccccagagcagagtggccaagccccaccagagagagaagatcctgaacgagatcgagctgcacagagacctgcagcacagacacatcgtgagattcagccaccacttcgaggacgccgacaacatctacatcttcctggagctgtgcagcagaaagagcctggcccacatctggaaggccagacacaccctgctggagcccgaggtgagatactacctgagacagatcctgagcggcctgaagtacctgcaccagagaggcatcctgcacagagacctgaagctgggcaacttcttcatcaccgagaacatggagctgaaggtgggcgacttcggcctggccgccagactggagccccccgagcagagaaagaagaccatctgcggcacccccaactacgtggcccccgaggtgctgctgagacagggccacggccccgaggccgacgtgtggagcctgggctgcgtgatgtacaccctgctgtgcggcagcccccccttcgagaccgccgacctgaaggagacctacagatgcatcaagcaggtgcactacaccctgcccgccagcctgagcctgcccgccagacagctgctggccgccatcctgagagccagccccagagacagacccagcatcgaccagatcctgagacacgacttcttcaccaagggctacacccccgacagactgcccatcagcagctgcgtgaccgtgcccgacctgaccccccccaaccccgccagaagcctgttcgccaaggtgaccaagagcctgttcggcagaaagaagaagagcaagaaccacgcccaggagagagacgaggtgagcggcctggtgagcggcctgatgagaaccagcgtgggccaccaggacgccagacccgaggcccccgccgccagcggccccgcccccgtgagcctggtggagaccgcccccgaggacagcagccccagaggcaccctggccagcagcggcgacggcttcgaggagggcctgaccgtggccaccgtggtggagagcgccctgtgcgccctgagaaactgcatcgccttcatgccccccgccgagcagaaccccgcccccctggcccagcccgagcccctggtgtgggtgagcaagtgggtggactacagcaacaagttcggcttcggctaccagctgagcagcagaagagtggccgtgctgttcaacgacggcacccacatggccctgagcgccaacagaaagaccgtgcactacaaccccaccagcaccaagcacttcagcttcagcgtgggcgccgtgcccagagccctgcagccccagctgggcatcctgagatacttcgccagctacatggagcagcacctgatgaagggcggcgacctgcccagcgtggaggaggtggaggtgcccgccccccccctgctgctgcagtgggtgaagaccgaccaggccctgctgatgctgttcagcgacggcaccgtgcaggtgaacttctacggcgaccacaccaagctgatcctgagcggctgggagcccctgctggtgaccttcgtggccagaaacagaagcgcctgcacctacctggccagccacctgagacagctgggctgcagccccgacctgagacagagactgagatacgccctgagactgctgagagacagaagccccgcctag

SEQ ID NO: 12241 - DNA, 1866 bp, Artificial Sequence
  Description of Artificial Sequence: Synthetic coding sequence
agcagacagagacacgccagacccggccccggcggcaccgagaagcccggccccagatgcgacgcccccgccgcctggagcctgccccccgtgagctgcctgagaacctacctgaagggcagactgctgggcaagggcggcttcgccagatgctacgaggccaccgacaccgagaccggcagcgcctacgccgtgaaggtgatcccccagagcagagtggccaagccccaccagagagagaagatcctgaacgagatcgagctgcacagagacctgcagcacagacacatcgtgagattcagccaccacttcgaggacgccgacaacatctacatcttcctggagctgtgcagcagaaagagcctggcccacatctggaaggccagacacaccctgctggagcccgaggtgagatactacctgagacagatcctgagcggcctgaagtacctgcaccagagaggcatcctgcacagagacctgaagctgggcaacttcttcatcaccgagaacatggagctgaaggtgggcgacttcggcctggccgccagactggagccccccgagcagagaaagaagaccatctgcggcacccccaactacgtggcccccgaggtgctgctgagacagggccacggccccgaggccgacgtgtggagcctgggctgcgtgatgtacaccctgctgtgcggcagcccccccttcgagaccgccgacctgaaggagacctacagatgcatcaagcaggtgcactacaccctgcccgccagcctgagcctgcccgccagacagctgctggccgccatcctgagagccagccccagagacagacccagcatcgaccagatcctgagacacgacttcttcaccaagggctacacccccgacagactgcccatcagcagctgcgtgaccgtgcccgacctgaccccccccaaccccgccagaagcctgttcgccaaggtgaccaagagcctgttcggcagaaagaagaagagcaagaaccacgcccaggagagagacgaggtgagcggcctggtgagcggcctgatgagaaccagcgtgggccaccaggacgccagacccgaggcccccgccgccagcggccccgcccccgtgagcctggtggagaccgcccccgaggacagcagccccagaggcaccctggccagcagcggcgacggcttcgaggagggcctgaccgtggccaccgtggtggagagcgccctgtgcgccctgagaaactgcatcgccttcatgccccccgccgagcagaaccccgcccccctggcccagcccgagcccctggtgtgggtgagcaagtgggtggactacagcaacaagttcggcttcggctaccagctgagcagcagaagagtggccgtgctgttcaacgacggcacccacatggccctgagcgccaacagaaagaccgtgcactacaaccccaccagcaccaagcacttcagcttcagcgtgggcgccgtgcccagagccctgcagccccagctgggcatcctgagatacttcgccagctacatggagcagcacctgatgaagggcggcgacctgcccagcgtggaggaggtggaggtgcccgccccccccctgctgctgcagtgggtgaagaccgaccaggccctgctgatgctgttcagcgacggcaccgtgcaggtgaacttctacggcgaccacaccaagctgatcctgagcggctgggagcccctgctggtgaccttcgtggccagaaacagaagcgcctgcacctacctggccagccacctgagacagctgggctgcagccccgacctgagacagagactgagatacgccctgagactgctgagagacagaagccccgcctag

SEQ ID NO: 12242 - DNA, 2913 bp, Artificial Sequence
  Description of Artificial Sequence: Synthetic coding sequence
atggccacctgcatcggcgagaagatcgaggacttcaaggtgggcaacctgctgggcaagggcagcttcgccggcgtgtacagagccgagagcatccacaccggcctggaggtggccatcaagatgatcgacaagaaggccatgtacaaggccggcatggtgcagagagtgcagaacgaggtgaagatccactgccagctgaagcaccccagcatcctggagctgtacaactacttcgaggacagcaactacgtgtacctggtgctggagatgtgccacaacggcgagatgaacagatacctgaagaacagagtgaagcccttcagcgagaacgaggccagacacttcatgcaccagatcatcaccggcatgctgtacctgcacagccacggcatcctgcacagagacctgaccctgagcaacctgctgctgaccagaaacatgaacatcaagatcgccgacttcggcctggccacccagctgaagatgccccacgagaagcactacaccctgtgcggcacccccaactacatcagccccgagatcgccaccagaagcgcccacggcctggagagcgacgtgtggagcctgggctgcatgttctacaccctgctgatcggcagaccccccttcgacaccgacaccgtgaagaacaccctgaacaaggtggtgctggccgactacgagatgcccagcttcctgagcatcgaggccaaggacctgatccaccagctgctgagaagaaaccccgccgacagactgagcctgagcagcgtgctggaccaccccttcatgagcagaaacagcagcaccaagagcaaggacctgggcaccgtggaggacagcatcgacagcggccacgccaccatcagcaccgccatcaccgccagcagcagcaccagcatcagcggcagcctgttcgacaagagaagactgctgatcggccagcccctgcccaacaagatgaccgtgttccccaagaacaagagcagcaccgacttcagcagcagcggcgacggcaacagcttctacacccagtggggcaaccaggagaccagcaacagcggcagaggcagagtgatccaggacgccgaggagagaccccacagcagatacctgagaagagcctacagcagcgacagaagcggcaccagcaacagccagagccaggccaagacctacaccatggagagatgccacagcgccgagatgctgagcgtgagcaagagaagcggcggcggcgagaacgaggagagatacagccccaccgacaacaacgccaacatcttcaacttcttcaaggagaagaccagcagcagcagcggcagcttcgagagacccgacaacaaccaggccctgagcaaccacctgtgccccggcaagacccccttccccttcgccgaccccaccccccagaccgagaccgtgcagcagtggttcggcaacctgcagatcaacgcccacctgagaaagaccaccgagtacgacagcatcagccccaacagagacttccagggccaccccgacctgcagaaggacaccagcaagaacgcctggaccgacaccaaggtgaagaagaacagcgacgccagcgacaacgcccacagcgtgaagcagcagaacaccatgaagtacatgaccgccctgcacagcaagcccgagatcatccagcaggagtgcgtgttcggcagcgaccccctgagcgagcagagcaagaccagaggcatggagcccccctggggctaccagaacagaaccctgagaagcatcaccagccccctggtggcccacagactgaagcccatcagacagaagaccaagaaggccgtggtgagcatcctggacagcgaggaggtgtgcgtggagctggtgaaggagtacgccagccaggagtacgtgaaggaggtgctgcagatcagcagcgacggcaacaccatcaccatctactaccccaacggcggcagaggcttccccctggccgacagaccccccagccccaccgacaacatcagcagatacagcttcgacaacctgcccgagaagtactggagaaagtaccagtacgccagcagattcgtgcagctggtgagaagcaagagccccaagatcacctacttcaccagatacgccaagtgcatcctgatggagaacagccccggcgccgacttcgaggtgtggttctacgacggcgtgaagatccacaagaccgaggacttcatccaggtgatcgagaagaccggcaagagctacaccctgaagagcgagagcgaggtgaacagcctgaaggaggagatcaagatgtacatggaccacgccaacgagggccacagaatctgcctggccctggagagcatcatcagcgaggaggagagaaagaccagaagcgcccccttcttccccatcatcatcggcagaaagcccggcagcaccagcagccccaaggccctgagccccccccccagcgtggacagcaactaccccaccagagagagagccagcttcaacagaatggtgatgcacagcgccgccagccccacccaggcccccatcctgaaccccagcatggtgaccaacgagggcctgggcctgaccaccaccgccagcggcaccgacatcagcagcaacagcctgaaggactgcctgcccaagagcgcccagctgctgaagagcgtgttcgtgaagaacgtgggctgggccacccagctgaccagcggcgccgtgtgggtgcagttcaacgacggcagccagctggtggtgcaggccggcgtgagcagcatcagctacaccagccccaacggccagaccaccagatacggcgagaacgagaagctgcccgactacatcaagcagaagctgcagtgcctgagcagcatcctgctgatgttcagcaaccccacccccaacttccactag

SEQ ID NO: 12243 - DNA, 2817 bp, Artificial Sequence
  Description of Artificial Sequence: Synthetic coding sequence
atggccacctgcatcggcgagaagatcgaggacttcaaggtgggcaacctgctgggcaagggcagcttcgccggcgtgtacagagccgagagcatccacaccggcctggaggtggccatcaagatgctgtacaactacttcgaggacagcaactacgtgtacctggtgctggagatgtgccacaacggcgagatgaacagatacctgaagaacagagtgaagcccttcagcgagaacgaggccagacacttcatgcaccagatcatcaccggcatgctgtacctgcacagccacggcatcctgcacagagacctgaccctgagcaacctgctgctgaccagaaacatgaacatcaagatcgccgacttcggcctggccacccagctgaagatgccccacgagaagcactacaccctgtgcggcacccccaactacatcagccccgagatcgccaccagaagcgcccacggcctggagagcgacgtgtggagcctgggctgcatgttctacaccctgctgatcggcagaccccccttcgacaccgacaccgtgaagaacaccctgaacaaggtggtgctggccgactacgagatgcccagcttcctgagcatcgaggccaaggacctgatccaccagctgctgagaagaaaccccgccgacagactgagcctgagcagcgtgctggaccaccccttcatgagcagaaacagcagcaccaagagcaaggacctgggcaccgtggaggacagcatcgacagcggccacgccaccatcagcaccgccatcaccgccagcagcagcaccagcatcagcggcagcctgttcgacaagagaagactgctgatcggccagcccctgcccaacaagatgaccgtgttccccaagaacaagagcagcaccgacttcagcagcagcggcgacggcaacagcttctacacccagtggggcaaccaggagaccagcaacagcggcagaggcagagtgatccaggacgccgaggagagaccccacagcagatacctgagaagagcctacagcagcgacagaagcggcaccagcaacagccagagccaggccaagacctacaccatggagagatgccacagcgccgagatgctgagcgtgagcaagagaagcggcggcggcgagaacgaggagagatacagccccaccgacaacaacgccaacatcttcaacttcttcaaggagaagaccagcagcagcagcggcagcttcgagagacccgacaacaaccaggccctgagcaaccacctgtgccccggcaagacccccttccccttcgccgaccccaccccccagaccgagaccgtgcagcagtggttcggcaacctgcagatcaacgcccacctgagaaagaccaccgagtacgacagcatcagccccaacagagacttccagggccaccccgacctgcagaaggacaccagcaagaacgcctggaccgacaccaaggtgaagaagaacagcgacgccagcgacaacgcccacagcgtgaagcagcagaacaccatgaagtacatgaccgccctgcacagcaagcccgagatcatccagcaggagtgcgtgttcggcagcgaccccctgagcgagcagagcaagaccagaggcatggagcccccctggggctaccagaacagaaccctgagaagcatcaccagccccctggtggcccacagactgaagcccatcagacagaagaccaagaaggccgtggtgagcatcctggacagcgaggaggtgtgcgtggagctggtgaaggagtacgccagccaggagtacgtgaaggaggtgctgcagatcagcagcgacggcaacaccatcaccatctactaccccaacggcggcagaggcttccccctggccgacagaccccccagccccaccgacaacatcagcagatacagcttcgacaacctgcccgagaagtactggagaaagtaccagtacgccagcagattcgtgcagctggtgagaagcaagagccccaagatcacctacttcaccagatacgccaagtgcatcctgatggagaacagccccggcgccgacttcgaggtgtggttctacgacggcgtgaagatccacaagaccgaggacttcatccaggtgatcgagaagaccggcaagagctacaccctgaagagcgagagcgaggtgaacagcctgaaggaggagatcaagatgtacatggaccacgccaacgagggccacagaatctgcctggccctggagagcatcatcagcgaggaggagagaaagaccagaagcgcccccttcttccccatcatcatcggcagaaagcccggcagcaccagcagccccaaggccctgagccccccccccagcgtggacagcaactaccccaccagagagagagccagcttcaacagaatggtgatgcacagcgccgccagccccacccaggcccccatcctgaaccccagcatggtgaccaacgagggcctgggcctgaccaccaccgccagcggcaccgacatcagcagcaacagcctgaaggactgcctgcccaagagcgcccagctgctgaagagcgtgttcgtgaagaacgtgggctgggccacccagctgaccagcggcgccgtgtgggtgcagttcaacgacggcagccagctggtggtgcaggccggcgtgagcagcatcagctacaccagccccaacggccagaccaccagatacggcgagaacgagaagctgcccgactacatcaagcagaagctgcagtgcctgagcagcatcctgctgatgttcagcaaccccacccccaacttccactag

SEQ ID NO: 12244 - DNA, 2790 bp, Artificial Sequence
  Description of Artificial Sequence: Synthetic coding sequence
atgatcgacaagaaggccatgtacaaggccggcatggtgcagagagtgcagaacgaggtgaagatccactgccagctgaagcaccccagcatcctggagctgtacaactacttcgaggacagcaactacgtgtacctggtgctggagatgtgccacaacggcgagatgaacagatacctgaagaacagagtgaagcccttcagcgagaacgaggccagacacttcatgcaccagatcatcaccggcatgctgtacctgcacagccacggcatcctgcacagagacctgaccctgagcaacctgctgctgaccagaaacatgaacatcaagatcgccgacttcggcctggccacccagctgaagatgccccacgagaagcactacaccctgtgcggcacccccaactacatcagccccgagatcgccaccagaagcgcccacggcctggagagcgacgtgtggagcctgggctgcatgttctacaccctgctgatcggcagaccccccttcgacaccgacaccgtgaagaacaccctgaacaaggtggtgctggccgactacgagatgcccagcttcctgagcatcgaggccaaggacctgatccaccagctgctgagaagaaaccccgccgacagactgagcctgagcagcgtgctggaccaccccttcatgagcagaaacagcagcaccaagagcaaggacctgggcaccgtggaggacagcatcgacagcggccacgccaccatcagcaccgccatcaccgccagcagcagcaccagcatcagcggcagcctgttcgacaagagaagactgctgatcggccagcccctgcccaacaagatgaccgtgttccccaagaacaagagcagcaccgacttcagcagcagcggcgacggcaacagcttctacacccagtggggcaaccaggagaccagcaacagcggcagaggcagagtgatccaggacgccgaggagagaccccacagcagatacctgagaagagcctacagcagcgacagaagcggcaccagcaacagccagagccaggccaagacctacaccatggagagatgccacagcgccgagatgctgagcgtgagcaagagaagcggcggcggcgagaacgaggagagatacagccccaccgacaacaacgccaacatcttcaacttcttcaaggagaagaccagcagcagcagcggcagcttcgagagacccgacaacaaccaggccctgagcaaccacctgtgccccggcaagacccccttccccttcgccgaccccaccccccagaccgagaccgtgcagcagtggttcggcaacctgcagatcaacgcccacctgagaaagaccaccgagtacgacagcatcagccccaacagagacttccagggccaccccgacctgcagaaggacaccagcaagaacgcctggaccgacaccaaggtgaagaagaacagcgacgccagcgacaacgcccacagcgtgaagcagcagaacaccatgaagtacatgaccgccctgcacagcaagcccgagatcatccagcaggagtgcgtgttcggcagcgaccccctgagcgagcagagcaagaccagaggcatggagcccccctggggctaccagaacagaaccctgagaagcatcaccagccccctggtggcccacagactgaagcccatcagacagaagaccaagaaggccgtggtgagcatcctggacagcgaggaggtgtgcgtggagctggtgaaggagtacgccagccaggagtacgtgaaggaggtgctgcagatcagcagcgacggcaacaccatcaccatctactaccccaacggcggcagaggcttccccctggccgacagaccccccagccccaccgacaacatcagcagatacagcttcgacaacctgcccgagaagtactggagaaagtaccagtacgccagcagattcgtgcagctggtgagaagcaagagccccaagatcacctacttcaccagatacgccaagtgcatcctgatggagaacagccccggcgccgacttcgaggtgtggttctacgacggcgtgaagatccacaagaccgaggacttcatccaggtgatcgagaagaccggcaagagctacaccctgaagagcgagagcgaggtgaacagcctgaaggaggagatcaagatgtacatggaccacgccaacgagggccacagaatctgcctggccctggagagcatcatcagcgaggaggagagaaagaccagaagcgcccccttcttccccatcatcatcggcagaaagcccggcagcaccagcagccccaaggccctgagccccccccccagcgtggacagcaactaccccaccagagagagagccagcttcaacagaatggtgatgcacagcgccgccagccccacccaggcccccatcctgaaccccagcatggtgaccaacgagggcctgggcctgaccaccaccgccagcggcaccgacatcagcagcaacagcctgaaggactgcctgcccaagagcgcccagctgctgaagagcgtgttcgtgaagaacgtgggctgggccacccagctgaccagcggcgccgtgtgggtgcagttcaacgacggcagccagctggtggtgcaggccggcgtgagcagcatcagctacaccagccccaacggccagaccaccagatacggcgagaacgagaagctgcccgactacatcaagcagaagctgcagtgcctgagcagcatcctgctgatgttcagcaaccccacccccaacttccactag

SEQ ID NO: 12245 - DNA, 1752 bp, Artificial Sequence
  Description of Artificial Sequence: Synthetic coding sequence
atggccgccagaagaagaagaagcaccggcggcggcagagccagagccctgaacgagagcaagagagtgaacaacggcaacaccgcccccgaggacagcagccccgccaagaagaccagaagatgccagagacaggagagcaagaagatgcccgtggccggcggcaaggccaacaaggacagaaccgaggacaagcaggacggcatgcccggcagaagctgggccagcaagagagtgagcgagagcgtgaaggccctgctgctgaagggcaaggcccccgtggaccccgagtgcaccgccaaggtgggcaaggcccacgtgtactgcgagggcaacgacgtgtacgacgtgatgctgaaccagaccaacctgcagttcaacaacaacaagtactacctgatccagctgctggaggacgacgcccagagaaacttcagcgtgtggatgagatggggcagagtgggcaagatgggccagcacagcctggtggcctgcagcggcaacctgaacaaggccaaggagatcttccagaagaagttcctggacaagaccaagaacaactgggaggacagagagaagttcgagaaggtgcccggcaagtacgacatgctgcagatggactacgccaccaacacccaggacgaggaggagaccaagaaggaggagagcctgaagagccccctgaagcccgagagccagctggacctgagagtgcaggagctgatcaagctgatctgcaacgtgcaggccatggaggagatgatgatggagatgaagtacaacaccaagaaggcccccctgggcaagctgaccgtggcccagatcaaggccggctaccagagcctgaagaagatcgaggactgcatcagagccggccagcacggcagagccctgatggaggcctgcaacgagttctacaccagaatcccccacgacttcggcctgagaaccccccccctgatcagaacccagaaggagctgagcgagaagatccagctgctggaggccctgggcgacatcgagatcgccatcaagctggtgaagaccgagctgcagagccccgagcaccccctggaccagcactacagaaacctgcactgcgccctgagacccctggaccacgagagctacgagttcaaggtgatcagccagtacctgcagagcacccacgcccccacccacagcgactacaccatgaccctgctggacctgttcgaggtggagaaggacggcgagaaggaggccttcagagaggacctgcacaacagaatgctgctgtggcacggcagcagaatgagcaactgggtgggcatcctgagccacggcctgagaatcgccccccccgaggcccccatcaccggctacatgttcggcaagggcatctacttcgccgacatgagcagcaagagcgccaactactgcttcgccagcagactgaagaacaccggcctgctgctgctgagcgaggtggccctgggccagtgcaacgagctgctggaggccaaccccaaggccgagggcctgctgcagggcaagcacagcaccaagggcctgggcaagatggcccccagcagcgcccacttcgtgaccctgaacggcagcaccgtgcccctgggccccgccagcgacaccggcatcctgaaccccgacggctacaccctgaactacaacgagtacatcgtgtacaaccccaaccaggtgagaatgagatacctgctgaaggtgcagttcaacttcctgcagctgtggtag

SEQ ID NO: 12246 - DNA, 1713 bp, Artificial Sequence
  Description of Artificial Sequence: Synthetic coding sequence
atggccgccagaagaagaagaagcaccggcggcggcagagccagagccctgaacgagagcaagagagtgaacaacggcaacaccgcccccgaggacagcagccccgccaagaagaccagaagatgccagagacaggagagcaagaagatgcccgtggccggcggcaaggccaacaaggacagaaccgaggacaagcaggacgagagcgtgaaggccctgctgctgaagggcaaggcccccgtggaccccgagtgcaccgccaaggtgggcaaggcccacgtgtactgcgagggcaacgacgtgtacgacgtgatgctgaaccagaccaacctgcagttcaacaacaacaagtactacctgatccagctgctggaggacgacgcccagagaaacttcagcgtgtggatgagatggggcagagtgggcaagatgggccagcacagcctggtggcctgcagcggcaacctgaacaaggccaaggagatcttccagaagaagttcctggacaagaccaagaacaactgggaggacagagagaagttcgagaaggtgcccggcaagtacgacatgctgcagatggactacgccaccaacacccaggacgaggaggagaccaagaaggaggagagcctgaagagccccctgaagcccgagagccagctggacctgagagtgcaggagctgatcaagctgatctgcaacgtgcaggccatggaggagatgatgatggagatgaagtacaacaccaagaaggcccccctgggcaagctgaccgtggcccagatcaaggccggctaccagagcctgaagaagatcgaggactgcatcagagccggccagcacggcagagccctgatggaggcctgcaacgagttctacaccagaatcccccacgacttcggcctgagaaccccccccctgatcagaacccagaaggagctgagcgagaagatccagctgctggaggccctgggcgacatcgagatcgccatcaagctggtgaagaccgagctgcagagccccgagcaccccctggaccagcactacagaaacctgcactgcgccctgagacccctggaccacgagagctacgagttcaaggtgatcagccagtacctgcagagcacccacgcccccacccacagcgactacaccatgaccctgctggacctgttcgaggtggagaaggacggcgagaaggaggccttcagagaggacctgcacaacagaatgctgctgtggcacggcagcagaatgagcaactgggtgggcatcctgagccacggcctgagaatcgccccccccgaggcccccatcaccggctacatgttcggcaagggcatctacttcgccgacatgagcagcaagagcgccaactactgcttcgccagcagactgaagaacaccggcctgctgctgctgagcgaggtggccctgggccagtgcaacgagctgctggaggccaaccccaaggccgagggcctgctgcagggcaagcacagcaccaagggcctgggcaagatggcccccagcagcgcccacttcgtgaccctgaacggcagcaccgtgcccctgggccccgccagcgacaccggcatcctgaaccccgacggctacaccctgaactacaacgagtacatcgtgtacaaccccaaccaggtgagaatgagatacctgctgaaggtgcagttcaacttcctgcagctgtggtag

SEQ ID NO: 12247 - DNA, 1623 bp, Artificial Sequence
  Description of Artificial Sequence: Synthetic coding sequence
atgagcctgctgttcctggccatggcccccaagcccaagccctgggtgcagaccgagggccccgagaagaagaagggcagacaggccggcagagaggaggaccccttcagaagcaccgccgaggccctgaaggccatccccgccgagaagagaatcatcagagtggaccccacctgccccctgagcagcaaccccggcacccaggtgtacgaggactacaactgcaccctgaaccagaccaacatcgagaacaacaacaacaagttctacatcatccagctgctgcaggacagcaacagattcttcacctgctggaaccactggggcagagtgggcgaggtgggccagagcaagatcaaccacttcaccagactggaggacgccaagaaggacttcgagaagaagttcagagagaagaccaagaacaactgggccgagagagaccacttcgtgagccaccccggcaagtacaccctgatcgaggtgcaggccgaggacgaggcccaggaggccgtggtgaaggtggacagaggccccgtgagaaccgtgaccaagagagtgcagccctgcagcctggaccccgccacccagaagctgatcaccaacatcttcagcaaggagatgttcaagaacaccatggccctgatggacctggacgtgaagaagatgcccctgggcaagctgagcaagcagcagatcgccagaggcttcgaggccctggaggccctggaggaggccctgaagggccccaccgacggcggccagagcctggaggagctgagcagccacttctacaccgtgatcccccacaacttcggccacagccagcccccccccatcaacagccccgagctgctgcaggccaagaaggacatgctgctggtgctggccgacatcgagctggcccaggccctgcaggccgtgagcgagcaggagaagaccgtggaggaggtgccccaccccctggacagagactaccagctgctgaagtgccagctgcagctgctggacagcggcgcccccgagtacaaggtgatccagacctacctggagcagaccggcagcaaccacagatgccccaccctgcagcacatctggaaggtgaaccaggagggcgaggaggacagattccaggcccacagcaagctgggcaacagaaagctgctgtggcacggcaccaacatggccgtggtggccgccatcctgaccagcggcctgagaatcatgccccacagcggcggcagagtgggcaagggcatctacttcgccagcgagaacagcaagagcgccggctacgtgatcggcatgaagtgcggcgcccaccacgtgggctacatgttcctgggcgaggtggccctgggcagagagcaccacatcaacaccgacaaccccagcctgaagagccccccccccggcttcgacagcgtgatcgccagaggccacaccgagcccgaccccacccaggacaccgagctggagctggacggccagcaggtggtggtgccccagggccagcccgtgccctgccccgagttcagcagcagcaccttcagccagagcgagtacctgatctaccaggagagccagtgcagactgagatacctgctggaggtgcacctgtag

SEQ ID NO: 12248 - DNA, 1602 bp, Artificial Sequence
  Description of Artificial Sequence: Synthetic coding sequence
atggcccccaagcccaagccctgggtgcagaccgagggccccgagaagaagaagggcagacaggccggcagagaggaggaccccttcagaagcaccgccgaggccctgaaggccatccccgccgagaagagaatcatcagagtggaccccacctgccccctgagcagcaaccccggcacccaggtgtacgaggactacaactgcaccctgaaccagaccaacatcgagaacaacaacaacaagttctacatcatccagctgctgcaggacagcaacagattcttcacctgctggaaccactggggcagagtgggcgaggtgggccagagcaagatcaaccacttcaccagactggaggacgccaagaaggacttcgagaagaagttcagagagaagaccaagaacaactgggccgagagagaccacttcgtgagccaccccggcaagtacaccctgatcgaggtgcaggccgaggacgaggcccaggaggccgtggtgaaggtggacagaggccccgtgagaaccgtgaccaagagagtgcagccctgcagcctggaccccgccacccagaagctgatcaccaacatcttcagcaaggagatgttcaagaacaccatggccctgatggacctggacgtgaagaagatgcccctgggcaagctgagcaagcagcagatcgccagaggcttcgaggccctggaggccctggaggaggccctgaagggccccaccgacggcggccagagcctggaggagctgagcagccacttctacaccgtgatcccccacaacttcggccacagccagcccccccccatcaacagccccgagctgctgcaggccaagaaggacatgctgctggtgctggccgacatcgagctggcccaggccctgcaggccgtgagcgagcaggagaagaccgtggaggaggtgccccaccccctggacagagactaccagctgctgaagtgccagctgcagctgctggacagcggcgcccccgagtacaaggtgatccagacctacctggagcagaccggcagcaaccacagatgccccaccctgcagcacatctggaaggtgaaccaggagggcgaggaggacagattccaggcccacagcaagctgggcaacagaaagctgctgtggcacggcaccaacatggccgtggtggccgccatcctgaccagcggcctgagaatcatgccccacagcggcggcagagtgggcaagggcatctacttcgccagcgagaacagcaagagcgccggctacgtgatcggcatgaagtgcggcgcccaccacgtgggctacatgttcctgggcgaggtggccctgggcagagagcaccacatcaacaccgacaaccccagcctgaagagccccccccccggcttcgacagcgtgatcgccagaggccacaccgagcccgaccccacccaggacaccgagctggagctggacggccagcaggtggtggtgccccagggccagcccgtgccctgccccgagttcagcagcagcaccttcagccagagcgagtacctgatctaccaggagagccagtgcagactgagatacctgctggaggtgcacctgtag

SEQ ID NO: 12249 - DNA, 1602 bp, Artificial Sequence; identical to SEQ ID NO: 12248
  Description of Artificial Sequence: Synthetic coding sequence

SEQ ID NO: 12250 - DNA, 999 bp, Artificial Sequence
  Description of Artificial Sequence: Synthetic coding sequence
atggcccccaagcccaagccctgggtgcagaccgagggccccgagaagaagaagggcagacaggccggcagagaggaggaccccttcagaagcaccgccgaggccctgaaggccatccccgccgagaagagaatcatcagagtggaccccacctgccccctgagcagcaaccccggcacccaggtgtacgaggactacaactgcaccctgaaccagaccaacatcgagaacaacaacaacaagttctacatcatccagctgctgcaggacagcaacagattcttcacctgctggaaccactggggcagagtgggcgaggtgggccagagcaagatcaaccacttcaccagactggaggacgccaagaaggacttcgagaagaagttcagagagaagaccaagaacaactgggccgagagagaccacttcgtgagccaccccggcaagtacaccctgatcgaggtgcaggccgaggacgaggcccaggaggccgtggtgaaggtggacagaggccccgtgagaaccgtgaccaagagagtgcagccctgcagcctggaccccgccacccagaagctgatcaccaacatcttcagcaaggagatgttcaagaacaccatggccctgatggacctggacgtgaagaagatgcccctgggcaagctgagcaagcagcagatcgccagaggcttcgaggccctggaggccctggaggaggccctgaagggccccaccgacggcggccagagcctggaggagctgagcagccacttctacaccgtgatcccccacaacttcggccacagccagcccccccccatcaacagccccgagctgctgcaggccaagaaggacatgctgctggtgctggccgacatcgagctggcccaggccctgcaggccgtgagcgagcaggagaagaccgtggaggaggtgccccaccccctggacagagactaccagctgctgaagtgccagctgcagctgctggacagcggctag

SEQ ID NO: 12251 - DNA, 5175 bp, Artificial Sequence
  Description of Artificial Sequence: Synthetic coding sequence
atggtgatgggcatcttcgccaactgcatcttctgcctgaaggtgaagtacctgccccagcagcagaagaagaagctgcagaccgacatcaaggagaacggcggcaagttcagcttcagcctgaacccccagtgcacccacatcatcctggacaacgccgacgtgctgagccagtaccagctgaacagcatccagaagaaccacgtgcacatcgccaaccccgacttcatctggaagagcatcagagagaagagactgctggacgtgaagaactacgacccctacaagcccctggacatcacccccccccccgaccagaaggccagcagcagcgaggtgaagaccgagggcctgtgccccgacagcgccaccgaggaggaggacaccgtggagctgaccgagttcggcatgcagaacgtggagatcccccacctgccccaggacttcgaggtggccaagtacaacaccctggagaaggtgggcatggagggcggccaggaggccgtggtggtggagctgcagtgcagcagagacagcagagactgccccttcctgatcagcagccacttcctgctggacgacggcatggagaccagaagacagttcgccatcaagaagaccagcgaggacgccagcgagtacttcgagaactacatcgaggagctgaagaagcagggcttcctgctgagagagcacttcacccccgaggccacccagctggccagcgagcagctgcaggccctgctgctggaggaggtgatgaacagcagcaccctgagccaggaggtgagcgacctggtggagatgatctgggccgaggccctgggccacctggagcacatgctgctgaagcccgtgaacagaatcagcctgaacgacgtgagcaaggccgagggcatcctgctgctggtgaaggccgccctgaagaacggcgagaccgccgagcagctgcagaagatgatgaccgagttctacagactgatcccccacaagggcaccatgcccaaggaggtgaacctgggcctgctggccaagaaggccgacctgtgccagctgatcagagacatggtgaacgtgtgcgagaccaacctgagcaagcccaacccccccagcctggccaagtacagagccctgagatgcaagatcgagcacgtggagcagaacaccgaggagttcctgagagtgagaaaggaggtgctgcagaaccaccacagcaagagccccgtggacgtgctgcagatcttcagagtgggcagagtgaacgagaccaccgagttcctgagcaagctgggcaacgtgagacccctgctgcacggcagccccgtgcagaacatcgtgggcatcctgtgcagaggcctgctgctgcccaaggtggtggaggacagaggcgtgcagagaaccgacgtgggcaacctgggcagcggcatctacttcagcgacagcctgagcaccagcatcaagtacagccaccccggcgagaccgacggcaccagactgctgctgatctgcgacgtggccctgggcaagtgcatggacctgcacgagaaggacttcagcctgaccgaggccccccccggctacgacagcgtgcacggcgtgagccagaccgccagcgtgaccaccgacttcgaggacgacgagttcgtggtgtacaagaccaaccaggtgaagatgaagtacatcatcaagttcagcatgcccggcgaccagatcaaggacttccaccccagcgaccacaccgagctggaggagtacagacccgagttcagcaacttcagcaaggtggaggactaccagctgcccgacgccaagaccagcagcagcaccaaggccggcctgcaggacgccagcggcaacctggtgcccctggaggacgtgcacatcaagggcagaatcatcgacaccgtggcccaggtgatcgtgttccagacctacaccaacaagagccacgtgcccatcgaggccaagtacatcttccccctggacgacaaggccgccgtgtgcggcttcgaggccttcatcaacggcaagcacatcgtgggcgagatcaaggagaaggaggaggcccagcaggagtacctggaggccgtgacccagggccacggcgcctacctgatgagccaggacgcccccgacgtgttcaccgtgagcgtgggcaacctgccccccaaggccaaggtgctgatcaagatcacctacatcaccgagctgagcatcctgggcaccgtgggcgtgttcttcatgcccgccaccgtggccccctggcagcaggacaaggccctgaacgagaacctgcaggacaccgtggagaagatctgcatcaaggagatcggcaccaagcagagcttcagcctgaccatgagcatcgagatgccctacgtgatcgagttcatcttcagcgacacccacgagctgaagcagaagagaaccgactgcaaggccgtgatcagcaccatggagggcagcagcctggacagcagcggcttcagcctgcacatcggcctgagcgccgcctacctgcccagaatgtgggtggagaagcaccccgagaaggagagcgaggcctgcatgctggtgttccagcccgacctggacgtggacctgcccgacctggccagcgagagcgaggtgatcatctgcctggactgcagcagcagcatggagggcgtgaccttcctgcaggccaagcagatcgccctgcacgccctgagcctggtgggcgagaagcagaaggtgaacatcatccagttcggcaccggctacaaggagctgttcagctaccccaagcacatcaccagcaacaccatggccgccgagttcatcatgagcgccacccccaccatgggcaacaccgacttctggaagaccctgagatacctgagcctgctgtaccccgccagaggcagcagaaacatcctgctggtgagcgacggccacctgcaggacgagagcctgaccctgcagctggtgaagagaagcagaccccacaccagactgttcgcctgcggcatcggcagcaccgccaacagacacgtgctgagaatcctgagccagtgcggcgccggcgtgttcgagtacttcaacgccaagagcaagcacagctggagaaagcagatcgaggaccagatgaccagactgtgcagccccagctgccacagcgtgagcgtgaagtggcagcagctgaaccccgacgtgcccgaggccctgcaggcccccgcccaggtgcccagcctgttcctgaacgacagactgctggtgtacggcttcatcccccactgcacccaggccaccctgtgcgccctgatccaggagaaggagttcagaaccatggtgagcaccaccgagctgcagaagaccaccggcaccatgatccacaagctggccgccagagccctgatcagagactacgaggacggcatcctgcacgagaacgagaccagccacgagatgaagaagcagaccctgaagagcctgatcatcaagctgagcaaggagaacagcctgatcacccagttcaccagcttcgtggccgtggagaagagagacgagaacgagagccccttccccgacatccccaaggtgagcgagctgatcgccaaggaggacgtggacttcctgccctacatgagctggcagggcgagccccaggaggccgtgagaaaccagagcctgctggccagcagcgagtggcccgagctgagactgagcaagagaaagcacagaaagatccccttcagcaagagaaagatggagctgagccagcccgaggtgagcgaggacttcgaggaggacggcctgggcgtgctgcccgccttcaccagcaacctggagagaggcggcgtggagaagctgctggacctgagctggaccgagagctgcaagcccaccgccaccgagcccctgttcaagaaggtgagcccctgggagaccagcaccagcagcttcttccccatcctggcccccgccgtgggcagctacctgccccccaccgccagagcccacagccccgccagcctgagcttcgccagctacagacaggtggccagcttcggcagcgccgccccccccagacagttcgacgccagccagttcagccagggccccgtgcccggcacctgcgccgactggatcccccagagcgccagctgccccaccggccccccccagaacccccccagcagcccctactgcggcatcgtgttcagcggcagcagcctgagcagcgcccagagcgcccccctgcagcaccccggcggcttcaccaccagacccagcgccggcaccttccccgagctggacagcccccagctgcacttcagcctgcccaccgaccccgaccccatcagaggcttcggcagctaccaccccagcgccagcagccccttccacttccagcccagcgccgccagcctgaccgccaacctgagactgcccatggccagcgccctgcccgaggccctgtgcagccagagcagaaccacccccgtggacctgtgcctgctggaggagagcgtgggcagcctggagggcagcagatgccccgtgttcgccttccagagcagcgacaccgagagcgacgagctgagcgaggtgctgcaggacagctgcttcctgcagatcaagtgcgacaccaaggacgacagcatcctgtgcttcctggaggtgaaggaggaggacgagatcgtgtgcatccagcactggcaggacgccgtgccctggaccgagctgctgagcctgcagaccgaggacggcttctggaagctgacccccgagctgggcctgatcctgaacctgaacaccaacggcctgcacagcttcctgaagcagaagggcatccagagcctgggcgtgaagggcagagagtgcctgctggacctgatcgccaccatgctggtgctgcagttcatcagaaccagactggagaaggagggcatcgtgttcaagagcctgatgaagatggacgacgccagcatcagcagaaacatcccctgggccttcgaggccatcaagcaggccagcgagtgggtgagaagaaccgagggccagtaccccagcatctgccccagactggagctgggcaacgactgggacagcgccaccaagcagctgctgggcctgcagcccatcagcaccgtgagccccctgcacagagtgctgcactacagccagggctag

SEQ ID NO: 12252 - DNA, 1911 bp, Artificial Sequence
  Description of Artificial Sequence: Synthetic coding sequence
atgaaccccagcgcccccagctaccccatggccagcctgtacgtgggcgacctgcaccccgacgtgaccgaggccatgctgtacgagaagttcagccccgccggccccatcctgagcatcagagtgtgcagagacatgatcaccagaagaagcctgggctacgcctacgtgaacttccagcagcccgccgacgccgagagagccctggacaccatgaacttcgacgtgatcaagggcaagcccgtgagaatcatgtggagccagagagaccccagcctgagaaagagcggcgtgggcaacatcttcatcaagaacctggacaagagcatcgacaacaaggccctgtacgacaccttcagcgccttcggcaacatcctgagctgcaaggtggtgtgcgacgagaacggcagcaagggctacggcttcgtgcacttcgagacccaggaggccgccgagagagccatcgagaagatgaacggcatgctgctgaacgacagaaaggtgttcgtgggcagattcaagagcagaaaggagagagaggccgagctgggcgccagagccaaggagttcaccaacgtgtacatcaagaacttcggcgaggacatggacgacgagagactgaaggacctgttcggcaagttcggccccgccctgagcgtgaaggtgatgaccgacgagagcggcaagagcaagggcttcggcttcgtgagcttcgagagacacgaggacgcccagaaggccgtggacgagatgaacggcaaggagctgaacggcaagcagatctacgtgggcagagcccagaagaaggtggagagacagaccgagctgaagagaaagttcgagcagatgaagcaggacagaatcaccagataccagggcgtgaacctgtacgtgaagaacctggacgacggcatcgacgacgagagactgagaaaggagttcagccccttcggcaccatcaccagcgccaaggtgatgatggagggcggcagaagcaagggcttcggcttcgtgtgcttcagcagccccgaggaggccaccaaggccgtgaccgagatgaacggcagaatcgtggccaccaagcccctgtacgtggccctggcccagagaaaggaggagagacaggcccacctgaccaaccagtacatgcagagaatggccagcgtgagagccgtgcccaaccccgtgatcaacccctaccagcccgccccccccagcggctacttcatggccgccatcccccagacccagaacagagccgcctactacccccccagccagatcgcccagctgagacccagccccagatggaccgcccagggcgccagaccccaccccttccagaacatgcccggcgccatcagacccgccgcccccagaccccccttcagcaccatgagacccgccagcagccaggtgcccagagtgatgagcacccagagagtggccaacaccagcacccagaccatgggccccagacccgccgccgccgccgccgccgccacccccgccgtgagaaccgtgccccagtacaagtacgccgccggcgtgagaaacccccagcagcacctgaacgcccagccccaggtgaccatgcagcagcccgccgtgcacgtgcagggccaggagcccctgaccgccagcatgctggccagcgcccccccccaggagcagaagcagatgctgggcgagagactgttccccctgatccaggccatgcaccccaccctggccggcaagatcaccggcatgctgctggagatcgacaacagcgagctgctgcacatgctggagagccccgagagcctgagaagcaaggtggacgaggccgtggccgtgctgcaggcccaccaggccaaggaggccgcccagaaggccgtgaacagcgccaccggcgtgcccaccgtgtag

SEQ ID NO: 12253 - DNA, 1644 bp, Artificial Sequence
  Description of Artificial Sequence: Synthetic coding sequence
atgaaccccagcgcccccagctaccccatggccagcctgtacgtgggcgacctgcaccccgacgtgaccgaggccatgctgtacgagaagttcagccccgccggccccatcctgagcatcagagtgtgcagagacatgatcaccagaagaagcctgggctacgcctacgtgaacttccagcagcccgccgacgccgagagagccctggacaccatgaacttcgacgtgatcaagggcaagcccgtgagaatcatgtggagccagagagaccccagcctgagaaagagcggcgtgggcaacatcttcatcaagaacctggacaagagcatcgacaacaaggccctgtacgacaccttcagcgccttcggcaacatcctgagctgcaaggtggtgtgcgacgagaacggcagcaagggctacggcttcgtgcacttcgagacccaggaggccgccgagagagccatcgagaagatgaacggcatgctgctgaacgacagaaaggtgttcgtgggcagattcaagagcagaaaggagagagaggccgagctgggcgccagagccaaggagttcaccaacgtgtacatcaagaacttcggcgaggacatggacgacgagagactgaaggacctgttcggcaagttcggccccgccctgagcgtgaaggtgatgaccgacgagagcggcaagagcaagggcttcggcttcgtgagcttcgagagacacgaggacgcccagaaggccgtggacgagatgaacggcaaggagctgaacggcaagcagatctacgtgggcagagcccagaagaaggtggagagacagaccgagctgaagagaaagttcgagcagatgaagcaggacagaatcaccagataccagggcgtgaacctgtacgtgaagaacctggacgacggcatcgacgacgagagactgagaaaggagttcagccccttcggcaccatcaccagcgccaaggtgatgatggagggcggcagaagcaagggcttcggcttcgtgtgcttcagcagccccgaggaggccaccaaggccgtgaccgagatgaacggcagaatcgtggccaccaagcccctgtacgtggccctggcccagagaaaggaggagagacaggcccacctgaccaaccagtacatgcagagaatggccagcgtgagagccgtgcccaaccccgtgatcaacccctaccagcccgccccccccagcggctacttcatggccgccatcccccagacccagaacagagccgcctactacccccccagccagatcgcccagctgagacccagccccagatggaccgcccagggcgccagaccccaccccgccgtgcacgtgcagggccaggagcccctgaccgccagcatgctggccagcgcccccccccaggagcagaagcagatgctgggcgagagactgttccccctgatccaggccatgcaccccaccctggccggcaagatcaccggcatgctgctggagatcgacaacagcgagctgctgcacatgctggagagccccgagagcctgagaagcaaggtggacgaggccgtggccgtgctgcaggcccaccaggccaaggaggccgcccagaaggccgtgaacagcgccaccggcgtgcccaccgtgtag

SEQ ID NO: 12254 - DNA, 129 bp, Artificial Sequence
  Description of Artificial Sequence: Synthetic coding sequence
tgaatgctggagagccccgagagcctgagaagcaaggtggacgaggccgtggccgtgctgcaggcccaccaggccaaggaggccgcccagaaggccgtgaacagcgccaccggcgtgcccaccgtgtag

SEQ ID NO: 12255 - DNA, 117 bp, Artificial Sequence
  Description of Artificial Sequence: Synthetic coding sequence
atgaaccccagcgcccccagctaccccatggccagcctgtacgtgggcgacctgcaccccgacgtgaccgaggccatgctgtacgagaagttcagccccgccggccccatcctgtag

SEQ ID NO: 12256 - DNA, 357 bp, Artificial Sequence
  Description of Artificial Sequence: Synthetic coding sequence
atgaaccccagcgcccccagctaccccatggccagcctgtacgtgggcgacctgcaccccgacgtgaccgaggccatgctgtacgagaagttcagccccgccggccccatcctgagcatcagagtgtgcagagacatgatcaccagaagaagcctgggctacgcctacgtgaacttccagcagcccgccgacgccgagagagccctggacaccatgaacttcgacgtgatcaagggcaagcccgtgagaatcatgtggagccagagagaccccagcctgagaaagagcggcgtgggcaacatcttcatcaagaacctggacaagagcatcgacaacaaggccctgtacgacacctag

SEQ ID NO: 12257 - DNA, 132 bp, Artificial Sequence
  Description of Artificial Sequence: Synthetic coding sequence
atgaaccccagcgcccccagctaccccatggccagcctgtacgtgggcgacctgcaccccgacgtgaccgaggccatgctgtacgagaagttcagccccgccggccccatcctgagcatcagagtgtgctag

SEQ ID NO: 12258 - DNA, 510 bp, Artificial Sequence
  Description of Artificial Sequence: Synthetic coding sequence
tgagccagcagccaggtgcccagagtgatgagcacccagagagtggccaacaccagcacccagaccatgggccccagacccgccgccgccgccgccgccgccacccccgccgtgagaaccgtgccccagtacaagtacgccgccggcgtgagaaacccccagcagcacctgaacgcccagccccaggtgaccatgcagcagcccgccgtgcacgtgcagggccaggagcccctgaccgccagcatgctggccagcgcccccccccaggagcagaagcagatgctgggcgagagactgttccccctgatccaggccatgcaccccaccctggccggcaagatcaccggcatgctgctggagatcgacaacagcgagctgctgcacatgctggagagccccgagagcctgagaagcaaggtggacgaggccgtggccgtgctgcaggcccaccaggccaaggaggccgcccagaaggccgtgaacagcgccaccggcgtgcccaccgtgtag

SEQ ID NO: 12259 - DNA, 186 bp, Artificial Sequence
  Description of Artificial Sequence: Synthetic coding sequence
atgaaccccagcgcccccagctaccccatggccagcctgtacgtgggcgacctgcaccccgacgtgaccgaggccatgctgtacgagaagttcagccccgccggccccatcctgagcatcagagtgtgcagagacatgatcaccagaagaagcctgggctacgcctacgtgaacttccagcagtag

SEQ ID NO: 12260 - DNA, 390 bp, Artificial Sequence
  Description of Artificial Sequence: Synthetic coding sequence
atgaaccccagcgcccccagctaccccatggccagcctgtacgtgggcgacctgcaccccgacgtgaccgaggccatgctgtacgagaagttcagccccgccggccccatcctgagcatcagagtgtgcagagacatgatcaccagaagaagcctgggctacgcctacgtgaacttccagcagcccgccgacgccgagagagccctggacaccatgaacttcgacgtgatcaagggcaagcccgtgagaatcatgtggagccagagagaccccagcctgagaaagagcggcgtgggcaacatcttcatcaagaacctggacaagagcatcgacaacaaggccctgtacgacaccttcagcgccttcggcaacatcctgagctgcaagtag

SEQ ID NO: 12261 - DNA, 552 bp, Artificial Sequence
  Description of Artificial Sequence: Synthetic coding sequence
atcagacccgccgcccccagaccccccttcagcaccatgagacccgccagcagccaggtgcccagagtgatgagcacccagagagtggccaacaccagcacccagaccatgggccccagacccgccgccgccgccgccgccgccacccccgccgtgagaaccgtgccccagtacaagtacgccgccggcgtgagaaacccccagcagcacctgaacgcccagccccaggtgaccatgcagcagcccgccgtgcacgtgcagggccaggagcccctgaccgccagcatgctggccagcgcccccccccaggagcagaagcagatgctgggcgagagactgttccccctgatccaggccatgcaccccaccctggccggcaagatcaccggcatgctgctggagatcgacaacagcgagctgctgcacatgctggagagccccgagagcctgagaagcaaggtggacgaggccgtggccgtgctgcaggcccaccaggccaaggaggccgcccagaaggccgtgaacagcgccaccggcgtgcccaccgtgtag

SEQ ID NO: 12262 - DNA, 228 bp, Artificial Sequence
  Description of Artificial Sequence: Synthetic coding sequence
atgaaccccagcgcccccagctaccccatggccagcctgtacgtgggcgacctgcaccccgacgtgaccgaggccatgctgtacgagaagttcagccccgccggccccatcctgagcatcagagtgtgcagagacatgatcaccagaagaagcctgggctacgcctacgtgaacttccagcagcccgccgacgccgagagagccctggacaccatgaacttcgactag

SEQ ID NO: 12263 - DNA, 1008 bp, Artificial Sequence
  Description of Artificial Sequence: Synthetic coding sequence
atgagcaagagaaaggccccccaggagaccctgaacggcggcatcaccgacatgctgaccgagctggccaacttcgagaagaacgtgagccaggccatccacaagtacaacgcctacagaaaggccgccagcgtgatcgccaagtacccccacaagatcaagagcggcgccgaggccaagaagctgcccggcgtgggcaccaagatcgccgagaagatcgacgagttcctggccaccggcaagctgagaaagctggagaagatcagacaggacgacaccagcagcagcatcaacttcctgaccagagtgagcggcatcggccccagcgccgccagaaagttcgtggacgagggcatcaagaccctggaggacctgagaaagaacgaggacaagctgaaccaccaccagagaatcggcctgaagtacttcggcgacttcgagaagagaatccccagagaggagatgctgcagatgcaggacatcgtgctgaacgaggtgaagaaggtggacagcgagtacatcgccaccgtgtgcggcagcttcagaagaggcgccgagagcagcggcgacatggacgtgctgctgacccaccccagcttcaccagcgagagcaccaagcagcccaagctgctgcaccaggtggtggagcagctgcagaaggtgcacttcatcaccgacaccctgagcaagggcgagaccaagttcatgggcgtgtgccagctgcccagcaagaacgacgagaaggagtacccccacagaagaatcgacatcagactgatccccaaggaccagtactactgcggcgtgctgtacttcaccggcagcgacatcttcaacaagaacatgagagcccacgccctggagaagggcttcaccatcaacgagtacaccatcagacccctgggcgtgaccggcgtggccggcgagcccctgcccgtggacagcgagaaggacatcttcgactacatccagtggaagtacagagagcccaaggacagaagcgagtag

SEQ ID NO: 12264 - DNA, 720 bp, Artificial Sequence
  Description of Artificial Sequence: Synthetic coding sequence
tgaggcgacttcgagaagagaatccccagagaggagatgctgcagatgcaggacatcgtgctgaacgaggtgaagaaggtggacagcgagtacatcgccaccgtgtgcggcagcttcagaagaggcgccgagagcagcggcgacatggacgtgctgctgacccaccccagcttcaccagcgagagcaccaagcagcccaagctgctgcaccaggtggtggagcagctgcagaaggtgcacttcatcaccgacaccctgagcaagggcgagaccaagttcatgggcgtgtgccagctgcccagcaagaacgacgagaaggagtacccccacagaagaatcgacatcagactgatccccaaggaccagtactactgcggcgtgctgtacttcaccggcagcgacatcttcaacaagaacatgagagcccacgccctggagaagggcttcaccatcaacgagtacaccatcagacccctgggcgtgaccgtgctgcaggccaccagagaggacctgatgcacaacatgctgctgggcccccagctgaaggccatcaaggagctgcaggagaacccctgccagtggatcgtgaagaagaccagcctgatcaccagcagcggcaacaccggcaaccccagaaccggcgccaacgaggcctgcatcctgcccggcagacacaaccccatcggcgtgctgatctacttcctgaccttcgccatgtag

SEQ ID NO: 12265 - DNA, 843 bp, Artificial Sequence
  Description of Artificial Sequence: Synthetic coding sequence
atgagcaagagaaaggccccccaggagaccctgaacggcggcatcaccgacatgctgaccgagctggccaacttcgagaagaacgtgagccaggccatccacaagtacaacgcctacagaaaggccgccagcgtgatcgccaagtacccccacaagatcaagagcggcgccgaggccaagaagctgcccggcgtgggcaccaagatcgccgagaagatcgacgagttcctggccaccggcaagctgagaaagctggagaagatcagacaggacgacaccagcagcagcatcaacttcctgaccagagtgagcggcatcggccccagcgccgccagaaagttcgtggacgagggcatcaagaccctggagggcagccagctggacagctgccccgtgaagggccacctgaacggcaccgagagcctgctggacctgatctgggacgtgatgaccatcctgaagctgaagaacgccgacctgagaaagaacgaggacaagctgaaccaccaccagagaatcggcctgaagtacttcggcgacttcgagaagagaatccccagagaggagatgctgcagatgcaggacatcgtgctgaacgaggtgaagaaggtggacagcgagtacatcgccaccgtgtgcggcagcttcagaagaggcgccgagagcagcggcgacatggacgtgctgctgacccaccccagcttcaccagcgagagcaccaagcagcccaagctgctgcaccaggtggtggagcagctgcagaaggtgcacttcatcaccgacaccctgagcaagggcgagaccaagttcatgggcgtgtgccagctgcccagcaagaactag

SEQ ID NO: 12266 - DNA, 714 bp, Artificial Sequence
  Description of Artificial Sequence: Synthetic coding sequence
tgagagaagatcgacgagttcctggccaccggcaagctgagaaagctggagaagatcagacaggacgacaccagcagcagcatcaacttcctgaccagagtgagcggcatcggccccagcgccgccagaaagttcgtggacgagggcatcaagaccctggaggacctgagaaagaacgaggacaagctgaaccaccaccagagaatcggcctgaagtacttcggcgacttcgagaagagaatccccagagaggagatgctgcagatgcaggacatcgtgctgaacgaggtgaagaaggtggacagcgagtacatcgccaccgtgtgcggcagcttcagaagaggcgccgagagcagcggcgacatggacgtgctgctgacccaccccagcttcaccagcgagagcaccaagcagggcgtgtgccagctgcccagcaagaacgacgagaaggagtacccccacagaagaatcgacatcagactgatccccaaggaccagtactactgcggcgtgctgtacttcaccggcagcgacatcttcaacaagaacatgagagcccacgccctggagaagggcttcaccatcaacgagtacaccatcagacccctgggcgtgaccggcgtggccggcgagcccctgcccgtggacagcgagaaggacatcttcgactacatccagtggaagtacagagagcccaaggacagaagcgagtag

SEQ ID NO: 12267 - DNA, 546 bp, Artificial Sequence
  Description of Artificial Sequence: Synthetic coding sequence
atgctgcagatgcaggacatcgtgctgaacgaggtgaagaaggtggacagcgagtacatcgccaccgtgtgcggcagcttcagaagaggcgccgagagcagcggcgacatggacgtgctgctgacccaccccagcttcaccagcgagagcaccaagcagcccaagctgctgcaccaggtggtggagcagctgcagaaggtgcacttcatcaccgacaccctgagcaagggcgagaccaagttcatgggcgtgtgccagctgcccagcaagaacgacgagaaggagtacccccacagaagaatcgacatcagactgatccccaaggaccagtactactgcggcgtgctgtacttcaccggcagcgacatcttcaacaagaacatgagagcccacgccctggagaagggcttcaccatcaacgagtacaccatcagacccctgggcgtgaccggcgtggccggcgagcccctgcccgtggacagcgagaaggacatcttcgactacatccagtggaagtacagagagcccaaggacagaagcgagtag

SEQ ID NO: 12268 - DNA, 1728 bp, Artificial Sequence
  Description of Artificial Sequence: Synthetic coding sequence
atggaccccagaggcatcctgaaggccttccccaagagacagaagatccacgccgacgccagcagcaaggtgctggccaagatccccagaagagaggagggcgaggaggccgaggagtggctgagcagcctgagagcccacgtggtgagaaccggcatcggcagagccagagccgagctgttcgagaagcagatcgtgcagcacggcggccagctgtgccccgcccagggccccggcgtgacccacatcgtggtggacgagggcatggactacgagagagccctgagactgctgagactgccccagctgccccccggcgcccagctggtgaagagcgcctggctgagcctgtgcctgcaggagagaagactggtggacgtggccggcttcagcatcttcatccccagcagatacctggaccacccccagcccagcaaggccgagcaggacgccagcatcccccccggcacccacgaggccctgctgcagaccgccctgagccccccccccccccccaccagacccgtgagccccccccagaaggccaaggaggcccccaacacccaggcccagcccatcagcgacgacgaggccagcgacggcgaggagacccaggtgagcgccgccgacctggaggccctgatcagcggccactaccccaccagcctggagggcgactgcgagcccagccccgcccccgccgtgctggacaagtgggtgtgcgcccagcccagcagccagaaggccaccaaccacaacctgcacatcaccgagaagctggaggtgctggccaaggcctacagcgtgcagggcgacaagtggagagccctgggctacgccaaggccatcaacgccctgaagagcttccacaagcccgtgaccagctaccaggaggcctgcagcatccccggcatcggcaagagaatggccgagaagatcatcgagatcctggagagcggccacctgagaaagctggaccacatcagcgagagcgtgcccgtgctggagctgttcagcaacatctggggcgccggcaccaagaccgcccagatgtggtaccagcagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggagggcttcctgaccgacgacctggtgagccaggaggagaacggccagcagcagaagtacctgggcgtgtgcagactgcccggccccggcagaagacacagaagactggacatcatcgtggtgccctacagcgagttcgcctgcgccctgctgtacttcaccggcagcgcccacttcaacagaagcatgagagccctggccaagaccaagggcatgagcctgagcgagcacgccctgagcaccgccgtggtgagaaacacccacggctgcaaggtgggccccggcagagtgctgcccacccccaccgagaaggacgtgttcagactgctgggcctgccctacagagagcccgccgagagagactggtag

SEQ ID NO: 12269 - DNA, 897 bp, Artificial Sequence
  Description of Artificial Sequence: Synthetic coding sequence
atgcaccaccagaagtacctgcagagattcctgggcggcaagagagagaagaagcagaaggaggcctgcagcatccccggcatcggcaagagaatggccgagaagatcatcgagatcctggagagcggccacctgagaaagctggaccacatcagcgagagcgtgcccgtgctggagctgttcagcaacatctggggcgccggcaccaagaccgcccagatgtggtaccagcagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggagggcttcctgaccgacgacctggtgagccaggaggagaacggccagcagcagaagtacctgggcgtgtgcagactgcccggccccggcagaagacacagaagactggacatcatcgtggtgccctacagcgagttcgcctgcgccctgctgtacttcaccggcagcgcccacttcaacagaagcatgagagccctggccaagaccaagggcatgagcctgagcgagcacgccctgagcaccgccgtggtgagaaacacccacggctgcaaggtgggccccggcagagtgctgcccacccccaccgagaaggacgtgttcagactgctgggcctgccctacagagagcccgccgagagagactggtag

SEQ ID NO: 12270 - DNA, 1548 bp, Artificial Sequence
  Description of Artificial Sequence: Synthetic coding sequence
atggaccccagaggcatcctgaaggccttccccaagagacagaagatccacgccgacgccagcagcaaggtgctggccaagatccccagaagagaggagggcgaggaggccgaggagtggctgagcagcctgagagcccacgtggtgagaaccggcatcggcagagccagagccgagctgttcgagaagcagatcgtgcagcacggcggccagctgtgccccgcccagggccccggcgtgacccacatcgtggtggacgagggcatggactacgagagagccctgagactgctgagactgccccagctgccccccggcgcccagctggtgaagagcgcctggctgagcctgtgcctgcaggagagaagactggtggacgtggccggcttcagcatcttcatccccagcagatacctggaccacccccagcccagcaaggccgagcaggacgccagcatcccccccggcacccacgaggccctgctgcagaccgccctgagccccccccccccccccaccagacccgtgagccccccccagaaggccaaggaggcccccaacacccaggcccagcccatcagcgacgacgaggccagcgacggcgaggagacccaggtgagcgccgccgacctggaggccctgatcagcggccactaccccaccagcctggagggcgactgcgagcccagccccgcccccgccgtgctggacaagtgggtgtgcgcccagcccagcagccagaaggccaccaaccacaacctgcacatcaccgagaagctggaggtgctggccaaggcctacagcgtgcagggcgacaagtggagagccctgggctacgccaaggccatcaacgccctgaagagcttccacaagcccgtgaccagctaccaggaggcctgcagcatccccggcatcggcaagagaatggccgagaagatcatcgagatcctggagagcggccacctgagaaagctggaccacatcagcgagagcgtgcccgtgctggagctgttcagcaacatctggggcgccggcaccaagaccgcccagatgtggtaccagcagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggagggcttcctgaccgacgacctggtgagccaggaggagaacggccagcagcagaagtacctgggcgtgtgcagactgcccggccccggcagaagacacagaagactggacatcatcgtggtgccctacagcgagttcgcctgcgccctgcagggcggcgcctggcccagcgccgcccacagccactag

SEQ ID NO: 12271 - DNA, 903 bp, Artificial Sequence
  Description of Artificial Sequence: Synthetic coding sequence
atgctgatgcaccaccagaagtacctgcagagattcctgggcggcaagagagagaagaagcagaaggaggcctgcagcatccccggcatcggcaagagaatggccgagaagatcatcgagatcctggagagcggccacctgagaaagctggaccacatcagcgagagcgtgcccgtgctggagctgttcagcaacatctggggcgccggcaccaagaccgcccagatgtggtaccagcagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggagggcttcctgaccgacgacctggtgagccaggaggagaacggccagcagcagaagtacctgggcgtgtgcagactgcccggccccggcagaagacacagaagactggacatcatcgtggtgccctacagcgagttcgcctgcgccctgctgtacttcaccggcagcgcccacttcaacagaagcatgagagccctggccaagaccaagggcatgagcctgagcgagcacgccctgagcaccgccgtggtgagaaacacccacggctgcaaggtgggccccggcagagtgctgcccacccccaccgagaaggacgtgttcagactgctgggcctgccctacagagagcccgccgagagagactggtag

SEQ ID NO: 12272 - DNA, 1728 bp, Artificial Sequence; identical to SEQ ID NO: 12268
  Description of Artificial Sequence: Synthetic coding sequence

SEQ ID NO: 12273 - DNA, 516 bp, Artificial Sequence
  Description of Artificial Sequence: Synthetic coding sequence
atggactacgagagagccctgagactgctgagactgccccagctgccccccggcgcccagctggtgaagagcgcctggctgagcctgtgcctgcaggagagaagactggtggacgtggccggcttcagcatcttcatccccagcagccccagcctgatgatgaagcccgtgatgggcaagaagcccagactggtgcagctgatctggaagcccagcagcgtggccaccacccccccccccctgagagagatcgtgagcctggcccagcccctgctgagctggatcagcggcagcgtgcacagcccccaggccagaagaagacccatcaccaccagcatcagccagagaagctggaagttctggcccaagcccaccgtgttcagagagaccagcggcggcccctgggccatgcccagacccagcatgcccagcagagccagcatcagcctgagccccagaaccagaagacccgccgtgagcctgggcctgggcagcggctggctgagaaagagctag

SEQ ID NO: 12274 - DNA, 747 bp, Artificial Sequence
  Description of Artificial Sequence: Synthetic coding sequence
atggaggccctgtgcgtgtgcagcctgatgcccctgcactggagctggatcctgaccgccagccacctggccgccttcttccagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggagggcttcctgaccgacgacctggtgagccaggaggagaacggccagcagcagaagtacctgggcgtgtgcagactgcccggccccggcagaagacacagaagactggacatcatcgtggtgccctacagcgagttcgcctgcgccctgctgtacttcaccggcagcgcccacttcaacagaagcatgagagccctggccaagaccaagggcatgagcctgagcgagcacgccctgagcaccgccgtggtgagaaacacccacggctgcaaggtgggccccggcagagtgctgcccacccccaccgagaaggacgtgttcagactgctgggcctgccctacagagagcccgccgagagagactggtag

SEQ ID NO: 12275 - DNA, 1728 bp, Artificial Sequence; identical to SEQ ID NO: 12268
  Description of Artificial Sequence: Synthetic coding sequence

SEQ ID NO: 12276 - DNA, 1464 bp, Artificial Sequence
  Description of Artificial Sequence: Synthetic coding sequence
atggactacgagagagccctgagactgctgagactgccccagctgccccccggcgcccagctggtgaagagcgcctggctgagcctgtgcctgcaggagagaagactggtggacgtggccggcttcagcatcttcatccccagcagatacctggaccacccccagcccagcaaggccgagcaggacgccagcatcccccccggcacccacgaggccctgctgcagaccgccctgagccccccccccccccccaccagacccgtgagccccccccagaaggccaaggaggcccccaacacccaggcccagcccatcagcgacgacgaggccagcgacggcgaggagacccaggtgagcgccgccgacctggaggccctgatcagcggccactaccccaccagcctggagggcgactgcgagcccagccccgcccccgccgtgctggacaagtgggtgtgcgcccagcccagcagccagaaggccaccaaccacaacctgcacatcaccgagaagctggaggtgctggccaaggcctacagcgtgcagggcgacaagtggagagccctgggctacgccaaggccatcaacgccctgaagagcttccacaagcccgtgaccagctaccaggaggcctgcagcatccccggcatcggcaagagaatggccgagaagatcatcgagatcctggagagcggccacctgagaaagctggaccacatcagcgagagcgtgcccgtgctggagctgttcagcaacatctggggcgccggcaccaagaccgcccagatgtggtaccagcagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggagggcttcctgaccgacgacctggtgagccaggaggagaacggccagcagcagaagtacctgggcgtgtgcagactgcccggccccggcagaagacacagaagactggacatcatcgtggtgccctacagcgagttcgcctgcgccctgctgtacttcaccggcagcgcccacttcaacagaagcatgagagccctggccaagaccaagggcatgagcctgagcgagcacgccctgagcaccgccgtggtgagaaacacccacggctgcaaggtgggccccggcagagtgctgcccacccccaccgagaaggacgtgttcagactgctgggcctgccctacagagagcccgccgagagagactggtag

SEQ ID NO: 12277 - DNA, 1548 bp, Artificial Sequence; identical to SEQ ID NO: 12270
  Description of Artificial Sequence: Synthetic coding sequence

SEQ ID NO: 12278 - DNA, 810 bp, Artificial Sequence
  Description of Artificial Sequence: Synthetic coding sequence
atggaccccagaggcatcctgaaggccttccccaagagacagaagatccacgccgacgccagcagcaaggtgctggccaagatccccagaagagaggagggcgaggaggccgaggagtggctgagcagcctgagagcccacgtggtgagaaccggcatcggcagagccagagccgagctgttcgagaagcagatcgtgcagcacggcggccagctgtgccccgcccagggccccggcgtgacccacatcgtggtggacgagggcatggactacgagagagccctgagactgctgagactgccccagctgccccccggcgcccagctggtgaagagcgcctggctgagcctgtgcctgcaggagagaagactggtggacgtggccggcttcagcatcttcatccccagcagatacctggaccacccccagcccagcaaggccgagcaggacgccagcatcccccccggcacccacgaggccctgctgcagaccgccctgagccccccccccccccccaccagacccgtgagccccccccagaaggccaaggaggcccccaacacccaggcccagcccatcagcgacgacgaggccagcgacggcgaggagacccaggtgagcgccgccgacctggaggccctgatcagcggccactaccccaccagcctggagggcgactgcgagcccagccccgcccccgccgtgctggacaagtgggtgtgcgcccagcccagcagccagaaggccaccaaccacaacctgcacatcaccgagaagctggaggtgctggccaaggcctacagcgtgtag

SEQ ID NO: 12279 - DNA, 1413 bp, Artificial Sequence
  Description of Artificial Sequence: Synthetic coding sequence
atggaccccagaggcatcctgaaggccttccccaagagacagaagatccacgccgacgccagcagcaaggtgctggccaagatccccagaagagaggagggcgaggaggccgaggagtggctgagcagcctgagagcccacgtggtgagaaccggcatcggcagagccagagccgagctgttcgagaagcagatcgtgcagcacggcggccagctgtgccccgcccagggccccggcgtgacccacatcgtggtggacgagggcatggactacgagagagccctgagactgctgagactgccccagctgccccccggcgcccagctggtgaagagcgcctggctgagcctgtgcctgcaggagagaagactggtggacgtggccggcttcagcatcttcatccccagcagatacctggaccacccccagcccagcaaggccgagcaggacgccagcatcccccccggcacccacgaggccctgctgcagaccgccctgagccccccccccccccccaccagacccgtgagccccccccagaaggccaaggaggcccccaacacccaggcccagcccatcagcgacgacgaggccagcgacggcgaggagacccaggaggcctgcagcatccccggcatcggcaagagaatggccgagaagatcatcgagatcctggagagcggccacctgagaaagctggaccacatcagcgagagcgtgcccgtgctggagctgttcagcaacatctggggcgccggcaccaagaccgcccagatgtggtaccagcagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggaggccgtgcccagcgtgggccccggcttcctgaccgacgacctggtgagccaggaggagaacggccagcagcagaagtacctgggcgtgtgcagactgcccggccccggcagaagacacagaagactggacatcatcgtggtgccctacagcgagttcgcctgcgccctgctgtacttcaccggcagcgcccacttcaacagaagcatgagagccctggccaagaccaagggcatgagcctgagcgagcacgccctgagcaccgccgtggtgagaaacacccacggctgcaaggtgggccccggcagagtgctgcccacccccacctag

SEQ ID NO: 12280 - DNA, 1005 bp, Artificial Sequence
  Description of Artificial Sequence: Synthetic coding sequence
atggaccccagaggcatcctgaaggccttccccaagagacagaagatccacgccgacgccagcagcaagcccagctgcgccagcgccctgagatgcctgtgccccgagagcgacatcggcgccgacagcgcctgccccggccccgccgagtggctgagcagcctgagagcccacgtggtgagaaccggcatcggcagagccagagccgagctgttcgagaagcagatcgtgcagcacggcggccagctgtgccccgcccagggccccggcgtgacccacatcgtggtggacgagggcatggactacgagagagccctgagactgctgagactgccccagctgccccccggcgcccagctggtgaagagcgcctggctgagcctgtgcctgcaggagagaagactggtggacgtggccggcttcagcatcttcatccccagcagatacctggaccacccccagcccagcaaggccgagcaggacgccagcatcccccccggcacccacgaggccctgctgcagaccgccctgagccccccccccccccccaccagacccgtgagccccccccagaaggccaaggaggcccccaacacccaggcccagcccatcagcgacgacgaggccagcgacggcgaggagacccaggtgagcgccgccgacctggaggccctgatcagcggccactaccccaccagcctggagggcgactgcgagcccagccccgcccccgccgtgctggacaagtgggtgtgcgcccagcccagcagccagaaggccaccaaccacaacctgcacatcaccgagaagctggaggtgctggccaaggcctacagcgtgcagggcgacaagtggagagccctgggctacgccaaggccatcaacgccctgaagagcttccacaagcccgtgaccagctaccaggaggcctgcagcatccccggcatcggcaagagaatggccgagaagatcatcgagatcctggagagcggccacctgagatag

SEQ ID NO: 12281 - DNA, 657 bp, Artificial Sequence
  Description of Artificial Sequence: Synthetic coding sequence
atgcaccaccagaagtacctgcagagattcctgggcggcaagagagagaagaagcagaaggaggcctgcagcatccccggcatcggcaagagaatggccgagaagatcatcgagatcctggagagcggccacctgagaaagctggaccacatcagcgagagcgtgcccgtgctggagctgttcagcaacatctggggcgccggcaccaagaccgcccagatgtggtaccagcagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggagggcttcctgaccgacgacctggtgagccaggaggagaacggccagcagcagaagtacctgggcgtgtgcagactgcccggccccggcagaagacacagaagactggacatcatcgtggtgccctag

SEQ ID NO: 12282 - DNA, 567 bp, Artificial Sequence
  Description of Artificial Sequence: Synthetic coding sequence
atggaccccagaggcatcctgaaggccttccccaagagacagaagatccacgccgacgccagcagcaaggtgctggccaagatccccagaagagaggagggcgaggaggccgaggagtggctgagcagcctgagagcccacgtggtgagaaccggcatcggcagagccagagccgagctgttcgagaagcagatcgtgcagcacggcggccagctgtgccccgcccagggccccggcgtgacccacatcgtggtggacgagggcatggactacgagagagccctgagactgctgagactgccccagctgccccccggcgcccagctggtgaagagcgcctggctgagcctgtgcctgcaggagagaagactggtggacgtggccggcttcagcatcttcatccccagcagatacctggaccacccccagcccagcaaggccgagcaggacgccagcatcccccccggcacccacgaggccctgctgcagaccgccctgagccccccccccccccccaccagacccgtgagccccccccagaaggccaaggaggcccccaacacctag

SEQ ID NO: 12283 - DNA, 516 bp, Artificial Sequence; identical to SEQ ID NO: 12273
  Description of Artificial Sequence: Synthetic coding sequence

SEQ ID NO: 12284 - DNA, 459 bp, Artificial Sequence
  Description of Artificial Sequence: Synthetic coding sequence
atggactacgagagagccctgagactgctgagactgccccagctgccccccggcgcccagctggtgaagagcgcctggctgagcctgtgcctgcaggagagaagactggtggacgtggccggcttcagcatcttcatccccagcagccccagcctgatgatgaagcccgtgatgggcaagaagcccagactggtgcagctgatctggaagcccagcagcgtggccaccacccccccccccctgagagagatcgtgagcctggcccagcccctgctgagctggatcagcggcagcgtgcacagcccccaggccagaagaagacccatcaccaccagcatcagccagagaagctggaagttctggcccaagcccaccgtgttcagagagaccagcggcggcccctgggccatgcccagacccagcatgcccagcagagccagcatcagcctgagcccctag

SEQ ID NO: 12285 - DNA, 939 bp, Artificial Sequence
  Description of Artificial Sequence: Synthetic coding sequence
atgcaccaccagaagtacctgcagagattcctgggcggcaagagagagaagaagcagaagcccatcagcgacgacgaggccagcgacggcgaggagacccaggaggcctgcagcatccccggcatcggcaagagaatggccgagaagatcatcgagatcctggagagcggccacctgagaaagctggaccacatcagcgagagcgtgcccgtgctggagctgttcagcaacatctggggcgccggcaccaagaccgcccagatgtggtaccagcagggcttcagaagcctggaggacatcagaagccaggccagcctgaccacccagcaggccatcggcctgaagcactacagcgacttcctggagagaatgcccagagaggaggccaccgagatcgagcagaccgtgcagaaggccgcccaggccttcaacagcggcctgctgtgcgtggcctgcggcagctacagaagaggcaaggccacctgcggcgacgtggacgtgctgatcacccaccccgacggcagaagccacagaggcatcttcagcagactgctggacagcctgagacaggagggcttcctgaccgacgacctggtgagccaggaggagaacggccagcagcagaagtacctgggcgtgtgcagactgcccggccccggcagaagacacagaagactggacatcatcgtggtgccctacagcgagttcgcctgcgccctgctgtacttcaccggcagcgcccacttcaacagaagcatgagagccctggccaagaccaagggcatgagcctgagcgagcacgccctgagcaccgccgtggtgagaaacacccacggctgcaaggtgggccccggcagagtgctgcccacccccaccgagaaggacgtgttcagactgctgggcctgccctacagagagcccgccgagagagactggtag

SEQ ID NO: 12286 - DNA, 1401 bp, Artificial Sequence
  Description of Artificial Sequence: Synthetic coding sequence
atggccgaccagctgtacctggagaacatcgacgagttcgtgaccgaccagaacaagatcgtgacctacaagtggctgagctacaccctgggcgtgcacgtgaaccaggccaagcagatgctgtacgactacgtggagagaaagagaaaggagaacagcggcgcccagctgcacgtgacctacctggtgagcggcagcctgatccagaacggccacagctgccacaaggtggccgtggtgagagaggacaagctggaggccgtgaagagcaagctggccgtgaccgccagcatccacgtgtacagcatccagaaggccatgctgaaggacagcggccccctgttcaacaccgactacgacatcctgaagagcaacctgcagaactgcagcaagttcagcgccatccagtgcgccgccgccgtgcccagagcccccgccgagagcagcagcagcagcaagaagttcgagcagagccacctgcacatgagcagcgagacccaggccaacaacgagctgaccaccaacggccacggcccccccgccagcaagcaggtgagccagcagcccaagggcatcatgggcatgttcgccagcaaggccgccgccaagacccaggagaccaacaaggagaccaagaccgaggccaaggaggtgaccaacgccagcgccgccggcaacaaggcccccggcaagggcaacatgatgagcaacttcttcggcaaggccgccatgaacaagttcaaggtgaacctggacagcgagcaggccgtgaaggaggagaagatcgtggagcagcccaccgtgagcgtgaccgagcccaagctggccacccccgccggcctgaagaagagcagcaagaaggccgagcccgtgaaggtgctgcagaaggagaagaagagaggcaagagagtggccctgagcgacgacgagaccaaggagaccgagaacatgagaaagaagagaagaagaatcaagctgcccgagagcgacagcagcgaggacgaggtgttccccgacagccccggcgcctacgaggccgagagccccagccccccccccccccccagcccccccctggagcccgtgcccaagaccgagcccgagccccccagcgtgaagagcagcagcggcgagaacaagagaaagagaaagagagtgctgaagagcaagacctacctggacggcgagggctgcatcgtgaccgagaaggtgtacgagagcgagagctgcaccgacagcgaggaggagctgaacatgaagaccagcagcgtgcacagaccccccgccatgaccgtgaagaaggagcccagagaggagagaaagggccccaagaagggcaccgccgccctgggcaaggccaacagacaggtgagcatcaccggcttcttccagagaaagtag

SEQ ID NO: 12287 - DNA, 1284 bp, Artificial Sequence
  Description of Artificial Sequence: Synthetic coding sequence
atgctgtacgactacgtggagagaaagagaaaggagaacagcggcgcccagctgcacgtgacctacctggtgagcggcagcctgatccagaacggccacagctgccacaaggtggccgtggtgagagaggacaagctggaggccgtgaagagcaagctggccgtgaccgccagcatccacgtgtacagcatccagaaggccatgctgaaggacagcggccccctgttcaacaccgactacgacatcctgaagagcaacctgcagaactgcagcaagttcagcgccatccagtgcgccgccgccgtgcccagagcccccgccgagagcagcagcagcagcaagaagttcgagcagagccacctgcacatgagcagcgagacccaggccaacaacgagctgaccaccaacggccacggcccccccgccagcaagcaggtgagccagcagcccaagggcatcatgggcatgttcgccagcaaggccgccgccaagacccaggagaccaacaaggagaccaagaccgaggccaaggaggtgaccaacgccagcgccgccggcaacaaggcccccggcaagggcaacatgatgagcaacttcttcggcaaggccgccatgaacaagttcaaggtgaacctggacagcgagcaggccgtgaaggaggagaagatcgtggagcagcccaccgtgagcgtgaccgagcccaagctggccacccccgccggcctgaagaagagcagcaagaaggccgagcccgtgaaggtgctgcagaaggagaagaagagaggcaagagagtggccctgagcgacgacgagaccaaggagaccgagaacatgagaaagaagagaagaagaatcaagctgcccgagagcgacagcagcgaggacgaggtgttccccgacagccccggcgcctacgaggccgagagccccagccccccccccccccccagcccccccctggagcccgtgcccaagaccgagcccgagccccccagcgtgaagagcagcagcggcgagaacaagagaaagagaaagagagtgctgaagagcaagacctacctggacggcgagggctgcatcgtgaccgagaaggtgtacgagagcgagagctgcaccgacagcgaggaggagctgaacatgaagaccagcagcgtgcacagaccccccgccatgaccgtgaagaaggagcccagagaggagagaaagggccccaagaagggcaccgccgccctgggcaaggccaacagacaggtgagcatcaccggcttcttccagagaaagtag

SEQ ID NO: 12288 - DNA, 1083 bp, Artificial Sequence
  Description of Artificial Sequence: Synthetic coding sequence
atgctgaaggacagcggccccctgttcaacaccgactacgacatcctgaagagcaacctgcagaactgcagcaagttcagcgccatccagtgcgccgccgccgtgcccagagcccccgccgagagcagcagcagcagcaagaagttcgagcagagccacctgcacatgagcagcgagacccaggccaacaacgagctgaccaccaacggccacggcccccccgccagcaagcaggtgagccagcagcccaagggcatcatgggcatgttcgccagcaaggccgccgccaagacccaggagaccaacaaggagaccaagaccgaggccaaggaggtgaccaacgccagcgccgccggcaacaaggcccccggcaagggcaacatgatgagcaacttcttcggcaaggccgccatgaacaagttcaaggtgaacctggacagcgagcaggccgtgaaggaggagaagatcgtggagcagcccaccgtgagcgtgaccgagcccaagctggccacccccgccggcctgaagaagagcagcaagaaggccgagcccgtgaaggtgctgcagaaggagaagaagagaggcaagagagtggccctgagcgacgacgagaccaaggagaccgagaacatgagaaagaagagaagaagaatcaagctgcccgagagcgacagcagcgaggacgaggtgttccccgacagccccggcgcctacgaggccgagagccccagccccccccccccccccagcccccccctggagcccgtgcccaagaccgagcccgagccccccagcgtgaagagcagcagcggcgagaacaagagaaagagaaagagagtgctgaagagcaagacctacctggacggcgagggctgcatcgtgaccgagaaggtgtacgagagcgagagctgcaccgacagcgaggaggagctgaacatgaagaccagcagcgtgcacagaccccccgccatgaccgtgaagaaggagcccagagaggagagaaagggccccaagaagggcaccgccgccctgggcaaggccaacagacaggtgagcatcaccggcttcttccagagaaagtag

SEQ ID NO: 12289 - DNA, 804 bp, Artificial Sequence
  Description of Artificial Sequence: Synthetic coding sequence
atggccgaccagctgtacctggagaacatcgacgagttcgtgaccgaccagaacaagatcgtgacctacaagtggctgagctacaccctgggcgtgcacgtgaaccaggccaagcagatgctgtacgactacgtggagagaaagagaaaggagaacagcggcgcccagctgcacgtgacctacctggtgagcggcagcctgatccagaacggccacagctgccacaaggtggccgtggtgagagaggacaagctggaggccgtgaagagcaagctggccgtgaccgccagcatccacgtgtacagcatccagaaggccatgctgaaggacagcggccccctgttcaacaccgactacgacatcctgaagagcaacctgcagaactgcagcaagttcagcgccatccagtgcgccgccgccgtgcccagagcccccgccgagagcagcagcagcagcaagaagttcgagcagagccacctgcacatgagcagcgagacccaggccaacaacgagctgaccaccaacggccacggcccccccgccagcaagcaggtgagccagcagcccaagggcatcatgggcatgttcgccagcaaggccgccgccaagacccaggagaccaacaaggagaccaagaccgaggccaaggaggtgaccaacgccagcgccgccggcaacaaggcccccggcaagggcaacatgatgagcaacttcttcggcaaggccgccatgaacaagttcaaggtgaacctggacagcgagcaggccgtgaaggaggagaagatcaaggagaagaagagatag

SEQ ID NO: 12290 - DNA, 1566 bp, Artificial Sequence
  Description of Artificial Sequence: Synthetic coding sequence
atgggcgaggtggaggcccccggcagactgtggctggagagcccccccggcggcgccccccccatcttcctgcccagcgacggccaggccctggtgctgggcagaggccccctgacccaggtgaccgacagaaagtgcagcagaacccaggtggagctggtggccgaccccgagaccagaaccgtggccgtgaagcagctgggcgtgaaccccagcaccaccggcacccaggagctgaagcccggcctggagggcagcctgggcgtgggcgacaccctgtacctggtgaacggcctgcaccccctgaccctgagatgggaggagaccagaacccccgagagccagcccgacaccccccccggcacccccctggtgagccaggacgagaagagagacgccgagctgcccaagaagagaatgagaaagagcaaccccggctgggagaacctggagaagctgctggtgttcaccgccgccggcgtgaagccccagggcaaggtggccggcttcgacctggacggcaccctgatcaccaccagaagcggcaaggtgttccccaccggccccagcgactggagaatcctgtaccccgagatccccagaaagctgagagagctggaggccgagggctacaagctggtgatcttcaccaaccagatgagcatcggcagaggcaagctgcccgccgaggagttcaaggccaaggtggaggccgtggtggagaagctgggcgtgcccttccaggtgctggtggccacccacgccggcctgtacagaaagcccgtgaccggcatgtgggaccacctgcaggagcaggccaacgacggcacccccatcagcatcggcgacagcatcttcgtgggcgacgccgccggcagacccgccaactgggcccccggcagaaagaagaaggacttcagctgcgccgacagactgttcgccctgaacctgggcctgcccttcgccacccccgaggagttcttcctgaagtggcccgccgccggcttcgagctgcccgccttcgaccccagaaccgtgagcagaagcggccccctgtgcctgcccgagagcagagccctgctgagcgccagccccgaggtggtggtggccgtgggcttccccggcgccggcaagagcaccttcctgaagaagcacctggtgagcgccggctacgtgcacgtgaacagagacaccctgggcagctggcagagatgcgtgaccacctgcgagaccgccctgaagcagggcaagagagtggccatcgacaacaccaaccccgacgccgccagcagagccagatacgtgcagtgcgccagagccgccggcgtgccctgcagatgcttcctgttcaccgccaccctggagcaggccagacacaacaacagattcagagagatgaccgacagcagccacatccccgtgagcgacatggtgatgtacggctacagaaagcagttcgaggcccccaccctggccgagggcttcagcgccatcctggagatccccttcagactgtgggtggagcccagactgggcagactgtactgccagttcagcgagggctag

SEQ ID NO: 12291 - DNA, 699 bp, Artificial Sequence
  Description of Artificial Sequence: Synthetic coding sequence
atgctgggcgccatgttcagagccggcacccccatgccccccaacctgaacagccagggcggcggccactacttcatcgacagagacggcaaggccttcagacacatcctgaacttcctgagactgggcagactggacctgcccagaggctacggcgagaccgccctgctgagagccgaggccgacttctaccagatcagacccctgctggacgccctgagagagctggaggccagccagggcacccccgcccccaccgccgccctgctgcacgccgacgtggacgtgagccccagactggtgcacttcagcgccagaagaggcccccaccactacgagctgagcagcgtgcaggtggacaccttcagagccaacctgttctgcaccgacagcgagtgcctgggcgccctgagagccagattcggcgtggccagcggcgacagagccgagggcagcccccacttccacctggagtgggcccccagacccgtggagctgcccgaggtggagtacggcagactgggcctgcagcccctgtggaccggcggccccggcgagagaagagaggtggtgggcacccccagcttcctggaggaggtgctgagagtggccctggagcacggcttcagactggacagcgtgttccccgaccccgaggacctgctgaacagcagaagcctgagattcgtgagacactag

SEQ ID NO: 12292 - DNA, 5157 bp, Artificial Sequence
  Description of Artificial Sequence: Synthetic coding sequence
atgaaccagaacaccaccgagcccgtggccgccaccgagaccctggccgaggtgcccgagcacgtgctgagaggcctgcccgaggaggtgagactgttccccagcgccgtggacaagaccagaatcggcgtgtgggccaccaagcccatcctgaagggcaagaagttcggccccttcgtgggcgacaagaagaagagaagccaggtgaagaacaacgtgtacatgtgggaggtgtactaccccaacctgggctggatgtgcatcgacgccaccgaccccgagaagggcaactggctgagatacgtgaactgggcctgcagcggcgaggagcagaacctgttccccctggagatcaacagagccatctactacaagaccctgaagcccatcgcccccggcgaggagctgctggtgtggtacaacggcgaggacaaccccgagatcgccgccgccatcgaggaggagagagccagcgccagaagcaagagaagcagccccaagagcagaaagggcaagaagaagagccaggagaacaagaacaagggcaacaagatccaggacatccagctgaagaccagcgagcccgacttcaccagcgccaacatgagagacagcgccgagggccccaaggaggacgaggagaagcccagcgccagcgccctggagcagcccgccaccctgcaggaggtggccagccaggaggtgccccccgagctggccacccccgcccccgcctgggagccccagcccgagcccgacgagagactggaggccgccgcctgcgaggtgaacgacctgggcgaggaggaggaggaggaggaggaggaggacgaggaggaggaggaggacgacgacgacgacgagctggaggacgagggcgaggaggaggccagcatgcccaacgagaacagcgtgaaggagcccgagatcagatgcgacgagaagcccgaggacctgctggaggagcccaagaccaccagcgaggagaccctggaggactgcagcgaggtgacccccgccatgcagatccccagaaccaaggaggaggccaacggcgacgtgttcgagaccttcatgttcccctgccagcactgcgagagaaagttcaccaccaagcagggcctggagagacacatgcacatccacatcagcaccgtgaaccacgccttcaagtgcaagtactgcggcaaggccttcggcacccagatcaacagaagaagacacgagagaagacacgaggccggcctgaagagaaagcccagccagaccctgcagcccagcgaggacctggccgacggcaaggccagcggcgagaacgtggccagcaaggacgacagcagcccccccagcctgggccccgactgcctgatcatgaacagcgagaaggccagccaggacaccatcaacagcagcgtggtggaggagaacggcgaggtgaaggagctgcacccctgcaagtactgcaagaaggtgttcggcacccacaccaacatgagaagacaccagagaagagtgcacgagagacacctgatccccaagggcgtgagaagaaagggcggcctggaggagccccagccccccgccgagcaggcccaggccacccagaacgtgtacgtgcccagcaccgagcccgaggaggagggcgaggccgacgacgtgtacatcatggacatcagcagcaacatcagcgagaacctgaactactacatcgacggcaagatccagaccaacaacaacaccagcaactgcgacgtgatcgagatggagagcgccagcgccgacctgtacggcatcaactgcctgctgacccccgtgaccgtggagatcacccagaacatcaagaccacccaggtgcccgtgaccgaggacctgcccaaggagcccctgggcagcaccaacagcgaggccaagaagagaagaaccgccagcccccccgccctgcccaagatcaaggccgagaccgacagcgaccccatggtgcccagctgcagcctgagcctgcccctgagcatcagcaccaccgaggccgtgagcttccacaaggagaagagcgtgtacctgagcagcaagctgaagcagctgctgcagacccaggacaagctgacccccgccggcatcagcgccaccgagatcgccaagctgggccccgtgtgcgtgagcgcccccgccagcatgctgcccgtgaccagcagcagattcaagagaagaaccagcagcccccccagcagcccccagcacagccccgccctgagagacttcggcaagcccagcgacggcaaggccgcctggaccgacgccggcctgaccagcaagaagagcaagctggagagccacagcgacagccccgcctggagcctgagcggcagagacgagagagagaccgtgagccccccctgcttcgacgagtacaagatgagcaaggagtggaccgccagcagcgccttcagcagcgtgtgcaaccagcagcccctggacctgagcagcggcgtgaagcagaaggccgagggcaccggcaagacccccgtgcagtgggagagcgtgctggacctgagcgtgcacaagaagcactgcagcgacagcgagggcaaggagttcaaggagagccacagcgtgcagcccacctgcagcgccgtgaagaagagaaagcccaccacctgcatgctgcagaaggtgctgctgaacgagtacaacggcatcgacctgcccgtggagaaccccgccgacggcaccagaagccccagcccctgcaagagcctggaggcccagcccgaccccgacctgggccccggcagcggcttccccgcccccaccgtggagagcacccccgacgtgtgccccagcagccccgccctgcagacccccagcctgagcagcggccagctgccccccctgctgatccccaccgaccccagcagcccccccccctgcccccccgtgctgaccgtggccaccccccccccccccctgctgcccaccgtgcccctgcccgcccccagcagcagcgccagcccccacccctgccccagccccctgagcaacgccaccgcccagagccccctgcccatcctgagccccaccgtgagccccagccccagccccatcccccccgtggagcccctgatgagcgccgccagccccggcccccccaccctgagcagcagcagcagcagcagcagcagcagcagcagcttcagcagcagcagcagcagcagcagccccagccccccccccctgagcgccatcagcagcgtggtgagcagcggcgacaacctggaggccagcctgcccatgatcagcttcaagcaggaggagctggagaacgagggcctgaagcccagagaggagccccagagcgccgccgagcaggacgtggtggtgcaggagaccttcaacaagaacttcgtgtgcaacgtgtgcgagagccccttcctgagcatcaaggacctgaccaagcacctgagcatccacgccgaggagtggcccttcaagtgcgagttctgcgtgcagctgttcaaggacaagaccgacctgagcgagcacagattcctgctgcacggcgtgggcaacatcttcgtgtgcagcgtgtgcaagaaggagttcgccttcctgtgcaacctgcagcagcaccagagagacctgcaccccgacaaggtgtgcacccaccacgagttcgagagcggcaccctgagaccccagaacttcaccgaccccagcaaggcccacgtggagcacatgcagagcctgcccgaggaccccctggagaccagcaaggaggaggaggagctgaacgacagcagcgaggagctgtacaccaccatcaagatcatggccagcggcatcaagaccaaggaccccgacgtgagactgggcctgaaccagcactaccccagcttcaagcccccccccttccagtaccaccacagaaaccccatgggcatcggcgtgaccgccaccaacttcaccacccacaacatcccccagaccttcaccaccgccatcagatgcaccaagtgcggcaagggcgtggacaacatgcccgagctgcacaagcacatcctggcctgcgccagcgccagcgacaagaagagatacacccccaagaagaaccccgtgcccctgaagcagaccgtgcagcccaagaacggcgtggtggtgctggacaacagcggcaagaacgccttcagaagaatgggccagcccaagagactgaacttcagcgtggagctgagcaagatgagcagcaacaagctgaagctgaacgccctgaagaagaagaaccagctggtgcagaaggccatcctgcagaagaacaagagcgccaagcagaaggccgacctgaagaacgcctgcgagagcagcagccacatctgcccctactgcaacagagagttcacctacatcggcagcctgaacaagcacgccgccttcagctgccccaagaagcccctgagcccccccaagaagaaggtgagccacagcagcaagaagggcggccacagcagccccgccagcagcgacaagaacagcaacagcaaccacagaagaagaaccgccgacgccgagatcaagatgcagagcatgcagacccccctgggcaagaccagagccagaagcagcggccccacccaggtgcccctgcccagcagcagcttcagaagcaagcagaacgtgaagttcgccgccagcgtgaagagcaagaagcccagcagcagcagcctgagaaacagcagccccatcagaatggccaagatcacccacgtggagggcaagaagcccaaggccgtggccaagaaccacagcgcccagctgagcagcaagaccagcagaagcctgcacgtgagagtgcagaagagcaaggccgtgctgcagagcaagagcaccctggccagcaagaagagaaccgacagattcaacatcaagagcagagagagaagcggcggccccgtgaccagaagcctgcagctggccgccgccgccgacctgagcgagaacaagagagaggacggcagcgccaagcaggagctgaaggacttcagctacagcctgagactggccagcagatgcagcccccccgccgccccctacatcaccagacagtacagaaaggtgaaggcccccgccgccgcccagttccagggccccttcttcaaggagtag

SEQ ID NO: 12293 - DNA, 5049 bp, Artificial Sequence
  Description of Artificial Sequence: Synthetic coding sequence
atgaaccagaacaccaccgagcccgtggccgccaccgagaccctggccgaggtgcccgagcacgtgctgagaggcctgcccgaggaggtgagactgttccccagcgccgtggacaagaccagaatcggcgtgtgggccaccaagcccatcctgaagggcaagaagttcggccccttcgtgggcgacaagaagaagagaagccaggtgaagaacaacgtgtacatgtgggaggtgtactaccccaacctgggctggatgtgcatcgacgccaccgaccccgagaagggcaactggctgagatacgtgaactgggcctgcagcggcgaggagcagaacctgttccccctggagatcaacagagccatctactacaagaccctgaagcccatcgcccccggcgaggagctgctggtgtggtacaacggcgaggacaaccccgagatcgccgccgccatcgaggaggagagagccagcgccagaagcaagagaagcagccccaagagcagaaagggcaagaagaagagccaggagaacaagaacaagggcaacaagatccaggacatccagctgaagaccagcgagcccgacttcaccagcgccaacatgagagacagcgccgagggccccaaggaggacgaggagaagcccagcgccagcgccctggagcagcccgccaccctgcaggaggtggccagccaggaggtgccccccgagctggccacccccgcccccgcctgggagccccagcccgagcccgacgagagactggaggccgccgcctgcgaggtgaacgacctgggcgaggaggaggaggaggaggaggaggaggacgaggaggaggaggaggacgacgacgacgacgagctggaggacgagggcgaggaggaggccagcatgcccaacgagaacagcgtgaaggagcccgagatcagatgcgacgagaagcccgaggacctgctggaggagcccaagaccaccagcgaggagaccctggaggactgcagcgaggtgacccccgccatgcagatccccagaaccaaggaggaggccaacggcgacgtgttcgagaccttcatgttcccctgccagcactgcgagagaaagttcaccaccaagcagggcctggagagacacatgcacatccacatcagcaccgtgaaccacgccttcaagtgcaagtactgcggcaaggccttcggcacccagatcaacagaagaagacacgagagaagacacgaggccggcctgaagagaaagcccagccagaccctgcagcccagcgaggacctggccgacggcaaggccagcggcgagaacgtggccagcaaggacgacagcagcccccccagcctgggccccgactgcctgatcatgaacagcgagaaggccagccaggacaccatcaacagcagcgtggtggaggagaacggcgaggtgaaggagctgcacccctgcaagtactgcaagaaggtgttcggcacccacaccaacatgagaagacaccagagaagagtgcacgagagacacctgatccccaagggcgtgagaagaaagggcggcctggaggagccccagccccccgccgagcaggcccaggccacccagaacgtgtacgtgcccagcaccgagcccgaggaggagggcgaggccgacgacgtgtacatcatggacatcagcagcaacatcagcgagaacctgaactactacatcgacggcaagatccagaccaacaacaacaccagcaactgcgacgtgatcgagatggagagcgccagcgccgacctgtacggcatcaactgcctgctgacccccgtgaccgtggagatcacccagaacatcaagaccacccaggtgcccgtgaccgaggacctgcccaaggagcccctgggcagcaccaacagcgaggccaagaagagaagaaccgccagcccccccgccctgcccaagatcaaggccgagaccgacagcgaccccatggtgcccagctgcagcctgagcctgcccctgagcatcagcaccaccgaggccgtgagcttccacaaggagaagagcgtgtacctgagcagcaagctgaagcagctgctgcagacccaggacaagctgacccccgccggcatcagcgccaccgagatcgccaagctgggccccgtgtgcgtgagcgcccccgccagcatgctgcccgtgaccagcagcagattcaagagaagaaccagcagcccccccagcagcccccagcacagccccgccctgagagacttcggcaagcccagcgacggcaaggccgcctggaccgacgccggcctgaccagcaagaagagcaagctggagagccacagcgacagccccgcctggagcctgagcggcagagacgagagagagaccgtgagccccccctgcttcgacgagtacaagatgagcaaggagtggaccgccagcagcgccttcagcagcgtgtgcaaccagcagcccctggacctgagcagcggcgtgaagcagaaggccgagggcaccggcaagacccccgtgcagtgggagagcgtgctggacctgagcgtgcacaagaagcactgcagcgacagcgagggcaaggagttcaaggagagccacagcgtgcagcccacctgcagcgccgtgaagaagagaaagcccaccacctgcatgctgcagaaggtgctgctgaacgagtacaacggcatcgacctgcccgtggagaaccccgccgacggcaccagaagccccagcccctgcaagagcctggaggcccagcccgaccccgacctgggccccggcagcggcttccccgcccccaccgtggagagcacccccgacgtgtgccccagcagccccgccctgcagacccccagcctgagcagcggccagctgccccccctgctgatccccaccgaccccagcagcccccccccctgcccccccgtgctgaccgtggccaccccccccccccccctgctgcccaccgtgcccctgcccgcccccagcagcagcgccagcccccacccctgccccagccccctgagcaacgccaccgcccagagccccctgcccatcctgagccccaccgtgagccccagccccagccccatcccccccgtggagcccctgatgagcgccgccagccccggcccccccaccctgagcagcagcagcagcagcagcagcagcagcagcagcttcagcagcagcagcagcagcagcagccccagccccccccccctgagcgccatcagcagcgtggtgagcagcggcgacaacctggaggccagcctgcccatgatcagcttcaagcaggaggagctggagaacgagggcctgaagcccagagaggagccccagagcgccgccgagcaggacgtggtggtgcaggagaccttcaacaagaacttcgtgtgcaacgtgtgcgagagccccttcctgagcatcaaggacctgaccaagcacctgagcatccacgccgaggagtggcccttcaagtgcgagttctgcgtgcagctgttcaaggacaagaccgacctgagcgagcacagattcctgctgcacggcgtgggcaacatcttcgtgtgcagcgtgtgcaagaaggagttcgccttcctgtgcaacctgcagcagcaccagagagacctgcaccccgacaaggtgtgcacccaccacgagttcgagagcggcaccctgagaccccagaacttcaccgaccccagcaaggcccacgtggagcacatgcagagcctgcccgaggaccccctggagaccagcaaggaggaggaggagctgaacgacagcagcgaggagctgtacaccaccatcaagatcatggccagcggcatcaagaccaaggaccccgacgtgagactgggcctgaaccagcactaccccagcttcaagcccccccccttccagtaccaccacagaaaccccatgggcatcggcgtgaccgccaccaacttcaccacccacaacatcccccagaccttcaccaccgccatcagatgcaccaagtgcggcaagggcgtggacaacatgcccgagctgcacaagcacatcctggcctgcgccagcgccagcgacaagaagagatacacccccaagaagaaccccgtgcccctgaagcagaccgtgcagcccaagaacggcgtggtggtgctggacaacagcggcaagaacgccttcagaagaatgggccagcccaagagactgaacttcagcgtggagctgagcaagatgagcagcaacaagctgaagctgaacgccctgaagaagaagaaccagctggtgcagaaggccatcctgcagaagaacaagagcgccaagcagaaggccgacctgaagaacgcctgcgagagcagcagccacatctgcccctactgcaacagagagttcacctacatcggcagcctgaacaagcacgccgccttcagctgccccaagaagcccctgagcccccccaagaagaaggtgagccacagcagcaagaagggcggccacagcagccccgccagcagcgacaagaacagcaacagcaaccacagaagaagaaccgccgacgccgagatcaagatgcagagcatgcagacccccctgggcaagaccagagccagaagcagcggccccacccaggtgcccctgcccagcagcagcttcagaagcaagcagaacgtgaagttcgccgccagcgtgaagagcaagaagcccagcagcagcagcctgagaaacagcagccccatcagaatggccaagatcacccacgtggagggcaagaagcccaaggccgtggccaagaaccacagcgcccagctgagcagcaagaccagcagaagcctgcacgtgagagtgcagaagagcaaggccgtgctgcagagcaagagcaccctggccagcaagaagagaaccgacagattcaacatcaagagcagagagagaagcggcggccccgtgaccagaagcctgcagctggccgccgccgccgacctgagcgagaacaagagagaggacggcagcgccaagcaggagctgaaggacttcagaaacttcctgtag

SEQ ID NO: 12294 - DNA, 4446 bp, Artificial Sequence
  Description of Artificial Sequence: Synthetic coding sequence
atgagagacagcgccgagggccccaaggaggacgaggagaagcccagcgccagcgccctggagcagcccgccaccctgcaggaggtggccagccaggaggtgccccccgagctggccacccccgcccccgcctgggagccccagcccgagcccgacgagagactggaggccgccgcctgcgaggtgaacgacctgggcgaggaggaggaggaggaggaggaggaggacgaggaggaggaggaggacgacgacgacgacgagctggaggacgagggcgaggaggaggccagcatgcccaacgagaacagcgtgaaggagcccgagatcagatgcgacgagaagcccgaggacctgctggaggagcccaagaccaccagcgaggagaccctggaggactgcagcgaggtgacccccgccatgcagatccccagaaccaaggaggaggccaacggcgacgtgttcgagaccttcatgttcccctgccagcactgcgagagaaagttcaccaccaagcagggcctggagagacacatgcacatccacatcagcaccgtgaaccacgccttcaagtgcaagtactgcggcaaggccttcggcacccagatcaacagaagaagacacgagagaagacacgaggccggcctgaagagaaagcccagccagaccctgcagcccagcgaggacctggccgacggcaaggccagcggcgagaacgtggccagcaaggacgacagcagcccccccagcctgggccccgactgcctgatcatgaacagcgagaaggccagccaggacaccatcaacagcagcgtggtggaggagaacggcgaggtgaaggagctgcacccctgcaagtactgcaagaaggtgttcggcacccacaccaacatgagaagacaccagagaagagtgcacgagagacacctgatccccaagggcgtgagaagaaagggcggcctggaggagccccagccccccgccgagcaggcccaggccacccagaacgtgtacgtgcccagcaccgagcccgaggaggagggcgaggccgacgacgtgtacatcatggacatcagcagcaacatcagcgagaacctgaactactacatcgacggcaagatccagaccaacaacaacaccagcaactgcgacgtgatcgagatggagagcgccagcgccgacctgtacggcatcaactgcctgctgacccccgtgaccgtggagatcacccagaacatcaagaccacccaggtgcccgtgaccgaggacctgcccaaggagcccctgggcagcaccaacagcgaggccaagaagagaagaaccgccagcccccccgccctgcccaagatcaaggccgagaccgacagcgaccccatggtgcccagctgcagcctgagcctgcccctgagcatcagcaccaccgaggccgtgagcttccacaaggagaagagcgtgtacctgagcagcaagctgaagcagctgctgcagacccaggacaagctgacccccgccggcatcagcgccaccgagatcgccaagctgggccccgtgtgcgtgagcgcccccgccagcatgctgcccgtgaccagcagcagattcaagagaagaaccagcagcccccccagcagcccccagcacagccccgccctgagagacttcggcaagcccagcgacggcaaggccgcctggaccgacgccggcctgaccagcaagaagagcaagctggagagccacagcgacagccccgcctggagcctgagcggcagagacgagagagagaccgtgagccccccctgcttcgacgagtacaagatgagcaaggagtggaccgccagcagcgccttcagcagcgtgtgcaaccagcagcccctggacctgagcagcggcgtgaagcagaaggccgagggcaccggcaagacccccgtgcagtgggagagcgtgctggacctgagcgtgcacaagaagcactgcagcgacagcgagggcaaggagttcaaggagagccacagcgtgcagcccacctgcagcgccgtgaagaagagaaagcccaccacctgcatgctgcagaaggtgctgctgaacgagtacaacggcatcgacctgcccgtggagaaccccgccgacggcaccagaagccccagcccctgcaagagcctggaggcccagcccgaccccgacctgggccccggcagcggcttccccgcccccaccgtggagagcacccccgacgtgtgccccagcagccccgccctgcagacccccagcctgagcagcggccagctgccccccctgctgatccccaccgaccccagcagcccccccccctgcccccccgtgctgaccgtggccaccccccccccccccctgctgcccaccgtgcccctgcccgcccccagcagcagcgccagcccccacccctgccccagccccctgagcaacgccaccgcccagagccccctgcccatcctgagccccaccgtgagccccagccccagccccatcccccccgtggagcccctgatgagcgccgccagccccggcccccccaccctgagcagcagcagcagcagcagcagcagcagcagcagcttcagcagcagcagcagcagcagcagccccagccccccccccctgagcgccatcagcagcgtggtgagcagcggcgacaacctggaggccagcctgcccatgatcagcttcaagcaggaggagctggagaacgagggcctgaagcccagagaggagccccagagcgccgccgagcaggacgtggtggtgcaggagaccttcaacaagaacttcgtgtgcaacgtgtgcgagagccccttcctgagcatcaaggacctgaccaagcacctgagcatccacgccgaggagtggcccttcaagtgcgagttctgcgtgcagctgttcaaggacaagaccgacctgagcgagcacagattcctgctgcacggcgtgggcaacatcttcgtgtgcagcgtgtgcaagaaggagttcgccttcctgtgcaacctgcagcagcaccagagagacctgcaccccgacaaggtgtgcacccaccacgagttcgagagcggcaccctgagaccccagaacttcaccgaccccagcaaggcccacgtggagcacatgcagagcctgcccgaggaccccctggagaccagcaaggaggaggaggagctgaacgacagcagcgaggagctgtacaccaccatcaagatcatggccagcggcatcaagaccaaggaccccgacgtgagactgggcctgaaccagcactaccccagcttcaagcccccccccttccagtaccaccacagaaaccccatgggcatcggcgtgaccgccaccaacttcaccacccacaacatcccccagaccttcaccaccgccatcagatgcaccaagtgcggcaagggcgtggacaacatgcccgagctgcacaagcacatcctggcctgcgccagcgccagcgacaagaagagatacacccccaagaagaaccccgtgcccctgaagcagaccgtgcagcccaagaacggcgtggtggtgctggacaacagcggcaagaacgccttcagaagaatgggccagcccaagagactgaacttcagcgtggagctgagcaagatgagcagcaacaagctgaagctgaacgccctgaagaagaagaaccagctggtgcagaaggccatcctgcagaagaacaagagcgccaagcagaaggccgacctgaagaacgcctgcgagagcagcagccacatctgcccctactgcaacagagagttcacctacatcggcagcctgaacaagcacgccgccttcagctgccccaagaagcccctgagcccccccaagaagaaggtgagccacagcagcaagaagggcggccacagcagccccgccagcagcgacaagaacagcaacagcaaccacagaagaagaaccgccgacgccgagatcaagatgcagagcatgcagacccccctgggcaagaccagagccagaagcagcggccccacccaggtgcccctgcccagcagcagcttcagaagcaagcagaacgtgaagttcgccgccagcgtgaagagcaagaagcccagcagcagcagcctgagaaacagcagccccatcagaatggccaagatcacccacgtggagggcaagaagcccaaggccgtggccaagaaccacagcgcccagctgagcagcaagaccagcagaagcctgcacgtgagagtgcagaagagcaaggccgtgctgcagagcaagagcaccctggccagcaagaagagaaccgacagattcaacatcaagagcagagagagaagcggcggccccgtgaccagaagcctgcagctggccgccgccgccgacctgagcgagaacaagagagaggacggcagcgccaagcaggagctgaaggacttcagaaacttcctgtag

SEQ ID NO: 12295 - DNA, 681 bp, Artificial Sequence
  Description of Artificial Sequence: Synthetic coding sequence
atgaaccagaacaccaccgagcccgtggccgccaccgagaccctggccgaggtgcccgagcacgtgctgagaggcctgcccgaggaggtgagactgttccccagcgccgtggacaagaccagaatcggcgtgtgggccaccaagcccatcctgaagggcaagaagttcggccccttcgtgggcgacaagaagaagagaagccaggtgaagaacaacgtgtacatgtgggaggtgtactaccccaacctgggctggatgtgcatcgacgccaccgaccccgagaagggcaactggctgagatacgtgaactgggcctgcagcggcgaggagcagaacctgttccccctggagatcaacagagccatctactacaagaccctgaagcccatcgcccccggcgaggagctgctggtgtggtacaacggcgaggacaaccccgagatcgccgccgccatcgaggaggagagagccagcgccagaagcaagagaagcagccccaagagcagaaaggccaccgccagcgcctggagacccgacgccctgcaccagagacccagaaccagccccggcagcatcggcagaagcaagctgcagctgcagcccagcagcagagaccacagcagcaagagcagacacagcggctgcagcctgaccgcccccgaggtgacctggaaccagtag

SEQ ID NO: 12296 - DNA, 5049 bp, Artificial Sequence
  Description of Artificial Sequence: Synthetic coding sequence
atgaaccagaacaccaccgagcccgtggccgccaccgagaccctggccgaggtgcccgagcacgtgctgagaggcctgcccgaggaggtgagactgttccccagcgccgtggacaagaccagaatcggcgtgtgggccaccaagcccatcctgaagggcaagaagttcggccccttcgtgggcgacaagaagaagagaagccaggtgaagaacaacgtgtacatgtgggaggtgtactaccccaacctgggctggatgtgcatcgacgccaccgaccccgagaagggcaactggctgagatacgtgaactgggcctgcagcggcgaggagcagaacctgttccccctggagatcaacagagccatctactacaagaccctgaagcccatcgcccccggcgaggagctgctggtgtggtacaacggcgaggacaaccccgagatcgccgccgccatcgaggaggagagagccagcgccagaagcaagagaagcagccccaagagcagaaagggcaagaagaagagccaggagaacaagaacaagggcaacaagatccaggacatccagctgaagaccagcgagcccgacttcaccagcgccaacatgagagacagcgccgagggccccaaggaggacgaggagaagcccagcgccagcgccctggagcagcccgccaccctgcaggaggtggccagccaggaggtgccccccgagctggccacccccgcccccgcctgggagccccagcccgagcccgacgagagactggaggccgccgcctgcgaggtgaacgacctgggcgaggaggaggaggaggaggaggaggaggacgaggaggaggaggaggacgacgacgacgacgagctggaggacgagggcgaggaggaggccagcatgcccaacgagaacagcgtgaaggagcccgagatcagatgcgacgagaagcccgaggacctgctggaggagcccaagaccaccagcgaggagaccctggaggactgcagcgaggtgacccccgccatgcagatccccagaaccaaggaggaggccaacggcgacgtgttcgagaccttcatgttcccctgccagcactgcgagagaaagttcaccaccaagcagggcctggagagacacatgcacatccacatcagcaccgtgaaccacgccttcaagtgcaagtactgcggcaaggccttcggcacccagatcaacagaagaagacacgagagaagacacgaggccggcctgaagagaaagcccagccagaccctgcagcccagcgaggacctggccgacggcaaggccagcggcgagaacgtggccagcaaggacgacagcagcccccccagcctgggccccgactgcctgatcatgaacagcgagaaggccagccaggacaccatcaacagcagcgtggtggaggagaacggcgaggtgaaggagctgcacccctgcaagtactgcaagaaggtgttcggcacccacaccaacatgagaagacaccagagaagagtgcacgagagacacctgatccccaagggcgtgagaagaaagggcggcctggaggagccccagccccccgccgagcaggcccaggccacccagaacgtgtacgtgcccagcaccgagcccgaggaggagggcgaggccgacgacgtgtacatcatggacatcagcagcaacatcagcgagaacctgaactactacatcgacggcaagatccagaccaacaacaacaccagcaactgcgacgtgatcgagatggagagcgccagcgccgacctgtacggcatcaactgcctgctgacccccgtgaccgtggagatcacccagaacatcaagaccacccaggtgcccgtgaccgaggacctgcccaaggagcccctgggcagcaccaacagcgaggccaagaagagaagaaccgccagcccccccgccctgcccaagatcaaggccgagaccgacagcgaccccatggtgcccagctgcagcctgagcctgcccctgagcatcagcaccaccgaggccgtgagcttccacaaggagaagagcgtgtacctgagcagcaagctgaagcagctgctgcagacccaggacaagctgacccccgccggcatcagcgccaccgagatcgccaagctgggccccgtgtgcgtgagcgcccccgccagcatgctgcccgtgaccagcagcagattcaagagaagaaccagcagcccccccagcagcccccagcacagccccgccctgagagacttcggcaagcccagcgacggcaaggccgcctggaccgacgccggcctgaccagcaagaagagcaagctggagagccacagcgacagccccgcctggagcctgagcggcagagacgagagagagaccgtgagccccccctgcttcgacgagtacaagatgagcaaggagtggaccgccagcagcgccttcagcagcgtgtgcaaccagcagcccctggacctgagcagcggcgtgaagcagaaggccgagggcaccggcaagacccccgtgcagtgggagagcgtgctggacctgagcgtgcacaagaagcactgcagcgacagcgagggcaaggagttcaaggagagccacagcgtgcagcccacctgcagcgccgtgaagaagagaaagcccaccacctgcatgctgcagaaggtgctgctgaacgagtacaacggcatcgacctgcccgtggagaaccccgccgacggcaccagaagccccagcccctgcaagagcctggaggcccagcccgaccccgacctgggccccggcagcggcttccccgcccccaccgtggagagcacccccgacgtgtgccccagcagccccgccctgcagacccccagcctgagcagcggccagctgccccccctgctgatccccaccgaccccagcagcccccccccctgcccccccgtgctgaccgtggccaccccccccccccccctgctgcccaccgtgcccctgcccgcccccagcagcagcgccagcccccacccctgccccagccccctgagcaacgccaccgcccagagccccctgcccatcctgagccccaccgtgagccccagccccagccccatcccccccgtggagcccctgatgagcgccgccagccccggcccccccaccctgagcagcagcagcagcagcagcagcagcagcagcagcttcagcagcagcagcagcagcagcagccccagccccccccccctgagcgccatcagcagcgtggtgagcagcggcgacaacctggaggccagcctgcccatgatcagcttcaagcaggaggagctggagaacgagggcctgaagcccagagaggagccccagagcgccgccgagcaggacgtggtggtgcaggagaccttcaacaagaacttcgtgtgcaacgtgtgcgagagccccttcctgagcatcaaggacctgaccaagcacctgagcatccacgccgaggagtggcccttcaagtgcgagttctgcgtgcagctgttcaaggacaagaccgacctgagcgagcacagattcctgctgcacggcgtgggcaacatcttcgtgtgcagcgtgtgcaagaaggagttcgccttcctgtgcaacctgcagcagcaccagagagacctgcaccccgacaaggtgtgcacccaccacgagttcgagagcggcaccctgagaccccagaacttcaccgaccccagcaaggcccacgtggagcacatgcagagcctgcccgaggaccccctggagaccagcaaggaggaggaggagctgaacgacagcagcgaggagctgtacaccaccatcaagatcatggccagcggcatcaagaccaaggaccccgacgtgagactgggcctgaaccagcactaccccagcttcaagcccccccccttccagtaccaccacagaaaccccatgggcatcggcgtgaccgccaccaacttcaccacccacaacatcccccagaccttcaccaccgccatcagatgcaccaagtgcggcaagggcgtggacaacatgcccgagctgcacaagcacatcctggcctgcgccagcgccagcgacaagaagagatacacccccaagaagaaccccgtgcccctgaagcagaccgtgcagcccaagaacggcgtggtggtgctggacaacagcggcaagaacgccttcagaagaatgggccagcccaagagactgaacttcagcgtggagctgagcaagatgagcagcaacaagctgaagctgaacgccctgaagaagaagaaccagctggtgcagaaggccatcctgcagaagaacaagagcgccaagcagaaggccgacctgaagaacgcctgcgagagcagcagccacatctgcccctactgcaacagagagttcacctacatcggcagcctgaacaagcacgccgccttcagctgccccaagaagcccctgagcccccccaagaagaaggtgagccacagcagcaagaagggcggccacagcagccccgccagcagcgacaagaacagcaacagcaaccacagaagaagaaccgccgacgccgagatcaagatgcagagcatgcagacccccctgggcaagaccagagccagaagcagcggccccacccaggtgcccctgcccagcagcagcttcagaagcaagcagaacgtgaagttcgccgccagcgtgaagagcaagaagcccagcagcagcagcctgagaaacagcagccccatcagaatggccaagatcacccacgtggagggcaagaagcccaaggccgtggccaagaaccacagcgcccagctgagcagcaagaccagcagaagcctgcacgtgagagtgcagaagagcaaggccgtgctgcagagcaagagcaccctggccagcaagaagagaaccgacagattcaacatcaagagcagagagagaagcggcggccccgtgaccagaagcctgcagctggccgccgccgccgacctgagcgagaacaagagagaggacggcagcgccaagcaggagctgaaggacttcagatgcttcctgtag

SEQ ID NO: 12297 - DNA, 237 bp, Artificial Sequence
  Description of Artificial Sequence: Synthetic coding sequence
atgagagacagcgccgagggccccaaggaggacgaggagaagcccagcgccagcgccctggagcagcccgccaccctgcaggaggtggccagccaggaggtgccccccgagctggccacccccgcccccgcctgggagccccagcccgagcccgacgagagactggaggccgccgcctgcgaggtgaacgacctgggcgaggaggaggaggaggaggaggaggaggacgaggagtag

SEQ ID NO: 12298 - DNA, 4446 bp, Artificial Sequence; identical to SEQ ID NO: 12294
  Description of Artificial Sequence: Synthetic coding sequence

SEQ ID NO: 12299 - DNA, 675 bp, Artificial Sequence
  Description of Artificial Sequence: Synthetic coding sequence
atgagcagctacttcgtgaacagcaccttccccgtgaccctggccagcggccaggagagcttcctgggccagctgcccctgtacagcagcggctacgccgaccccctgagacactaccccgccccctacggccccggccccggccaggacaagggcttcgccaccagcagctactacccccccgccggcggcggctacggcagagccgccccctgcgactacggccccgcccccgccttctacagagagaaggagagcgcctgcgccctgagcggcgccgacgagcagccccccttccaccccgagcccagaaagagcgactgcgcccaggacaagagcgtgttcggcgagaccgaggagcagaagtgcagcacccccgtgtacccctggatgcagagaatgaacagctgcaacagcagcagcttcggccccagcggcagaagaggcagacagacctacaccagataccagaccctggagctggagaaggagttccactacaacagatacctgaccagaagaagaagaatcgagatcgcccacgccctgtgcctgaccgagagacagatcaagatctggttccagaacagaagaatgaagtggaagaaggagagcaagctgctgagcgccagccagctgagcgccgaggaggaggaggagaagcaggccgagtag

SEQ ID NO: 12300 - DNA, 2496 bp, Artificial Sequence
  Description of Artificial Sequence: Synthetic coding sequence
atgaccgagctgaaggccaagggccccagagccccccacgtggccggcggcccccccagccccgaggtgggcagccccctgctgtgcagacccgccgccggccccttccccggcagccagaccagcgacaccctgcccgaggtgagcgccatccccatcagcctggacggcctgctgttccccagaccctgccagggccaggaccccagcgacgagaagacccaggaccagcagagcctgagcgacgtggagggcgcctacagcagagccgaggccaccagaggcgccggcggcagcagcagcagcccccccgagaaggacagcggcctgctggacagcgtgctggacaccctgctggcccccagcggccccggccagagccagcccagcccccccgcctgcgaggtgaccagcagctggtgcctgttcggccccgagctgcccgaggacccccccgccgcccccgccacccagagagtgctgagccccctgatgagcagaagcggctgcaaggtgggcgacagcagcggcaccgccgccgcccacaaggtgctgcccagaggcctgagccccgccagacagctgctgctgcccgccagcgagagcccccactggagcggcgcccccgtgaagcccagcccccaggccgccgccgtggaggtggaggaggaggacggcagcgagagcgaggagagcgccggccccctgctgaagggcaagcccagagccctgggcggcgccgccgccggcggcggcgccgccgccgtgccccccggcgccgccgccggcggcgtggccctggtgcccaaggaggacagcagattcagcgcccccagagtggccctggtggagcaggacgcccccatggcccccggcagaagccccctggccaccaccgtgatggacttcatccacgtgcccatcctgcccctgaaccacgccctgctggccgccagaaccagacagctgctggaggacgagagctacgacggcggcgccggcgccgccagcgccttcgccccccccagaagcagcccctgcgccagcagcacccccgtggccgtgggcgacttccccgactgcgcctacccccccgacgccgagcccaaggacgacgcctaccccctgtacagcgacttccagccccccgccctgaagatcaaggaggaggaggagggcgccgaggccagcgccagaagccccagaagctacctggtggccggcgccaaccccgccgccttccccgacttccccctgggcccccccccccccctgccccccagagccacccccagcagacccggcgaggccgccgtgaccgccgcccccgccagcgccagcgtgagcagcgccagcagcagcggcagcaccctggagtgcatcctgtacaaggccgagggcgcccccccccagcagggccccttcgccccccccccctgcaaggcccccggcgccagcggctgcctgctgcccagagacggcctgcccagcaccagcgccagcgccgccgccgccggcgccgcccccgccctgtaccccgccctgggcctgaacggcctgccccagctgggctaccaggccgccgtgctgaaggagggcctgccccaggtgtaccccccctacctgaactacctgagacccgacagcgaggccagccagagcccccagtacagcttcgagagcctgccccagaagatctgcctgatctgcggcgacgaggccagcggctgccactacggcgtgctgacctgcggcagctgcaaggtgttcttcaagagagccatggagggccagcacaactacctgtgcgccggcagaaacgactgcatcgtggacaagatcagaagaaagaactgccccgcctgcagactgagaaagtgctgccaggccggcatggtgctgggcggcttcagaaacctgcacatcgacgaccagatcaccctgatccagtacagctggatgagcctgatggtgttcggcctgggctggagaagctacaagcacgtgagcggccagatgctgtacttcgcccccgacctgatcctgaacgagcagagaatgaaggagagcagcttctacagcctgtgcctgaccatgtggcagatcccccaggagttcgtgaagctgcaggtgagccaggaggagttcctgtgcatgaaggtgctgctgctgctgaacaccatccccctggagggcctgagaagccagacccagttcgaggagatgagaagcagctacatcagagagctgatcaaggccatcggcctgagacagaagggcgtggtgagcagcagccagagattctaccagctgaccaagctgctggacaacctgcacgacctggtgaagcagctgcacctgtactgcctgaacaccttcatccagagcagagccctgagcgtggagttccccgagatgatgagcgaggtgatcgccgcccagctgcccaagatcctggccggcatggtgaagcccctgctgttccacaagaagtag

SEQ ID NO: 12301 - DNA, 2802 bp, Artificial Sequence
  Description of Artificial Sequence: Synthetic coding sequence
atgaccgagctgaaggccaagggccccagagccccccacgtggccggcggcccccccagccccgaggtgggcagccccctgctgtgcagacccgccgccggccccttccccggcagccagaccagcgacaccctgcccgaggtgagcgccatccccatcagcctggacggcctgctgttccccagaccctgccagggccaggaccccagcgacgagaagacccaggaccagcagagcctgagcgacgtggagggcgcctacagcagagccgaggccaccagaggcgccggcggcagcagcagcagcccccccgagaaggacagcggcctgctggacagcgtgctggacaccctgctggcccccagcggccccggccagagccagcccagcccccccgcctgcgaggtgaccagcagctggtgcctgttcggccccgagctgcccgaggacccccccgccgcccccgccacccagagagtgctgagccccctgatgagcagaagcggctgcaaggtgggcgacagcagcggcaccgccgccgcccacaaggtgctgcccagaggcctgagccccgccagacagctgctgctgcccgccagcgagagcccccactggagcggcgcccccgtgaagcccagcccccaggccgccgccgtggaggtggaggaggaggacggcagcgagagcgaggagagcgccggccccctgctgaagggcaagcccagagccctgggcggcgccgccgccggcggcggcgccgccgccgtgccccccggcgccgccgccggcggcgtggccctggtgcccaaggaggacagcagattcagcgcccccagagtggccctggtggagcaggacgcccccatggcccccggcagaagccccctggccaccaccgtgatggacttcatccacgtgcccatcctgcccctgaaccacgccctgctggccgccagaaccagacagctgctggaggacgagagctacgacggcggcgccggcgccgccagcgccttcgccccccccagaagcagcccctgcgccagcagcacccccgtggccgtgggcgacttccccgactgcgcctacccccccgacgccgagcccaaggacgacgcctaccccctgtacagcgacttccagccccccgccctgaagatcaaggaggaggaggagggcgccgaggccagcgccagaagccccagaagctacctggtggccggcgccaaccccgccgccttccccgacttccccctgggcccccccccccccctgccccccagagccacccccagcagacccggcgaggccgccgtgaccgccgcccccgccagcgccagcgtgagcagcgccagcagcagcggcagcaccctggagtgcatcctgtacaaggccgagggcgcccccccccagcagggccccttcgccccccccccctgcaaggcccccggcgccagcggctgcctgctgcccagagacggcctgcccagcaccagcgccagcgccgccgccgccggcgccgcccccgccctgtaccccgccctgggcctgaacggcctgccccagctgggctaccaggccgccgtgctgaaggagggcctgccccaggtgtaccccccctacctgaactacctgagacccgacagcgaggccagccagagcccccagtacagcttcgagagcctgccccagaagatctgcctgatctgcggcgacgaggccagcggctgccactacggcgtgctgacctgcggcagctgcaaggtgttcttcaagagagccatggagggccagcacaactacctgtgcgccggcagaaacgactgcatcgtggacaagatcagaagaaagaactgccccgcctgcagactgagaaagtgctgccaggccggcatggtgctgggcggcagaaagttcaagaagttcaacaaggtgagagtggtgagagccctggacgccgtggccctgccccagcccgtgggcgtgcccaacgagagccaggccctgagccagagattcaccttcagccccggccaggacatccagctgatcccccccctgatcaacctgctgatgagcatcgagcccgacgtgatctacgccggccacgacaacaccaagcccgacaccagcagcagcctgctgaccagcctgaaccagctgggcgagagacagctgctgagcgtggtgaagtggagcaagagcctgcccggcttcagaaacctgcacatcgacgaccagatcaccctgatccagtacagctggatgagcctgatggtgttcggcctgggctggagaagctacaagcacgtgagcggccagatgctgtacttcgcccccgacctgatcctgaacgagcagagaatgaaggagagcagcttctacagcctgtgcctgaccatgtggcagatcccccaggagttcgtgaagctgcaggtgagccaggaggagttcctgtgcatgaaggtgctgctgctgctgaacaccatccccctggagggcctgagaagccagacccagttcgaggagatgagaagcagctacatcagagagctgatcaaggccatcggcctgagacagaagggcgtggtgagcagcagccagagattctaccagctgaccaagctgctggacaacctgcacgacctggtgaagcagctgcacctgtactgcctgaacaccttcatccagagcagagccctgagcgtggagttccccgagatgatgagcgaggtgatcgccgcccagctgcccaagatcctggccggcatggtgaagcccctgctgttccacaagaagtag

SEQ ID NO: 12302 - DNA, 2088 bp, Artificial Sequence
  Description of Artificial Sequence: Synthetic coding sequence
atgaccgagctgaaggccaagggccccagagccccccacgtggccggcggcccccccagccccgaggtgggcagccccctgctgtgcagacccgccgccggccccttccccggcagccagaccagcgacaccctgcccgaggtgagcgccatccccatcagcctggacggcctgctgttccccagaccctgccagggccaggaccccagcgacgagaagacccaggaccagcagagcctgagcgacgtggagggcgcctacagcagagccgaggccaccagaggcgccggcggcagcagcagcagcccccccgagaaggacagcggcctgctggacagcgtgctggacaccctgctggcccccagcggccccggccagagccagcccagcccccccgcctgcgaggtgaccagcagctggtgcctgttcggccccgagctgcccgaggacccccccgccgcccccgccacccagagagtgctgagccccctgatgagcagaagcggctgcaaggtgggcgacagcagcggcaccgccgccgcccacaaggtgctgcccagaggcctgagccccgccagacagctgctgctgcccgccagcgagagcccccactggagcggcgcccccgtgaagcccagcccccaggccgccgccgtggaggtggaggaggaggacggcagcgagagcgaggagagcgccggccccctgctgaagggcaagcccagagccctgggcggcgccgccgccggcggcggcgccgccgccgtgccccccggcgccgccgccggcggcgtggccctggtgcccaaggaggacagcagattcagcgcccccagagtggccctggtggagcaggacgcccccatggcccccggcagaagccccctggccaccaccgtgatggacttcatccacgtgcccatcctgcccctgaaccacgccctgctggccgccagaaccagacagctgctggaggacgagagctacgacggcggcgccggcgccgccagcgccttcgccccccccagaagcagcccctgcgccagcagcacccccgtggccgtgggcgacttccccgactgcgcctacccccccgacgccgagcccaaggacgacgcctaccccctgtacagcgacttccagccccccgccctgaagatcaaggaggaggaggagggcgccgaggccagcgccagaagccccagaagctacctggtggccggcgccaaccccgccgccttccccgacttccccctgggcccccccccccccctgccccccagagccacccccagcagacccggcgaggccgccgtgaccgccgcccccgccagcgccagcgtgagcagcgccagcagcagcggcagcaccctggagtgcatcctgtacaaggccgagggcgcccccccccagcagggccccttcgccccccccccctgcaaggcccccggcgccagcggctgcctgctgcccagagacggcctgcccagcaccagcgccagcgccgccgccgccggcgccgcccccgccctgtaccccgccctgggcctgaacggcctgccccagctgggctaccaggccgccgtgctgaaggagggcctgccccaggtgtaccccccctacctgaactacctgagacccgacagcgaggccagccagagcccccagtacagcttcgagagcctgccccagaagatctgcctgatctgcggcgacgaggccagcggctgccactacggcgtgctgacctgcggcagctgcaaggtgttcttcaagagagccatggagggccagcacaactacctgtgcgccggcagaaacgactgcatcgtggacaagatcagaagaaagaactgccccgcctgcagactgagaaagtgctgccaggccggcatggtgctgggcggcttcagaaacctgcacatcgacgaccagatcaccctgatccagtacagctggatgagcctgatggtgttcggcctgggctggagaagctacaagcacgtgagcggccagatgctgtacttcgcccccgacctgatcctgaacgacagcttcggcagagccaccaagagcaaccccgtgtag

SEQ ID NO: 12303 - DNA, 2295 bp, Artificial Sequence
  Description of Artificial Sequence: Synthetic coding sequence
atgaccgagctgaaggccaagggccccagagccccccacgtggccggcggcccccccagccccgaggtgggcagccccctgctgtgcagacccgccgccggccccttccccggcagccagaccagcgacaccctgcccgaggtgagcgccatccccatcagcctggacggcctgctgttccccagaccctgccagggccaggaccccagcgacgagaagacccaggaccagcagagcctgagcgacgtggagggcgcctacagcagagccgaggccaccagaggcgccggcggcagcagcagcagcccccccgagaaggacagcggcctgctggacagcgtgctggacaccctgctggcccccagcggccccggccagagccagcccagcccccccgcctgcgaggtgaccagcagctggtgcctgttcggccccgagctgcccgaggacccccccgccgcccccgccacccagagagtgctgagccccctgatgagcagaagcggctgcaaggtgggcgacagcagcggcaccgccgccgcccacaaggtgctgcccagaggcctgagccccgccagacagctgctgctgcccgccagcgagagcccccactggagcggcgcccccgtgaagcccagcccccaggccgccgccgtggaggtggaggaggaggacggcagcgagagcgaggagagcgccggccccctgctgaagggcaagcccagagccctgggcggcgccgccgccggcggcggcgccgccgccgtgccccccggcgccgccgccggcggcgtggccctggtgcccaaggaggacagcagattcagcgcccccagagtggccctggtggagcaggacgcccccatggcccccggcagaagccccctggccaccaccgtgatggacttcatccacgtgcccatcctgcccctgaaccacgccctgctggccgccagaaccagacagctgctggaggacgagagctacgacggcggcgccggcgccgccagcgccttcgccccccccagaagcagcccctgcgccagcagcacccccgtggccgtgggcgacttccccgactgcgcctacccccccgacgccgagcccaaggacgacgcctaccccctgtacagcgacttccagccccccgccctgaagatcaaggaggaggaggagggcgccgaggccagcgccagaagccccagaagctacctggtggccggcgccaaccccgccgccttccccgacttccccctgggcccccccccccccctgccccccagagccacccccagcagacccggcgaggccgccgtgaccgccgcccccgccagcgccagcgtgagcagcgccagcagcagcggcagcaccctggagtgcatcctgtacaaggccgagggcgcccccccccagcagggccccttcgccccccccccctgcaaggcccccggcgccagcggctgcctgctgcccagagacggcctgcccagcaccagcgccagcgccgccgccgccggcgccgcccccgccctgtaccccgccctgggcctgaacggcctgccccagctgggctaccaggccgccgtgctgaaggagggcctgccccaggtgtaccccccctacctgaactacctgagacccgacagcgaggccagccagagcccccagtacagcttcgagagcctgccccagaagatctgcctgatctgcggcgacgaggccagcggctgccactacggcgtgctgacctgcggcagctgcaaggtgttcttcaagagagccatggagggcagaaagttcaagaagttcaacaaggtgagagtggtgagagccctggacgccgtggccctgccccagcccgtgggcgtgcccaacgagagccaggccctgagccagagattcaccttcagccccggccaggacatccagctgatcccccccctgatcaacctgctgatgagcatcgagcccgacgtgatctacgccggccacgacaacaccaagcccgacaccagcagcagcctgctgaccagcctgaaccagctgggcgagagacagctgctgagcgtggtgaagtggagcaagagcctgcccggcttcagaaacctgcacatcgacgaccagatcaccctgatccagtacagctggatgagcctgatggtgttcggcctgggctggagaagctacaagcacgtgagcggccagatgctgtacttcgcccccgacctgatcctgaacgagagccacagaagcctgagcagcttcaagctggccaagaagagcagcagcgtgtag

SEQ ID NO: 12304 - DNA, 1020 bp, Artificial Sequence
  Description of Artificial Sequence: Synthetic coding sequence
atggagggccagcacaactacctgtgcgccggcagaaacgactgcatcgtggacaagatcagaagaaagaactgccccgcctgcagactgagaaagtgctgccaggccggcatggtgctgggcggcagaaagttcaagaagttcaacaaggtgagagtggtgagagccctggacgccgtggccctgccccagcccgtgggcgtgcccaacgagagccaggccctgagccagagattcaccttcagccccggccaggacatccagctgatcccccccctgatcaacctgctgatgagcatcgagcccgacgtgatctacgccggccacgacaacaccaagcccgacaccagcagcagcctgctgaccagcctgaaccagctgggcgagagacagctgctgagcgtggtgaagtggagcaagagcctgcccggcttcagaaacctgcacatcgacgaccagatcaccctgatccagtacagctggatgagcctgatggtgttcggcctgggctggagaagctacaagcacgtgagcggccagatgctgtacttcgcccccgacctgatcctgaacgagcagagaatgaaggagagcagcttctacagcctgtgcctgaccatgtggcagatcccccaggagttcgtgaagctgcaggtgagccaggaggagttcctgtgcatgaaggtgctgctgctgctgaacaccatccccctggagggcctgagaagccagacccagttcgaggagatgagaagcagctacatcagagagctgatcaaggccatcggcctgagacagaagggcgtggtgagcagcagccagagattctaccagctgaccaagctgctggacaacctgcacgacctggtgaagcagctgcacctgtactgcctgaacaccttcatccagagcagagccctgagcgtggagttccccgagatgatgagcgaggtgatcgccgcccagctgcccaagatcctggccggcatggtgaagcccctgctgttccacaagaagtag

SEQ ID NO: 12305 - DNA, 2412 bp, Artificial Sequence
  Description of Artificial Sequence: Synthetic coding sequence
atgaccgagctgaaggccaagggccccagagccccccacgtggccggcggcccccccagccccgaggtgggcagccccctgctgtgcagacccgccgccggccccttccccggcagccagaccagcgacaccctgcccgaggtgagcgccatccccatcagcctggacggcctgctgttccccagaccctgccagggccaggaccccagcgacgagaagacccaggaccagcagagcctgagcgacgtggagggcgcctacagcagagccgaggccaccagaggcgccggcggcagcagcagcagcccccccgagaaggacagcggcctgctggacagcgtgctggacaccctgctggcccccagcggccccggccagagccagcccagcccccccgcctgcgaggtgaccagcagctggtgcctgttcggccccgagctgcccgaggacccccccgccgcccccgccacccagagagtgctgagccccctgatgagcagaagcggctgcaaggtgggcgacagcagcggcaccgccgccgcccacaaggtgctgcccagaggcctgagccccgccagacagctgctgctgcccgccagcgagagcccccactggagcggcgcccccgtgaagcccagcccccaggccgccgccgtggaggtggaggaggaggacggcagcgagagcgaggagagcgccggccccctgctgaagggcaagcccagagccctgggcggcgccgccgccggcggcggcgccgccgccgtgccccccggcgccgccgccggcggcgtggccctggtgcccaaggaggacagcagattcagcgcccccagagtggccctggtggagcaggacgcccccatggcccccggcagaagccccctggccaccaccgtgatggacttcatccacgtgcccatcctgcccctgaaccacgccctgctggccgccagaaccagacagctgctggaggacgagagctacgacggcggcgccggcgccgccagcgccttcgccccccccagaagcagcccctgcgccagcagcacccccgtggccgtgggcgacttccccgactgcgcctacccccccgacgccgagcccaaggacgacgcctaccccctgtacagcgacttccagccccccgccctgaagatcaaggaggaggaggagggcgccgaggccagcgccagaagccccagaagctacctggtggccggcgccaaccccgccgccttccccgacttccccctgggcccccccccccccctgccccccagagccacccccagcagacccggcgaggccgccgtgaccgccgcccccgccagcgccagcgtgagcagcgccagcagcagcggcagcaccctggagtgcatcctgtacaaggccgagggcgcccccccccagcagggccccttcgccccccccccctgcaaggcccccggcgccagcggctgcctgctgcccagagacggcctgcccagcaccagcgccagcgccgccgccgccggcgccgcccccgccctgtaccccgccctgggcctgaacggcctgccccagctgggctaccaggccgccgtgctgaaggagggcctgccccaggtgtaccccccctacctgaactacctgagacccgacagcgaggccagccagagcccccagtacagcttcgagagcctgccccagaagatctgcctgatctgcggcgacgaggccagcggctgccactacggcgtgctgacctgcggcagctgcaaggtgttcttcaagagagccatggagggccagcacaactacctgtgcgccggcagaaacgactgcatcgtggacaagatcagaagaaagaactgccccgcctgcagactgagaaagtgctgccaggccggcatggtgctgggcggcagaaagttcaagaagttcaacaaggtgagagtggtgagagccctggacgccgtggccctgccccagcccgtgggcgtgcccaacgagagccaggccctgagccagagattcaccttcagccccggccaggacatccagctgatcccccccctgatcaacctgctgatgagcatcgagcccgacgtgatctacgccggccacgacaacaccaagcccgacaccagcagcagcctgctgaccagcctgaaccagctgggcgagagacagctgctgagcgtggtgaagtggagcaagagcctgcccggcttcagaaacctgcacatcgacgaccagatcaccctgatccagtacagctggatgagcctgatggtgttcggcctgggctggagaagctacaagcacgtgagcggccagatgctgtacttcgcccccgacctgatcctgaacgagagccacagaagcctgagcagcttcaagctggccaagaagagcagcagcgtgtag

SEQ ID NO: 12306 - DNA, 2073 bp, Artificial Sequence
  Description of Artificial Sequence: Synthetic coding sequence
atgaccgagctgaaggccaagggccccagagccccccacgtggccggcggcccccccagccccgaggtgggcagccccctgctgtgcagacccgccgccggccccttccccggcagccagaccagcgacaccctgcccgaggtgagcgccatccccatcagcctggacggcctgctgttccccagaccctgccagggccaggaccccagcgacgagaagacccaggaccagcagagcctgagcgacgtggagggcgcctacagcagagccgaggccaccagaggcgccggcggcagcagcagcagcccccccgagaaggacagcggcctgctggacagcgtgctggacaccctgctggcccccagcggccccggccagagccagcccagcccccccgcctgcgaggtgaccagcagctggtgcctgttcggccccgagctgcccgaggacccccccgccgcccccgccacccagagagtgctgagccccctgatgagcagaagcggctgcaaggtgggcgacagcagcggcaccgccgccgcccacaaggtgctgcccagaggcctgagccccgccagacagctgctgctgcccgccagcgagagcccccactggagcggcgcccccgtgaagcccagcccccaggccgccgccgtggaggtggaggaggaggacggcagcgagagcgaggagagcgccggccccctgctgaagggcaagcccagagccctgggcggcgccgccgccggcggcggcgccgccgccgtgccccccggcgccgccgccggcggcgtggccctggtgcccaaggaggacagcagattcagcgcccccagagtggccctggtggagcaggacgcccccatggcccccggcagaagccccctggccaccaccgtgatggacttcatccacgtgcccatcctgcccctgaaccacgccctgctggccgccagaaccagacagctgctggaggacgagagctacgacggcggcgccggcgccgccagcgccttcgccccccccagaagcagcccctgcgccagcagcacccccgtggccgtgggcgacttccccgactgcgcctacccccccgacgccgagcccaaggacgacgcctaccccctgtacagcgacttccagccccccgccctgaagatcaaggaggaggaggagggcgccgaggccagcgccagaagccccagaagctacctggtggccggcgccaaccccgccgccttccccgacttccccctgggcccccccccccccctgccccccagagccacccccagcagacccggcgaggccgccgtgaccgccgcccccgccagcgccagcgtgagcagcgccagcagcagcggcagcaccctggagtgcatcctgtacaaggccgagggcgcccccccccagcagggccccttcgccccccccccctgcaaggcccccggcgccagcggctgcctgctgcccagagacggcctgcccagcaccagcgccagcgccgccgccgccggcgccgcccccgccctgtaccccgccctgggcctgaacggcctgccccagctgggctaccaggccgccgtgctgaaggagggcctgccccaggtgtaccccccctacctgaactacctgagacccgacagcgaggccagccagagcccccagtacagcttcgagagcctgccccagaagatctgcctgatctgcggcgacgaggccagcggctgccactacggcgtgctgacctgcggcagctgcaaggtgttcttcaagagagccatggagggccagcacaactacctgtgcgccggcagaaacgactgcatcgtggacaagatcagaagaaagaactgccccgcctgcagactgagaaagtgctgccaggccggcatggtgctgggcggcttcagaaacctgcacatcgacgaccagatcaccctgatccagtacagctggatgagcctgatggtgttcggcctgggctggagaagctacaagcacgtgagcggccagatgctgtacttcgcccccgacctgatcctgaacgaggagagcatcgtgaccagctag

SEQ ID NO: 12307 - DNA, 1410 bp, Artificial Sequence
  Description of Artificial Sequence: Synthetic coding sequence
atggacgtggagaacgagcagatcctgaacgtgaaccccgccgaccccgacaacctgagcgacagcctgttcagcggcgacgaggagaacgccggcaccgaggagatcaagaacgagatcaacggcaactggatcagcgccagcagcatcaacgaggccagaatcaacgccaaggccaagagaagactgagaaagaacagcagcagagacagcggcagaggcgacagcgtgagcgacagcggcagcgacgccctgagaagcggcctgaccgtgcccaccagccccaagggcagactgctggacagaagaagcagaagcggcaagggcagaggcctgcccaagaagggcggcgccggcggcaagggcgtgtggggcacccccggccaggtgtacgacgtggaggaggtggacgtgaaggaccccaactacgacgacgaccaggagaactgcgtgtacgagaccgtggtgctgcccctggacgagagagccttcgagaagaccctgacccccatcatccaggagtacttcgagcacggcgacaccaacgaggtggccgagatgctgagagacctgaacctgggcgagatgaagagcggcgtgcccgtgctggccgtgagcctggccctggagggcaaggccagccacagagagatgaccagcaagctgctgagcgacctgtgcggcaccgtgatgagcaccaccgacgtggagaagagcttcgacaagctgctgaaggacctgcccgagctggccctggacacccccagagccccccagctggtgggccagttcatcgccagagccgtgggcgacggcatcctgtgcaacacctacatcgacagctacaagggcaccgtggactgcgtgcaggccagagccgccctggacaaggccaccgtgctgctgagcatgagcaagggcggcaagagaaaggacagcgtgtggggcagcggcggcggccagcagagcgtgaaccacctggtgaaggagatcgacatgctgctgaaggagtacctgctgagcggcgacatcagcgaggccgagcactgcctgaaggagctggaggtgccccacttccaccacgagctggtgtacgaggccatcatcatggtgctggagagcaccggcgagagcaccttcaagatgatcctggacctgctgaagagcctgtggaagagcagcaccatcaccgtggaccagatgaagagaggctacgagagaatctacaacgagatccccgacatcaacctggacgtgccccacagctacagcgtgctggagagattcgtggaggagtgcttccaggccggcatcatcagcaagcagctgagagacctgtgccccagcagaggcagaaagagattcgtgagcgagggcgacggcggcagactgaagcccgagagctactag

SEQ ID NO: 12308 - DNA, 1377 bp, Artificial Sequence
  Description of Artificial Sequence: Synthetic coding sequence
atgaccaagtaccccgacaacctgagcgacagcctgttcagcggcgacgaggagaacgccggcaccgaggagatcaagaacgagatcaacggcaactggatcagcgccagcagcatcaacgaggccagaatcaacgccaaggccaagagaagactgagaaagaacagcagcagagacagcggcagaggcgacagcgtgagcgacagcggcagcgacgccctgagaagcggcctgaccgtgcccaccagccccaagggcagactgctggacagaagaagcagaagcggcaagggcagaggcctgcccaagaagggcggcgccggcggcaagggcgtgtggggcacccccggccaggtgtacgacgtggaggaggtggacgtgaaggaccccaactacgacgacgaccaggagaactgcgtgtacgagaccgtggtgctgcccctggacgagagagccttcgagaagaccctgacccccatcatccaggagtacttcgagcacggcgacaccaacgaggtggccgagatgctgagagacctgaacctgggcgagatgaagagcggcgtgcccgtgctggccgtgagcctggccctggagggcaaggccagccacagagagatgaccagcaagctgctgagcgacctgtgcggcaccgtgatgagcaccaccgacgtggagaagagcttcgacaagctgctgaaggacctgcccgagctggccctggacacccccagagccccccagctggtgggccagttcatcgccagagccgtgggcgacggcatcctgtgcaacacctacatcgacagctacaagggcaccgtggactgcgtgcaggccagagccgccctggacaaggccaccgtgctgctgagcatgagcaagggcggcaagagaaaggacagcgtgtggggcagcggcggcggccagcagagcgtgaaccacctggtgaaggagatcgacatgctgctgaaggagtacctgctgagcggcgacatcagcgaggccgagcactgcctgaaggagctggaggtgccccacttccaccacgagctggtgtacgaggccatcatcatggtgctggagagcaccggcgagagcaccttcaagatgatcctggacctgctgaagagcctgtggaagagcagcaccatcaccgtggaccagatgaagagaggctacgagagaatctacaacgagatccccgacatcaacctggacgtgccccacagctacagcgtgctggagagattcgtggaggagtgcttccaggccggcatcatcagcaagcagctgagagacctgtgccccagcagaggcagaaagagattcgtgagcgagggcgacggcggcagactgaagcccgagagctactag

SEQ ID NO: 12309 - DNA, 696 bp, Artificial Sequence
  Description of Artificial Sequence: Synthetic coding sequence
atggacgtggagaacgagcagatcctgaacgtgaaccccgccgagaacgccggcaccgaggagatcaagaacgagatcaacggcaactggatcagcgccagcagcatcaacgaggccagaatcaacgccaaggccaagagaagactgagaaagaacagcagcagagacagcggcagaggcgacagcgtgagcgacagcggcagcgacgccctgagaagcggcctgaccgtgcccaccagccccaagggcagactgctggacagaagaagcagaagcggcaagggcagaggcctgcccaagaagggcggcgccggcggcaagggcgtgtggggcacccccggccaggtgtacgacgtggaggaggtggacgtgaaggaccccaactacgacgacgaccaggagaactgcgtgtacgagaccgtggtgctgcccctggacgagagagccttcgagaagaccctgacccccatcatccaggagtacttcgagcacggcgacaccaacgaggtggccgagatgctgagagacctgaacctgggcgagatgaagagcggcgtgcccgtgctggccgtgagcctggccctggagggcaaggccagccacagagagatgaccagcaagctgctgagcgacctgtgcggcaccgtgatgagcaccaccgacgtggagaagagcttcgacaagctgctgaagtag

SEQ ID NO: 12310 - DNA, 786 bp, Artificial Sequence
  Description of Artificial Sequence: Synthetic coding sequence
atgttcgaggccagactggtgcagggcagcatcctgaagaaggtgctggaggccctgaaggacctgatcaacgaggcctgctgggacatcagcagcagcggcgtgaacctgcagagcatggacagcagccacgtgagcctggtgcagctgaccctgagaagcgagggcttcgacacctacagatgcgacagaaacctggccatgggcgtgaacctgaccagcatgagcaagatcctgaagtgcgccggcaacgaggacatcatcaccctgagagccgaggacaacgccgacaccctggccctggtgttcgaggcccccaaccaggagaaggtgagcgactacgagatgaagctgatggacctggacgtggagcagctgggcatccccgagcaggagtacagctgcgtggtgaagatgcccagcggcgagttcgccagaatctgcagagacctgagccacatcggcgacgccgtggtgatcagctgcgccaaggacggcgtgaagttcagcgccagcggcgagctgggcaacggcaacatcaagctgagccagaccagcaacgtggacaaggaggaggaggccgtgaccatcgagatgaacgagcccgtgcagctgaccttcgccctgagatacctgaacttcttcaccaaggccacccccctgagcagcaccgtgaccctgagcatgagcgccgacgtgcccctggtggtggagtacaagatcgccgacatgggccacctgaagtactacctggcccccaagatcgaggacgaggagggcagctag

SEQ ID NO: 12311 - DNA, 786 bp, Artificial Sequence; identical to SEQ ID NO: 12310
  Description of Artificial Sequence: Synthetic coding sequence

SEQ ID NO: 12312 - DNA, 1140 bp, Artificial Sequence
  Description of Artificial Sequence: Synthetic coding sequence
atgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgagggccagaagctgctggacagcctggccgagacctgggacttcttcttcagcgacgtgctgcccatgctgcaggccatcttctaccccgtgcagggcaaggagcccagcgtgagacagctggccctgctgcacttcagaaacgccatcaccctgagcgtgaagctggaggacgccctggccagagcccacgccagagtgccccccgccatcgtgcagatgctgctggtgctgcagggcgtgcacgagagcagaggcgtgaccgaggactacctgagactggagaccctggtgcagaaggtggtgagcccctacctgggcacctacggcctgcacagcagcgagggccccttcacccacagctgcatcctggagaagagactgctgagaagaagcagaagcggcgacgtgctggccaagaaccccgtggtgagaagcaagagctacaacacccccctgctgaaccccgtgcaggagcacgaggccgagggcgccgccgccggcggcaccagcatcagaagacacagcgtgagcgagatgaccagctgccccgagccccagggcttcagcgacccccccggccagggccccaccggcaccttcagaagcagccccgccccccacagcggcccctgccccagcagactgtaccccaccacccagccccccgagcagggcctggaccccaccagaagcagcctgcccagaagcagccccgagaacctggtggaccagatcctggagagcgtggacagcgacagcgagggcatcttcatcgacttcggcagaggcagaggcagcggcatgagcgacctggagggcagcggcggcagacagagcgtggtgtag

SEQ ID NO: 12313 - DNA, 1167 bp, Artificial Sequence
  Description of Artificial Sequence: Synthetic coding sequence
atgagaaccctgagaagactgaagttcatgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgagggccagaagctgctggacagcctggccgagacctgggacttcttcttcagcgacgtgctgcccatgctgcaggccatcttctaccccgtgcagggcaaggagcccagcgtgagacagctggccctgctgcacttcagaaacgccatcaccctgagcgtgaagctggaggacgccctggccagagcccacgccagagtgccccccgccatcgtgcagatgctgctggtgctgcagggcgtgcacgagagcagaggcgtgaccgaggactacctgagactggagaccctggtgcagaaggtggtgagcccctacctgggcacctacggcctgcacagcagcgagggccccttcacccacagctgcatcctggagaagagactgctgagaagaagcagaagcggcgacgtgctggccaagaaccccgtggtgagaagcaagagctacaacacccccctgctgaaccccgtgcaggagcacgaggccgagggcgccgccgccggcggcaccagcatcagaagacacagcgtgagcgagatgaccagctgccccgagccccagggcttcagcgacccccccggccagggccccaccggcaccttcagaagcagccccgccccccacagcggcccctgccccagcagactgtaccccaccacccagccccccgagcagggcctggaccccaccagaagcagcctgcccagaagcagccccgagaacctggtggaccagatcctggagagcgtggacagcgacagcgagggcatcttcatcgacttcggcagaggcagaggcagcggcatgagcgacctggagggcagcggcggcagacagagcgtggtgtag

SEQ ID NO: 12314 - DNA, 804 bp, Artificial Sequence
  Description of Artificial Sequence: Synthetic coding sequence
atgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgagggccagaagctgctggacagcctggccgagacctgggacttcttcttcagcgacgtgctgcccatgctgcaggccatcttctaccccgtgcagggcaaggagcccagcgtgagacagctggccctgctgcacttcagaaacgccatcaccctgagcgtgaagctggaggacgccctggccagagcccacgccagagtgccccccgccatcgtgcagatgctgctggtgctgcagggcgtgcacgagagcagaggcgtgaccgaggactacctgagactggagaccctggtgcagaaggtggtgagcccctacctgggcacctacggcctgcacagcagcgagggccccttcacccacagctgcatcctggagaagagactgctgagaagaagcagaagcggcgacgtgctggccaagaaccccgtggtgagaagcaagagctacaacacccccctgctgaaccccgtgcaggagcacgaggccgagggcgccgccgccggcggcacctag

SEQ ID NO: 12315 - DNA, 681 bp, Artificial Sequence
  Description of Artificial Sequence: Synthetic coding sequence
atgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgagggccagaagctgctggacagcctggccgagacctgggacttcttcttcagcgacgtgctgcccatgctgcaggccatcttctaccccgtgcagggcaaggagcccagcgtgagacagctggccctgctgcacttcagaaacgccatcaccctgagcgtgaagctggaggacgccctggccagagcccacgccagagtgccccccgccatcgtgcagatgctgctggtgctgcagggcgtgcacgagagcagaggcgtgaccgaggactacctgagactggagaccctggtgcagaaggtggtgagcccctacctgggcacctacggcctgcacagcagcgagggccccttcacccacagctgcatcctggagaagagactgctgtag

SEQ ID NO: 12316 - DNA, 1236 bp, Artificial Sequence
  Description of Artificial Sequence: Synthetic coding sequence
atggtgtgcctggagctgagccagagagaggcctggggcagcggcagccccgagaagatgcccgcccagcccgagggcctgtacagactgaagttcatgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgagggccagaagctgctggacagcctggccgagacctgggacttcttcttcagcgacgtgctgcccatgctgcaggccatcttctaccccgtgcagggcaaggagcccagcgtgagacagctggccctgctgcacttcagaaacgccatcaccctgagcgtgaagctggaggacgccctggccagagcccacgccagagtgccccccgccatcgtgcagatgctgctggtgctgcagggcgtgcacgagagcagaggcgtgaccgaggactacctgagactggagaccctggtgcagaaggtggtgagcccctacctgggcacctacggcctgcacagcagcgagggccccttcacccacagctgcatcctggagaagagactgctgagaagaagcagaagcggcgacgtgctggccaagaaccccgtggtgagaagcaagagctacaacacccccctgctgaaccccgtgcaggagcacgaggccgagggcgccgccgccggcggcaccagcatcagaagacacagcgtgagcgagatgaccagctgccccgagccccagggcttcagcgacccccccggccagggccccaccggcaccttcagaagcagccccgccccccacagcggcccctgccccagcagactgtaccccaccacccagccccccgagcagggcctggaccccaccagaagcagcctgcccagaagcagccccgagaacctggtggaccagatcctggagagcgtggacagcgacagcgagggcatcttcatcgacttcggcagaggcagaggcagcggcatgagcgacctggagggcagcggcggcagacagagcgtggtgtag

SEQ ID NO: 12317 - DNA, 2649 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctgcccgaggaggccgagagagtgaaggcccaggtgcaggccctgggcctggccgaggcccagcccatggccgtggtgcagagcgtgcccggcgcccaccccgtgcccgtgtacgccttcagcatcaagggccccagctacggcgaggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccgaggagagagtggtggtgatcagcagcagcgaggacagcgacgccgagaacagcagcagcagagagctggacgacagcagcagcgagagcagcgacctgcagctggagggccccagcaccctgagagtgctggacgagaacctggccgacccccaggccgaggacagacccctggtgttcttcgacctgaagatcgacaacgagacccagaagatcagccagctggccgccgtgaacagagagagcaagttcagagtggtgatccagcccgaggccttcttcagcatctacagcaaggccgtgagcctggaggtgggcctgcagcacttcctgagcttcctgagcagcatgagaagacccatcctggcctgctacaagctgtggggccccggcctgcccaacttcttcagagccctggaggacatcaacagactgtgggagttccaggaggccatcagcggcttcctggccgccctgcccctgatcagagagagagtgcccggcgccagcagcttcaagctgaagaacctggcccagacctacctggccagaaacatgagcgagagaagcgccatggccgccgtgctggccatgagagacctgtgcagactgctggaggtgagccccggcccccagctggcccagcacgtgtaccccttcagcagcctgcagtgcttcgccagcctgcagcccctggtgcaggccgccgtgctgcccagagccgaggccagactgctggccctgcacaacgtgagcttcatggagctgctgagcgcccacagaagagacagacagggcggcctgaagaagtacagcagatacctgagcctgcagaccaccaccctgccccccgcccagcccgccttcaacctgcaggccctgggcacctacttcgagggcctgctggagggccccgccctggccagagccgagggcgtgagcacccccctggccggcagaggcctggccgagagagccagccagcagagctag

SEQ ID NO: 12318 - DNA, 2490 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctgcccgaggaggccgagagagtgaaggcccaggtgcaggccctgggcctggccgaggcccagcccatggccgtggtgcagagcgtgcccggcgcccaccccgtgcccgtgtacgccttcagcatcaagggccccagctacggcgaggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccgaggagagagtggtggtgatcagcagcagcgaggacagcgacgccgagaacagctgcatggagcccatggagaccgccgagccccagagcagccccgcccacagcagccccgcccacagcagccccgcccacagcagccccgtgcagagcctgctgagagcccagggcgccagcagcctgccctgcggcacctaccacccccccgcctggcccccccaccagcccgccgagcaggccgccacccccgacgccgagccccacagcgagccccccgaccaccaggagagacccgccgtgcacagaggcatcagatacctgctgtacagagcccagagagccatcagactgagacacgccctgagactgcacccccagctgcacagagcccccatcagaacctggagcccccacgtggtgcaggccagcacccccgccatcaccggccccctgaaccaccccgccaacgcccaggagcaccccgcccagctgcagagaggcatcagccccccccacagaatcagaggcgccgtgagaagcagaagcagaagcctgagaggcagcagccacctgagccagtggctgaacaacttcttcgccctgcccttcagcagcatggccagccagctggacatgagcagcgtggtgggcgccggcgagagcagagcccagaccctgggcgccggcgtgccccccggcgacagcgtgagaggcagcatggaggccagccaggtgcaggtgcccctggaggccagccccatcaccttcccccccccctgcgcccccgagagaccccccatcagccccgtgcccggcgccagacaggccggcctgtag

SEQ ID NO: 12319 - DNA, 2346 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccgaggagagagtggtggtgatcagcagcagcgaggacagcgacgccgagaacagctgcatggagcccatggagaccgccgagccccagagcagccccgcccacagcagccccgcccacagcagccccgcccacagcagccccgtgcagagcctgctgagagcccagggcgccagcagcctgccctgcggcacctaccacccccccgcctggcccccccaccagcccgccgagcaggccgccacccccgacgccgagccccacagcgagccccccgaccaccaggagagacccgccgtgcacagaggcatcagatacctgctgtacagagcccagagagccatcagactgagacacgccctgagactgcacccccagctgcacagagcccccatcagaacctggagcccccacgtggtgcaggccagcacccccgccatcaccggccccctgaaccaccccgccaacgcccaggagcaccccgcccagctgcagagaggcatcagccccccccacagaatcagaggcgccgtgagaagcagaagcagaagcctgagaggcagcagccacctgagccagtggctgaacaacttcttcgccctgcccttcagcagcatggccagccagctggacatgagcagcgtggtgggcgccggcgagagcagagcccagaccctgggcgccggcgtgccccccggcgacagcgtgagaggcagcatggaggccagccaggtgcaggtgcccctggaggccagccccatcaccttcccccccccctgcgcccccgagagaccccccatcagccccgtgcccggcgccagacaggccggcctgtag

SEQ ID NO: 12320 - DNA, 1272 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctgagaaacgccctgtggtag

SEQ ID NO: 12321 - DNA, 1308 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctgctgcccccccccgcccacgccctgaccggccccgcccagagcagcacccactag

SEQ ID NO: 12322 - DNA, 1902 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctgcccgaggaggccgagagagtgaaggcccaggtgcaggccctgggcctggccgaggcccagcccatggccgtggtgcagagcgtgcccggcgcccaccccgtgcccgtgtacgccttcagcatcaagggccccagctacggcgaggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccgaggagagagtggtggtgatcagcagcagcgaggacagcgacgccgagaacagcagcagcagagagctggacgacagcagcagcgagagcagcgacctgcagctggagggccccagcaccctgagagtgctggacgagaacctggccgacccccaggccgaggacagacccctggtgttcttcgacctgaagatcgacaacgagagcggcttcagctggggctacccccaccccttcctgatctag

SEQ ID NO: 12323 - DNA, 1332 bp, Artificial Sequence
  Description of Artificial Sequence: Synthetic coding sequence
atggccgtggtgcagagcgtgcccggcgcccaccccgtgcccgtgtacgccttcagcatcaagggccccagctacggcgaggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccgaggagagagtggtggtgatcagcagcagcgaggacagcgacgccgagaacagcagcagcagagagctggacgacagcagcagcgagagcagcgacctgcagctggagggccccagcaccctgagagtgctggacgagaacctggccgacccccaggccgaggacagacccctggtgttcttcgacctgaagatcgacaacgagacccagaagatcagccagctggccgccgtgaacagagagagcaagttcagagtggtgatccagcccgaggccttcttcagcatctacagcaaggccgtgagcctggaggtgggcctgcagcacttcctgagcttcctgagcagcatgagaagacccatcctggcctgctacaagctgtggggccccggcctgcccaacttcttcagagccctggaggacatcaacagactgtgggagttccaggaggccatcagcggcttcctggccgccctgcccctgatcagagagagagtgcccggcgccagcagcttcaagctgaagaacctggcccagacctacctggccagaaacatgagcgagagaagcgccatggccgccgtgctggccatgagagacctgtgcagactgctggaggtgagccccggcccccagctggcccagcacgtgtaccccttcagcagcctgcagtgcttcgccagcctgcagcccctggtgcaggccgccgtgctgcccagagccgaggccagactgctggccctgcacaacgtgagcttcatggagctgctgagcgcccacagaagagacagacagggcggcctgaagaagtacagcagatacctgagcctgcagaccaccaccctgccccccgcccagcccgccttcaacctgcaggccctgggcacctacttcgagggcctgctggagggccccgccctggccagagccgagggcgtgagcacccccctggccggcagaggcctggccgagagagccagccagcagagctag

SEQ ID NO: 12324 - DNA, 2598 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctgcccgaggaggccgagagagtgaaggcccaggtgcaggccctgggcctggccgaggcccagcccatggccgtggtgcagagcgtgcccggcgcccaccccgtgcccgtgtacgccttcagcatcaagggccccagctacggcgaggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccgaggagagagtggtggtgatcagcagcagcgaggacagcgacgccgagaacagcagcagcagagagctggacgacagcagcagcgagagcagcgacctgcagctggagggccccagcaccctgagagtgctggacgagaacctggccgacccccaggccgaggacagacccctggtgttcttcgacctgaagatcgacaacgagacccagaagatcagccagctggccgccgtgaacagagagagcaagttcagagtggtgatccagcccgaggccttcttcagcttcctgagcagcatgagaagacccatcctggcctgctacaagctgtggggccccggcctgcccaacttcttcagagccctggaggacatcaacagactgtgggagttccaggaggccatcagcggcttcctggccgccctgcccctgatcagagagagagtgcccggcgccagcagcttcaagctgaagaacctggcccagacctacctggccagaaacatgagcgagagaagcgccatggccgccgtgctggccatgagagacctgtgcagactgctggaggtgagccccggcccccagctggcccagcacgtgtaccccttcagcagcctgcagtgcttcgccagcctgcagcccctggtgcaggccgccgtgctgcccagagccgaggccagactgctggccctgcacaacgtgagcttcatggagctgctgagcgcccacagaagagacagacagggcggcctgaagaagtacagcagatacctgagcctgcagaccaccaccctgccccccgcccagcccgccttcaacctgcaggccctgggcacctacttcgagggcctgctggagggccccgccctggccagagccgagggcgtgagcacccccctggccggcagaggcctggccgagagagccagccagcagagctag

SEQ ID NO: 12325 - DNA, 1836 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctgcccgaggaggccgagagagtgaaggcccaggtgcaggccctgggcctggccgaggcccagcccatggccgtggtgcagagcgtgcccggcgcccaccccgtgcccgtgtacgccttcagcatcaagggccccagctacggcgaggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccgaggagagagtggtggtgatcagcagcagcgaggacagcgacgccgagaacagcgtgagcggccccgaggtgcagcccagaacccccgccagcccccacttcagaagccagggcgcccagccccagcaggtgaccctgagactggccctgagactgggcaacttccccgtgagacactag

SEQ ID NO: 12326 - DNA, 1683 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctgcccgaggaggccgagagagtgaaggcccaggtgcaggccctgggcctggccgaggcccagcccatggccgtggtgcagagcgtgcccggcgcccaccccgtgcccgtgtacgccttcagcatcaagggccccagctacggcgaggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccggcagagagagaaacgccctgtggtag

SEQ ID NO: 12327 - DNA, 1758 bp, Artificial Sequence
  Description of Artificial Sequence: Synthetic coding sequence
atggagcccgcccccgccagaagccccagaccccagcaggaccccgccagaccccaggagcccaccatgcccccccccgagacccccagcgagggcagacagcccagccccagccccagccccaccgagagagcccccgccagcgaggaggagttccagttcctgagatgccagcagtgccaggccgaggccaagtgccccaagctgctgccctgcctgcacaccctgtgcagcggctgcctggaggccagcggcatgcagtgccccatctgccaggccccctggcccctgggcgccgacacccccgccctggacaacgtgttcttcgagagcctgcagagaagactgagcgtgtacagacagatcgtggacgcccaggccgtgtgcaccagatgcaaggagagcgccgacttctggtgcttcgagtgcgagcagctgctgtgcgccaagtgcttcgaggcccaccagtggttcctgaagcacgaggccagacccctggccgagctgagaaaccagagcgtgagagagttcctggacggcaccagaaagaccaacaacatcttctgcagcaaccccaaccacagaacccccaccctgaccagcatctactgcagaggctgcagcaagcccctgtgctgcagctgcgccctgctggacagcagccacagcgagctgaagtgcgacatcagcgccgagatccagcagagacaggaggagctggacgccatgacccaggccctgcaggagcaggacagcgccttcggcgccgtgcacgcccagatgcacgccgccgtgggccagctgggcagagccagagccgagaccgaggagctgatcagagagagagtgagacaggtggtggcccacgtgagagcccaggagagagagctgctggaggccgtggacgccagataccagagagactacgaggagatggccagcagactgggcagactggacgccgtgctgcagagaatcagaaccggcagcgccctggtgcagagaatgaagtgctacgccagcgaccaggaggtgctggacatgcacggcttcctgagacaggccctgtgcagactgagacaggaggagccccagagcctgcaggccgccgtgagaaccgacggcttcgacgagttcaaggtgagactgcaggacctgagcagctgcatcacccagggcaaggacgccgccgtgagcaagaaggccagccccgaggccgccagcacccccagagaccccatcgacgtggacctggacgtgagcaacaccaccaccgcccagaagagaaagtgcagccagacccagtgccccagaaaggtgatcaagatggagagcgaggagggcaaggaggccagactggccagaagcagccccgagcagcccagacccagcaccagcaaggccgtgagccccccccacctggacggcccccccagccccagaagccccgtgatcggcagcgaggtgttcctgcccaacagcaaccacgtggccagcggcgccggcgaggccgaggagagagtggtggtgatcagcagcagcgaggacagcgacgccgagaacagcagcagcagagagctggacgacagcagcagcgagagcagcgacctgcagctggagggccccagcaccctgagagtgctggacgagaacctggccgacccccaggccgaggacagacccctggtgttcttcgacctgaagatcgacaacgagagcggcttcagctggggctacccccaccccttcctgatctag

SEQ ID NO: 12328 - DNA, 483 bp, Artificial Sequence
  Description of Artificial Sequence: Synthetic coding sequence
atgcagcccgccagcgccaagtggtacgacagaagagactacgtgttcatcgagttctgcgtggaggacagcaaggacgtgaacgtgaacttcgagaagagcaagctgaccttcagctgcctgggcggcagcgacaacttcaagcacctgaacgagatcgacctgttccactgcatcgaccccaacgacagcaagcacaagagaaccgacagaagcatcctgtgctgcctgagaaagggcgagagcggccagagctggcccagactgaccaaggagagagccaagctgaactggctgagcgtggacttcaacaactggaaggactgggaggacgacagcgacgaggacatgagcaacttcgacagattcagcgagatgatgaacaacatgggcggcgacgaggacgtggacctgcccgaggtggacggcgccgacgacgacagccaggacagcgacgacgagaagatgcccgacctggagtag

SEQ ID NO: 12329 - DNA, 3141 bp, Artificial Sequence
  Description of Artificial Sequence: Synthetic coding sequence
atgcagaagcccagcggcctgaagccccccggcagaggcggcaagcacagcagccccatgggcagaaccagcaccggcagcgccagcagcagcgccgccgtggccgccagcagcaaggagggcagccccctgcacaagcagagcagcggccccagcagcagccccgccgccgccgccgcccccgagaagcccggccccaaggccgccgaggtgggcgacgacttcctgggcgacttcgtggtgggcgagagagtgtgggtgaacggcgtgaagcccggcgtggtgcagtacctgggcgagacccagttcgcccccggccagtgggccggcgtggtgctggacgaccccgtgggcaagaacgacggcgccgtgggcggcgtgagatacttcgagtgccccgccctgcagggcatcttcaccagacccagcaagctgaccagacagcccaccgccgagggcagcggcagcgacgcccacagcgtggagagcctgaccgcccagaacctgagcctgcacagcggcaccgccaccccccccctgaccagcagagtgatccccctgagagagagcgtgctgaacagcagcgtgaagaccggcaacgagagcggcagcaacctgagcgacagcggcagcgtgaagagaggcgagaaggacctgagactgggcgacagagtgctggtgggcggcaccaagaccggcgtggtgagatacgtgggcgagaccgacttcgccaagggcgagtggtgcggcgtggagctggacgagcccctgggcaagaacgacggcgccgtggccggcaccagatacttccagtgcccccccaagttcggcctgttcgcccccatccacaaggtgatcagaatcggcttccccagcaccagccccgccaaggccaagaagaccaagagaatggccatgggcgtgagcgccctgacccacagccccagcagcagcagcatcagcagcgtgagcagcgtggccagcagcgtgggcggcagacccagcagaagcggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacatctgcgaggtggagaaggagatcgccctgctgaaggcccagcacgagcagtacgtggccgaggccgaggagaagctgcagagagccagactgctggtggagagcgtgagaaaggagaaggtggacctgagcaaccagctggaggaggagagaagaaaggtggaggacctgcagttcagagtggaggaggagagcatcaccaagggcgacctggagacccagacccagctggagcacgccagaatcggcgagctggagcagagcctgctgctggagaaggcccaggccgagagactgctgagagagctggccgacaacagactgaccaccgtggccgagaagagcagagtgctgcagctggaggaggagctgaccctgagaagaggcgagatcgaggagctgcagcagtgcctgctgcacagcggcccccccccccccgaccaccccgacgccgccgagatcctgagactgagagagagactgctgagcgccagcaaggagcaccagagagagagcggcgtgctgagagacaagtacgagaaggccctgaaggcctaccaggccgaggtggacaagctgagagccgccaacgagaagtacgcccaggaggtggccggcctgaaggacaaggtgcagcaggccaccagcgagaacatgggcctgatggacaactggaagagcaagctggacagcctggccagcgaccaccagaagagcctggaggacctgaaggccaccctgaacagcggccccggcgcccagcagaaggagatcggcgagctgaaggccgtgatggagggcatcaagatggagcaccagctggagctgggcaacctgcaggccaagcacgacctggagaccgccatgcacgtgaaggagaaggaggccctgagagagaagctgcaggaggcccaggaggagctggccggcctgcagagacactggagagcccagctggaggtgcaggccagccagcacagactggagctgcaggaggcccaggaccagagaagagacgccgagctgagagtgcacgagctggagaagctggacgtggagtacagaggccaggcccaggccatcgagttcctgaaggagcagatcagcctggccgagaagaagatgctggactacgagagactgcagagagccgaggcccagggcaagcaggaggtggagagcctgagagagaagctgctggtggccgagaacagactgcaggccgtggaggccctgtgcagcagccagcacacccacatgatcgagagcaacgacatcagcgaggagaccatcagaaccaaggagaccgtggagggcctgcaggacaagctgaacaagagagacaaggaggtgaccgccctgaccagccagaccgagatgctgagagcccaggtgagcgccctggagagcaagtgcaagagcggcgagaagaaggtggacgccctgctgaaggagaagagaagactggaggccgagctggagaccgtgagcagaaagacccacgacgccagcggccagctggtgctgatcagccaggagctgctgagaaaggagagaagcctgaacgagctgagagtgctgctgctggaggccaacagacacagccccggccccgagagagacctgagcagagaggtgcacaaggccgagtggagaatcaaggagcagaagctgaaggacgacatcagaggcctgagagagaagctgaccggcctggacaaggagaagagcctgagcgaccagagaagatacagcctgatcgacagaagcagcgcccccgagctgctgagactgcagcaccagctgatgagcaccgaggacgccctgagagacgccctggaccaggcccagcaggtggagaagctgatggaggccatgagaagctgccccgacaaggcccagaccatcggcaacagcggcagcgccaacggcatccaccagcaggacaaggcccagaagcaggaggacaagcactag

SEQ ID NO: 12330 - DNA, 1800 bp, Artificial Sequence
  Description of Artificial Sequence: Synthetic coding sequence
atgagcagaagcctgctgctgtggttcctgctgttcctgctgctgctgccccccctgcccgtgctgctggccgaccccggcgcccccacccccgtgaacccctgctgctactacccctgccagcaccagggcatctgcgtgagattcggcctggacagataccagtgcgactgcaccagaaccggctacagcggccccaactgcaccatccccggcctgtggacctggctgagaaacagcctgagacccagccccagcttcacccacttcctgctgacccacggcagatggttctgggagttcgtgaacgccaccttcatcagagagatgctgatgagactggtgctgaccgtgagaagcaacctgatccccagcccccccacctacaacagcgcccacgactacatcagctgggagagcttcagcaacgtgagctactacaccagaatcctgcccagcgtgcccaaggactgccccacccccatgggcaccaagggcaagaagcagctgcccgacgcccagctgctggccagaagattcctgctgagaagaaagttcatccccgacccccagggcaccaacctgatgttcgccttcttcgcccagcacttcacccaccagttcttcaagaccagcggcaagatgggccccggcttcaccaaggccctgggccacggcgtggacctgggccacatctacggcgacaacctggagagacagtaccagctgagactgttcaaggacggcaagctgaagtaccaggtgctggacggcgagatgtacccccccagcgtggaggaggcccccgtgctgatgcactaccccagaggcatccccccccagagccagatggccgtgggccaggaggtgttcggcctgctgcccggcctgatgctgtacgccaccctgtggctgagagagcacaacagagtgtgcgacctgctgaaggccgagcaccccacctggggcgacgagcagctgttccagaccaccagactgatcctgatcggcgagaccatcaagatcgtgatcgaggagtacgtgcagcagctgagcggctacttcctgcagctgaagttcgaccccgagctgctgttcggcgtgcagttccagtacagaaacagaatcgccatggagttcaaccacctgtaccactggcaccccctgatgcccgacagcttcaaggtgggcagccaggagtacagctacgagcagttcctgttcaacaccagcatgctggtggactacggcgtggaggccctggtggacgccttcagcagacagatcgccggcagaatcggcggcggcagaaacatggaccaccacatcctgcacgtggccgtggacgtgatcagagagagcagagagatgagactgcagcccttcaacgagtacagaaagagattcggcatgaagccctacaccagcttccaggagctggtgggcgagaaggagatggccgccgagctggaggagctgtacggcgacatcgacgccctggagttctaccccggcctgctgctggagaagtgccaccccaacagcatcttcggcgagagcatgatcgagatcggcgcccccttcagcctgaagggcctgctgggcaaccccatctgcagccccgagtactggaagcccagcaccttcggcggcgaggtgggcttcaacatcgtgaagaccgccaccctgaagaagctggtgtgcctgaacaccaagacctgcccctacgtgagcttcagagtgcccgacgccagccaggacgacggccccgccgtggagagacccagcaccgagctgtag

SEQ ID NO: 12331 - DNA, 1473 bp, Artificial Sequence
  Description of Artificial Sequence: Synthetic coding sequence
atgctgatgagactggtgctgaccgtgagaagcaacctgatccccagcccccccacctacaacagcgcccacgactacatcagctgggagagcttcagcaacgtgagctactacaccagaatcctgcccagcgtgcccaaggactgccccacccccatgggcaccaagggcaagaagcagctgcccgacgcccagctgctggccagaagattcctgctgagaagaaagttcatccccgacccccagggcaccaacctgatgttcgccttcttcgcccagcacttcacccaccagttcttcaagaccagcggcaagatgggccccggcttcaccaaggccctgggccacggcgtggacctgggccacatctacggcgacaacctggagagacagtaccagctgagactgttcaaggacggcaagctgaagtaccaggtgctggacggcgagatgtacccccccagcgtggaggaggcccccgtgctgatgcactaccccagaggcatccccccccagagccagatggccgtgggccaggaggtgttcggcctgctgcccggcctgatgctgtacgccaccctgtggctgagagagcacaacagagtgtgcgacctgctgaaggccgagcaccccacctggggcgacgagcagctgttccagaccaccagactgatcctgatcggcgagaccatcaagatcgtgatcgaggagtacgtgcagcagctgagcggctacttcctgcagctgaagttcgaccccgagctgctgttcggcgtgcagttccagtacagaaacagaatcgccatggagttcaaccacctgtaccactggcaccccctgatgcccgacagcttcaaggtgggcagccaggagtacagctacgagcagttcctgttcaacaccagcatgctggtggactacggcgtggaggccctggtggacgccttcagcagacagatcgccggcagaatcggcggcggcagaaacatggaccaccacatcctgcacgtggccgtggacgtgatcagagagagcagagagatgagactgcagcccttcaacgagtacagaaagagattcggcatgaagccctacaccagcttccaggagctggtgggcgagaaggagatggccgccgagctggaggagctgtacggcgacatcgacgccctggagttctaccccggcctgctgctggagaagtgccaccccaacagcatcttcggcgagagcatgatcgagatcggcgcccccttcagcctgaagggcctgctgggcaaccccatctgcagccccgagtactggaagcccagcaccttcggcggcgaggtgggcttcaacatcgtgaagaccgccaccctgaagaagctggtgtgcctgaacaccaagacctgcccctacgtgagcttcagagtgcccgacgccagccaggacgacggccccgccgtggagagacccagcaccgagctgtag

SEQ ID NO: 12332 - DNA, 471 bp, Artificial Sequence
  Description of Artificial Sequence: Synthetic coding sequence
agcctgctgctgtggttcctgctgttcctgctgctgctgccccccctgcccgtgctgctggccgaccccggcgcccccacccccgccggcctgtggacctggctgagaaacagcctgagacccagccccagcttcacccacttcctgctgacccacggcagatggttctgggagttcgtgaacgccaccttcatcagagagatgctgatgagactggtgctgaccgtgagaagcaacctgatccccagcccccccacctacaacagcgcccacgactacatcagctgggagagcttcagcaacttcttcaagaccagcggcaagatgggccccggcttcaccaaggccctgggccacggcgtggacctgggccacatctacggcgacaacctggagagacagtaccagctgagactgttcaaggacggcaagctgaagtaccaggtgctggacggcgagatgtacccctag

SEQ ID NO: 12333 - DNA, 1614 bp, Artificial Sequence
  Description of Artificial Sequence: Synthetic coding sequence
atgagaaagcccagactgatgaacccctgctgctactacccctgccagcaccagggcatctgcgtgagattcggcctggacagataccagtgcgactgcaccagaaccggctacagcggccccaactgcaccatccccggcctgtggacctggctgagaaacagcctgagacccagccccagcttcacccacttcctgctgacccacggcagatggttctgggagttcgtgaacgccaccttcatcagagagatgctgatgagactggtgctgaccgtgagaagcaacctgatccccagcccccccacctacaacagcgcccacgactacatcagctgggagagcttcagcaacgtgagctactacaccagaatcctgcccagcgtgcccaaggactgccccacccccatgggcaccaagggcaagaagcagctgcccgacgcccagctgctggccagaagattcctgctgagaagaaagttcatccccgacccccagggcaccaacctgatgttcgccttcttcgcccagcacttcacccaccagttcttcaagaccagcggcaagatgggccccggcttcaccaaggccctgggccacggcgtggacctgggccacatctacggcgacaacctggagagacagtaccagctgagactgttcaaggacggcaagctgaagtaccaggtgctggacggcgagatgtacccccccagcgtggaggaggcccccgtgctgatgcactaccccagaggcatccccccccagagccagatggccgtgggccaggaggtgttcggcctgctgcccggcctgatgctgtacgccaccctgtggctgagagagcacaacagagtgtgcgacctgctgaaggccgagcaccccacctggggcgacgagcagctgttccagaccaccagactgatcctgatcggcgagaccatcaagatcgtgatcgaggagtacgtgcagcagctgagcggctacttcctgcagctgaagttcgaccccgagctgctgttcggcgtgcagttccagtacagaaacagaatcgccatggagttcaaccacctgtaccactggcaccccctgatgcccgacagcttcaagatcggcggcggcagaaacatggaccaccacatcctgcacgtggccgtggacgtgatcagagagagcagagagatgagactgcagcccttcaacgagtacagaaagagattcggcatgaagccctacaccagcttccaggagctggtgggcgagaaggagatggccgccgagctggaggagctgtacggcgacatcgacgccctggagttctaccccggcctgctgctggagaagtgccaccccaacagcatcttcggcgagagcatgatcgagatcggcgcccccttcagcctgaagggcctgctgggcaaccccatctgcagccccgagtactggaagcccagcaccttcggcggcgaggtgggcttcaacatcgtgaagaccgccaccctgaagaagctggtgtgcctgaacaccaagacctgcccctacgtgagcttcagagtgcccgacgccagccaggacgacggccccgccgtggagagacccagcaccgagctgtag

SEQ ID NO: 12334 - DNA, 1815 bp, Artificial Sequence
  Description of Artificial Sequence: Synthetic coding sequence
atgctggccagagccctgctgctgtgcgccgtgctggccctgagccacaccgccaacccctgctgcagccacccctgccagaacagaggcgtgtgcatgagcgtgggcttcgaccagtacaagtgcgactgcaccagaaccggcttctacggcgagaactgcagcacccccgagttcctgaccagaatcaagctgttcctgaagcccacccccaacaccgtgcactacatcctgacccacttcaagggcttctggaacgtggtgaacaacatccccttcctgagaaacgccatcatgagctacgtgctgaccagcagaagccacctgatcgacagcccccccacctacaacgccgactacggctacaagagctgggaggccttcagcaacctgagctactacaccagagccctgccccccgtgcccgacgactgccccacccccctgggcgtgaagggcaagaagcagctgcccgacagcaacgagatcgtggagaagctgctgctgagaagaaagttcatccccgacccccagggcagcaacatgatgttcgccttcttcgcccagcacttcacccaccagttcttcaagaccgaccacaagagaggccccgccttcaccaacggcctgggccacggcgtggacctgaaccacatctacggcgagaccctggccagacagagaaagctgagactgttcaaggacggcaagatgaagtaccagatcatcgacggcgagatgtacccccccaccgtgaaggacacccaggccgagatgatctaccccccccaggtgcccgagcacctgagattcgccgtgggccaggaggtgttcggcctggtgcccggcctgatgatgtacgccaccatctggctgagagagcacaacagagtgtgcgacgtgctgaagcaggagcaccccgagtggggcgacgagcagctgttccagaccagcagactgatcctgatcggcgagaccatcaagatcgtgatcgaggactacgtgcagcacctgagcggctaccacttcaagctgaagttcgaccccgagctgctgttcaacaagcagttccagtaccagaacagaatcgccgccgagttcaacaccctgtaccactggcaccccctgctgcccgacaccttccagatccacgaccagaagtacaactaccagcagttcatctacaacaacagcatcctgctggagcacggcatcacccagttcgtggagagcttcaccagacagatcgccggcagagtggccggcggcagaaacgtgccccccgccgtgcagaaggtgagccaggccagcatcgaccagagcagacagatgaagtaccagagcttcaacgagtacagaaagagattcatgctgaagccctacgagagcttcgaggagctgaccggcgagaaggagatgagcgccgagctggaggccctgtacggcgacatcgacgccgtggagctgtaccccgccctgctggtggagaagcccagacccgacgccatcttcggcgagaccatggtggaggtgggcgcccccttcagcctgaagggcctgatgggcaacgtgatctgcagccccgcctactggaagcccagcaccttcggcggcgaggtgggcttccagatcatcaacaccgccagcatccagagcctgatctgcaacaacgtgaagggctgccccttcaccagcttcagcgtgcccgaccccgagctgatcaagaccgtgaccatcaacgccagcagcagcagaagcggcctggacgacatcaaccccaccgtgctgctgaaggagagaagcaccgagctgtag

SEQ ID NO: 12335 - DNA, 1614 bp, Artificial Sequence
  Description of Artificial Sequence: Synthetic coding sequence
agcctggtgcccgccaccaactacatctacacccccctgaaccagctgaagggcggcaccatcgtgaacgtgtacggcgtggtgaagttcttcaagcccccctacctgagcaagggcaccgactactgcagcgtggtgaccatcgtggaccagaccaacgtgaagctgacctgcctgctgttcagcggcaactacgaggccctgcccatcatctacaagaacggcgacatcgtgagattccacagactgaagatccaggtgtacaagaaggagacccagggcatcaccagcagcggcttcgccagcctgaccttcgagggcaccctgggcgcccccatcatccccagaaccagcagcaagtacttcaacttcaccaccgaggaccacaagatggtggaggccctgagagtgtgggccagcacccacatgagccccagctggaccctgctgaagctgtgcgacgtgcagcccatgcagtacttcgacctgacctgccagctgctgggcaaggccgaggtggacggcgccagcttcctgctgaaggtgtgggacggcaccagaacccccttccccagctggagagtgctgatccaggacctggtgctggagggcgacctgagccacatccacagactgcagaacctgaccatcgacatcctggtgtacgacaaccacgtgcacgtggccagaagcctgaaggtgggcagcttcctgagaatctacagcctgcacaccaagctgcagagcatgaacagcgagaaccagaccatgctgagcctggagttccacctgcacggcggcaccagctacggcagaggcatcagagtgctgcccgagagcaacagcgacgtggaccagctgaagaaggacctggagagcgccaacctgaccgccaaccagcacagcgacgtgatctgccagagcgagcccgacgacagcttccccagcagcggcagcgtgagcctgtacgaggtggagagatgccagcagctgagcgccaccatcctgaccgaccaccagtacctggagagaacccccctgtgcgccatcctgaagcagaaggccccccagcagtacagaatcagagccaagctgagaagctacaagcccagaagactgttccagagcgtgaagctgcactgccccaagtgccacctgctgcaggaggtgccccacgagggcgacctggacatcatcttccaggacggcgccaccaagacccccgacgtgaagctgcagaacaccagcctgtacgacagcaagatctggaccaccaagaaccagaagggcagaaaggtggccgtgcacttcgtgaagaacaacggcatcctgcccctgagcaacgagtgcctgctgctgatcgagggcggcaccctgagcgagatctgcaagctgagcaacaagttcaacagcgtgatccccgtgagaagcggccacgaggacctggagctgctggacctgagcgcccccttcctgatccagggcaccatccaccactacggctgcaagcagtgcagcagcctgagaagcatccagaacctgaacagcctggtggacaagaccagctggatccccagcagcgtggccgaggagctggacatcgtgctgcagtag

SEQ ID NO: 12336 - DNA, 1905 bp, Artificial Sequence
  Description of Artificial Sequence: Synthetic coding sequence
atgagcctggtgcccgccaccaactacatctacacccccctgaaccagctgaagggcggcaccatcgtgaacgtgtacggcgtggtgaagttcttcaagcccccctacctgagcaagggcaccgactactgcagcgtggtgaccatcgtggaccagaccaacgtgaagctgacctgcctgctgttcagcggcaactacgaggccctgcccatcatctacaagaacggcgacatcgtgagattccacagactgaagatccaggtgtacaagaaggagacccagggcatcaccagcagcggcttcgccagcctgaccttcgagggcaccctgggcgcccccatcatccccagaaccagcagcaagtacttcaacttcaccaccgaggaccacaagatggtggaggccctgagagtgtgggccagcacccacatgagccccagctggaccctgctgaagctgtgcgacgtgcagcccatgcagtacttcgacctgacctgccagctgctgggcaaggccgaggtggacggcgccagcttcctgctgaaggtgtgggacggcaccagaacccccttccccagctggagagtgctgatccaggacctggtgctggagggcgacctgagccacatccacagactgcagaacctgaccatcgacatcctggtgtacgacaaccacgtgcacgtggccagaagcctgaaggtgggcagcttcctgagaatctacagcctgcacaccaagctgcagagcatgaacagcgagaaccagaccatgctgagcctggagttccacctgcacggcggcaccagctacggcagaggcatcagagtgctgcccgagagcaacagcgacgtggaccagctgaagaaggacctggagagcgccaacctgaccgccaaccagcacagcgacgtgatctgccagagcgagcccgacgacagcttccccagcagcggcagcgtgagcctgtacgaggtggagagatgccagcagctgagcgccaccatcctgaccgaccaccagtacctggagagaacccccctgtgcgccatcctgaagcagaaggccccccagcagtacagaatcagagccaagctgagaagctacaagcccagaagactgttccagagcgtgaagctgcactgccccaagtgccacctgctgcaggaggtgccccacgagggcgacctggacatcatcttccaggacggcgccaccaagacccccgacgtgaagctgcagaacaccagcctgtacgacagcaagatctggaccaccaagaaccagaagggcagaaaggtggccgtgcacttcgtgaagaacaacggcatcctgcccctgagcaacgagtgcctgctgctgatcgagggcggcaccctgagcgagatctgcaagctgagcaacaagttcaacagcgtgatccccgtgagaagcggccacgaggacctggagctgctggacctgagcgcccccttcctgatccagggcaccatccaccactacggctgcaagcagtgcagcagcctgagaagcatccagaacctgaacagcctggtggacaagaccagctggatccccagcagcgtggccgaggccctgggcatcgtgcccctgcagtacgtgttcgtgatgaccttcaccctggacgacggcaccggcgtgctggaggcctacctgatggacagcgacaagttcttccagatccccgccagcgaggtgctgatggacgacgacctgcagaagagcgtggacatgatcatggacatgttctgcccccccggcatcaagatcgacgcctacccctggctggagtgcttcatcaagagctacaacgtgaccaacggcaccgacaaccagatctgctaccagatcttcgacaccaccgtggccgaggacgtgatctag

SEQ ID NO: 12337 - DNA, 1023 bp, Artificial Sequence
  Description of Artificial Sequence: Synthetic coding sequence
ctgagcctggtgcccgccaccaactacatctacacccccctgaaccagctgaagggcggcaccatcgtgaacgtgtacggcgtggtgaagttcttcaagcccccctacctgagcaagggcaccgactactgcagcgtggtgaccatcgtggaccagaccaacgtgaagctgacctgcctgctgttcagcggcaactacgaggccctgcccatcatctacaagaacggcgacatcgtgagattccacagactgaagatccaggtgtacaagaaggagacccagggcatcaccagcagcggcttcgccagcctgaccttcgagggcaccctgggcgcccccatcatccccagaaccagcagcaagtacttcaacttcaccaccgaggaccacaagatggtggaggccctgagagtgtgggccagcacccacatgagccccagctggaccctgctgaagctgtgcgacgtgcagcccatgcagtacttcgacctgacctgccagctgctgggcaaggccgaggtggacggcgccagcttcctgctgaaggtgtgggacggcaccagaacccccttccccagctggagagtgctgatccaggacctggtgctggagggcgacctgagccacatccacagactgcagaacctgaccatcgacatcctggtgtacgacaaccacgtgcacgtggccagaagcctgaaggtgggcagcttcctgagaatctacagcctgcacaccaagctgcagagcatgaacagcgagaaccagaccatgctgagcctggagttccacctgcacggcggcaccagctacggcagaggcatcagagtgctgcccgagagcaacagcgacgtggaccagctgaagaaggacctggagagcgccaacctgaccgccaaccagcacagcgacgtgatctgccagagcgagcccgacgacagcttccccaacggcgtgagcctgagaccccccggctggagcagcgtggccagaagcagactgatcgccgccagcaccagctag

SEQ ID NO: 12338 - DNA, 1512 bp, Artificial Sequence
  Description of Artificial Sequence: Synthetic coding sequence
atggtggaggccctgagagtgtgggccagcacccacatgagccccagctggaccctgctgaagctgtgcgacgtgcagcccatgcagtacttcgacctgacctgccagctgctgggcaaggccgaggtggacggcgccagcttcctgctgaaggtgtgggacggcaccagaacccccttccccagctggagagtgctgatccaggacctggtgctggagggcgacctgagccacatccacagactgcagaacctgaccatcgacatcctggtgtacgacaaccacgtgcacgtggccagaagcctgaaggtgggcagcttcctgagaatctacagcctgcacaccaagctgcagagcatgaacagcgagaaccagaccatgctgagcctggagttccacctgcacggcggcaccagctacggcagaggcatcagagtgctgcccgagagcaacagcgacgtggaccagctgaagaaggacctggagagcgccaacctgaccgccaaccagcacagcgacgtgatctgccagagcgagcccgacgacagcttccccagcagcggcagcgtgagcctgtacgaggtggagagatgccagcagctgagcgccaccatcctgaccgaccaccagtacctggagagaacccccctgtgcgccatcctgaagcagaaggccccccagcagtacagaatcagagccaagctgagaagctacaagcccagaagactgttccagagcgtgaagctgcactgccccaagtgccacctgctgcaggaggtgccccacgagggcgacctggacatcatcttccaggacggcgccaccaagacccccgacgtgaagctgcagaacaccagcctgtacgacagcaagatctggaccaccaagaaccagaagggcagaaaggtggccgtgcacttcgtgaagaacaacggcatcctgcccctgagcaacgagtgcctgctgctgatcgagggcggcaccctgagcgagatctgcaagctgagcaacaagttcaacagcgtgatccccgtgagaagcggccacgaggacctggagctgctggacctgagcgcccccttcctgatccagggcaccatccaccactacggctgcaagcagtgcagcagcctgagaagcatccagaacctgaacagcctggtggacaagaccagctggatccccagcagcgtggccgaggccctgggcatcgtgcccctgcagtacgtgttcgtgatgaccttcaccctggacgacggcaccggcgtgctggaggcctacctgatggacagcgacaagttcttccagatccccgccagcgaggtgctgatggacgacgacctgcagaagagcgtggacatgatcatggacatgttctgcccccccggcatcaagatcgacgcctacccctggctggagtgcttcatcaagagctacaacgtgaccaacggcaccgacaaccagatctgctaccagatcttcgacaccaccgtggccgaggacgtgatctag

SEQ ID NO: 12339 - DNA, 1380 bp, Artificial Sequence
  Description of Artificial Sequence: Synthetic coding sequence
ctgagcctggtgcccgccaccaactacatctacacccccctgaaccagctgaagggcggcaccatcgtgaacgtgtacggcgtggtgaagttcttcaagcccccctacctgagcaagggcaccgactactgcagcgtggtgaccatcgtggaccagaccaacgtgaagctgacctgcctgctgttcagcggcaactacgaggccctgcccatcatctacaagaacggcgacatcgtgagattccacagactgaagatccaggtgtacaagaaggagacccagggcatcaccagcagcggcttcgccagcctgaccttcgagggcaccctgggcgcccccatcatccccagaaccagcagcaagtacttcaacttcaccaccgaggaccacaagatggtggaggccctgagagtgtgggccagcacccacatgagccccagctggaccctgctgaagctgtgcgacgtgcagcccatgcagtacttcgacctgacctgccagctgctgggcaaggccgaggtggacggcgccagcttcctgctgaaggtgtgggacggcaccagaacccccttccccagctggagagtgctgatccaggacctggtgctggagggcgacctgagccacatccacagactgcagaacctgaccatcgacatcctggtgtacgacaaccacgtgcacgtggccagaagcctgaaggtgggcagcttcctgagaatctacagcctgcacaccaagctgcagagcatgaacagcgagaaccagaccatgctgagcctggagttccacctgcacggcggcaccagctacggcagaggcatcagagtgctgcccgagagcaacagcgacgtggaccagctgaagaaggacctggagagcgccaacctgaccgccaaccagcacagcgacgtgatctgccagagcgagcccgacgacagcttccccagcagcggcagcgtgagcctgtacgaggtggagagatgccagcagctgagcgccaccatcctgaccgaccaccagtacctggagagaacccccctgtgcgccatcctgaagcagaaggccccccagcagtacagaatcagagccaagctgagaagctacaagcccagaagactgttccagagcgtgaagctgcactgccccaagtgccacctgctgcaggaggtgccccacgagggcgacctggacatcatcttccaggacggcgccaccaagacccccgacgtgaagctgcagaacaccagcctgtacgacagcaagatctggaccaccaagaaccagaagggcagaaaggtggccgtgcacttcgtgaagaacaacggcatcctgcccctgagcaacgagtgcctgctgctgatcgaggtgctgctgtag

SEQ ID NO: 12340 - DNA, 249 bp, Artificial Sequence
  Description of Artificial Sequence: Synthetic coding sequence
atgagcctggtgcccgccaccaactacatctacacccccctgaaccagctgaagggcggcaccatcgtgaacgtgtacggcgtggtgaagttcttcaagcccccctacctgagcaagggcaccgactactgcagcgtggtgaccatcgtggaccagaccaacgtgaagctgacctgcctgctgttcagcggcaactacgaggccctgcccatcatctacaagaacggcgacatcgtgagattccactag

SEQ ID NO: 12341 - DNA, 1557 bp, Artificial Sequence
  Description of Artificial Sequence: Synthetic coding sequence
ctgagcctggtgcccgccaccaactacatctacacccccctgaaccagctgaagggcggcaccatcgtgaacgtgtacggcgtggtgaagttcttcaagcccccctacctgagcaagggcaccgactactgcagcgtggtgaccatcgtggaccagaccaacgtgaagctgacctgcctgctgttcagcggcaactacgaggccctgcccatcatctacaagaacggcgacatcgtgagattccacagactgaagatccaggtgtacaagaaggagacccagggcatcaccagcagcggcttcgccagcctgaccttcgagggcaccctgggcgcccccatcatccccagaaccagcagcaagtacttcaacttcaccaccgaggaccacaagatggtggaggccctgagagtgtgggccagcacccacatgagccccagctggaccctgctgaagctgtgcgacgtgcagcccatgcagtacttcgacctgacctgccagctgctgggcaaggccgaggtggacggcgccagcttcctgctgaaggtgtgggacggcaccagaacccccttccccagctggagagtgctgatccaggacctggtgctggagggcgacctgagccacatccacagactgcagaacctgaccatcgacatcctggtgtacgacaaccacgtgcacgtggccagaagcctgaaggtgggcagcttcctgagaatctacagcctgcacaccaagctgcagagcatgaacagcgagaaccagaccatgctgagcctggagttccacctgcacggcggcaccagctacggcagaggcatcagagtgctgcccgagagcaacagcgacgtggaccagctgaagaaggacctggagagcgccaacctgaccgccaaccagcacagcgacgtgatctgccagagcgagcccgacgacagcttccccagcagcggcagcgtgagcctgtacgaggtggagagatgccagcagctgagcgccaccatcctgaccgaccaccagtacctggagagaacccccctgtgcgccatcctgaagcagaaggccccccagcagtacagaatcagagccaagctgagaagctacaagcccagaagactgttccagagcgtgaagctgcactgccccaagtgccacctgctgcaggaggtgccccacgagggcgacctggacatcatcttccaggacggcgccaccaagacccccgacgtgaagctgcagaacaccagcctgtacgacagcaagatctggaccaccaagaaccagaagggcagaaaggtggccgtgcacttcgtgaagaacaacggcatcctgcccctgagcaacgagtgcctgctgctgatcgagggcggcaccctgagcgagatctgcaagctgagcaacaagttcaacagcgtgatccccgtgagaagcggccacgaggacctggagctgctggacctgagcgcccccttcctgatccagggcaccatccaccactacggcaccggctactgcaccccccccatctgcgtgtgctacgacctgtacacctag

SEQ ID NO: 12342 - DNA, 1374 bp, Artificial Sequence
  Description of Artificial Sequence: Synthetic coding sequence
agccccgaggaccccagaagcaagcacaagttcaagatccacacctacggcagccccaccttctgcgaccactgcggcagcctgctgtacggcctgatccaccagggcatgaagtgcgacacctgcgacatgaacgtgcacaagcagtgcgtgatcaacgtgcccagcctgtgcggcatggaccacaccgagaagagaggcagaatctacctgaaggccgaggtggccgacgagaagctgcacgtgaccgtgagagacgccaagaacctgatccccatggaccccaacggcctgagcgacccctacgtgaagctgaagctgatccccgaccccaagaacgagagcaagcagaagaccaagaccatcagaagcaccctgaacccccagtggaacgagagcttcaccttcaagctgaagcccagcgacaaggacagaagactgagcgtggagatctgggactgggacagaaccaccagaaacgacttcatgggcagcctgagcttcggcgtgagcgagctgatgaagatgcccgccagcggctggtacaagctgctgaaccaggaggagggcgagtactacaacgtgcccatccccgagggcgacgaggagggcaacatggagctgagacagaagttcgagaaggccaagctgggccccgccggcaacaaggtgatcagccccagcgaggacagaaagcagcccagcaacaacctggacagagtgaagctgaccgacttcaacttcctgatggtgctgggcaagggcagcttcggcaaggtgatgctggccgacagaaagggcaccgaggagctgtacgccatcaagatcctgaagaaggacgtggtgatccaggacgacgacgtggagtgcaccatggtggagaagagagtgctggccctgctggacaagccccccttcctgacccagctgcacagctgcttccagaccgtggacagactgtacttcgtgatggagtacgtgaacggcggcgacctgatgtaccacatccagcaggtgggcaagttcaaggagccccaggccgtgttctacgccgccgagatcagcatcggcctgttcttcctgcacaagagaggcatcatctacagagacctgaagctggacaacgtgatgctggacagcgagggccacatcaagatcgccgacttcggcatgtgcaaggagcacatgatggacggcgtgaccaccagaaccttctgcggcacccccgactacatcgcccccgagatcatcgcctaccagccctacggcaagagcgtggactggtgggcctacggcgtgctgctgtacgagatgctggccggccaggtgatgttctgctacatcttcatgttcgtgtactgctgcgtgatgtag

SEQ ID NO: 12343 - DNA, 2019 bp, Artificial Sequence
  Description of Artificial Sequence: Synthetic coding sequence
atggccgacgtgttccccggcaacgacagcaccgccagccaggacgtggccaacagattcgccagaaagggcgccctgagacagaagaacgtgcacgaggtgaaggaccacaagttcatcgccagattcttcaagcagcccaccttctgcagccactgcaccgacttcatctggggcttcggcaagcagggcttccagtgccaggtgtgctgcttcgtggtgcacaagagatgccacgagttcgtgaccttcagctgccccggcgccgacaagggccccgacaccgacgaccccagaagcaagcacaagttcaagatccacacctacggcagccccaccttctgcgaccactgcggcagcctgctgtacggcctgatccaccagggcatgaagtgcgacacctgcgacatgaacgtgcacaagcagtgcgtgatcaacgtgcccagcctgtgcggcatggaccacaccgagaagagaggcagaatctacctgaaggccgaggtggccgacgagaagctgcacgtgaccgtgagagacgccaagaacctgatccccatggaccccaacggcctgagcgacccctacgtgaagctgaagctgatccccgaccccaagaacgagagcaagcagaagaccaagaccatcagaagcaccctgaacccccagtggaacgagagcttcaccttcaagctgaagcccagcgacaaggacagaagactgagcgtggagatctgggactgggacagaaccaccagaaacgacttcatgggcagcctgagcttcggcgtgagcgagctgatgaagatgcccgccagcggctggtacaagctgctgaaccaggaggagggcgagtactacaacgtgcccatccccgagggcgacgaggagggcaacatggagctgagacagaagttcgagaaggccaagctgggccccgccggcaacaaggtgatcagccccagcgaggacagaaagcagcccagcaacaacctggacagagtgaagctgaccgacttcaacttcctgatggtgctgggcaagggcagcttcggcaaggtgatgctggccgacagaaagggcaccgaggagctgtacgccatcaagatcctgaagaaggacgtggtgatccaggacgacgacgtggagtgcaccatggtggagaagagagtgctggccctgctggacaagccccccttcctgacccagctgcacagctgcttccagaccgtggacagactgtacttcgtgatggagtacgtgaacggcggcgacctgatgtaccacatccagcaggtgggcaagttcaaggagccccaggccgtgttctacgccgccgagatcagcatcggcctgttcttcctgcacaagagaggcatcatctacagagacctgaagctggacaacgtgatgctggacagcgagggccacatcaagatcgccgacttcggcatgtgcaaggagcacatgatggacggcgtgaccaccagaaccttctgcggcacccccgactacatcgcccccgagatcatcgcctaccagccctacggcaagagcgtggactggtgggcctacggcgtgctgctgtacgagatgctggccggccagccccccttcgacggcgaggacgaggacgagctgttccagagcatcatggagcacaacgtgagctaccccaagagcctgagcaaggaggccgtgagcgtgtgcaagggcctgatgaccaagcaccccgccaagagactgggctgcggccccgagggcgagagagacgtgagagagcacgccttcttcagaagaatcgactgggagaagctggagaacagagagatccagccccccttcaagcccaaggtgtgcggcaagggcgccgagaacttcgacaagttcttcaccagaggccagcccgtgctgaccccccccgaccagctggtgatcgccaacatcgaccagagcgacttcgagggcttcagctacgtgaacccccagttcgtgcaccccatcctgcagagcgccgtgtag

SEQ ID NO: 12344 - DNA, 2022 bp, Artificial Sequence
  Description of Artificial Sequence: Synthetic coding sequence
atggccgaccccgccgccggccccccccccagcgagggcgaggagagcaccgtgagattcgccagaaagggcgccctgagacagaagaacgtgcacgaggtgaagaaccacaagttcaccgccagattcttcaagcagcccaccttctgcagccactgcaccgacttcatctggggcttcggcaagcagggcttccagtgccaggtgtgctgcttcgtggtgcacaagagatgccacgagttcgtgaccttcagctgccccggcgccgacaagggccccgccagcgacgaccccagaagcaagcacaagttcaagatccacacctacagcagccccaccttctgcgaccactgcggcagcctgctgtacggcctgatccaccagggcatgaagtgcgacacctgcatgatgaacgtgcacaagagatgcgtgatgaacgtgcccagcctgtgcggcaccgaccacaccgagagaagaggcagaatctacatccaggcccacatcgacagagacgtgctgatcgtgctggtgagagacgccaagaacctggtgcccatggaccccaacggcctgagcgacccctacgtgaagctgaagctgatccccgaccccaagagcgagagcaagcagaagaccaagaccatcaagtgcagcctgaaccccgagtggaacgagaccttcagattccagctgaaggagagcgacaaggacagaagactgagcgtggagatctgggactgggacctgaccagcagaaacgacttcatgggcagcctgagcttcggcatcagcgagctgcagaaggccagcgtggacggctggttcaagctgctgagccaggaggagggcgagtacttcaacgtgcccgtgccccccgagggcagcgaggccaacgaggagctgagacagaagttcgagagagccaagatcagccagggcaccaaggtgcccgaggagaagaccaccaacaccgtgagcaagttcgacaacaacggcaacagagacagaatgaagctgaccgacttcaacttcctgatggtgctgggcaagggcagcttcggcaaggtgatgctgagcgagagaaagggcaccgacgagctgtacgccgtgaagatcctgaagaaggacgtggtgatccaggacgacgacgtggagtgcaccatggtggagaagagagtgctggccctgcccggcaagccccccttcctgacccagctgcacagctgcttccagaccatggacagactgtacttcgtgatggagtacgtgaacggcggcgacctgatgtaccacatccagcaggtgggcagattcaaggagccccacgccgtgttctacgccgccgagatcgccatcggcctgttcttcctgcagagcaagggcatcatctacagagacctgaagctggacaacgtgatgctggacagcgagggccacatcaagatcgccgacttcggcatgtgcaaggagaacatctgggacggcgtgaccaccaagaccttctgcggcacccccgactacatcgcccccgagatcatcgcctaccagccctacggcaagagcgtggactggtgggccttcggcgtgctgctgtacgagatgctggccggccaggcccccttcgagggcgaggacgaggacgagctgttccagagcatcatggagcacaacgtggcctaccccaagagcatgagcaaggaggccgtggccatctgcaagggcctgatgaccaagcaccccggcaagagactgggctgcggccccgagggcgagagagacatcaaggagcacgccttcttcagatacatcgactgggagaagctggagagaaaggagatccagcccccctacaagcccaaggcctgcggcagaaacgccgagaacttcgacagattcttcaccagacacccccccgtgctgaccccccccgaccaggaggtgatcagaaacatcgaccagagcgagttcgagggcttcagcttcgtgaacagcgagttcctgaagcccgaggtgaagagctag

SEQ ID NO: 12345 - DNA, 2016 bp, Artificial Sequence
  Description of Artificial Sequence: Synthetic coding sequence
atggccgaccccgccgccggccccccccccagcgagggcgaggagagcaccgtgagattcgccagaaagggcgccctgagacagaagaacgtgcacgaggtgaagaaccacaagttcaccgccagattcttcaagcagcccaccttctgcagccactgcaccgacttcatctggggcttcggcaagcagggcttccagtgccaggtgtgctgcttcgtggtgcacaagagatgccacgagttcgtgaccttcagctgccccggcgccgacaagggccccgccagcgacgaccccagaagcaagcacaagttcaagatccacacctacagcagccccaccttctgcgaccactgcggcagcctgctgtacggcctgatccaccagggcatgaagtgcgacacctgcatgatgaacgtgcacaagagatgcgtgatgaacgtgcccagcctgtgcggcaccgaccacaccgagagaagaggcagaatctacatccaggcccacatcgacagagacgtgctgatcgtgctggtgagagacgccaagaacctggtgcccatggaccccaacggcctgagcgacccctacgtgaagctgaagctgatccccgaccccaagagcgagagcaagcagaagaccaagaccatcaagtgcagcctgaaccccgagtggaacgagaccttcagattccagctgaaggagagcgacaaggacagaagactgagcgtggagatctgggactgggacctgaccagcagaaacgacttcatgggcagcctgagcttcggcatcagcgagctgcagaaggccagcgtggacggctggttcaagctgctgagccaggaggagggcgagtacttcaacgtgcccgtgccccccgagggcagcgaggccaacgaggagctgagacagaagttcgagagagccaagatcagccagggcaccaaggtgcccgaggagaagaccaccaacaccgtgagcaagttcgacaacaacggcaacagagacagaatgaagctgaccgacttcaacttcctgatggtgctgggcaagggcagcttcggcaaggtgatgctgagcgagagaaagggcaccgacgagctgtacgccgtgaagatcctgaagaaggacgtggtgatccaggacgacgacgtggagtgcaccatggtggagaagagagtgctggccctgcccggcaagccccccttcctgacccagctgcacagctgcttccagaccatggacagactgtacttcgtgatggagtacgtgaacggcggcgacctgatgtaccacatccagcaggtgggcagattcaaggagccccacgccgtgttctacgccgccgagatcgccatcggcctgttcttcctgcagagcaagggcatcatctacagagacctgaagctggacaacgtgatgctggacagcgagggccacatcaagatcgccgacttcggcatgtgcaaggagaacatctgggacggcgtgaccaccaagaccttctgcggcacccccgactacatcgcccccgagatcatcgcctaccagccctacggcaagagcgtggactggtgggccttcggcgtgctgctgtacgagatgctggccggccaggcccccttcgagggcgaggacgaggacgagctgttccagagcatcatggagcacaacgtggcctaccccaagagcatgagcaaggaggccgtggccatctgcaagggcctgatgaccaagcaccccggcaagagactgggctgcggccccgagggcgagagagacatcaaggagcacgccttcttcagatacatcgactgggagaagctggagagaaaggagatccagcccccctacaagcccaaggccagagacaagagagacaccagcaacttcgacaaggagttcaccagacagcccgtggagctgacccccaccgacaagctgttcatcatgaacctggaccagaacgagttcgccggcttcagctacaccaaccccgagttcgtgatcaacgtgtag

SEQ ID NO: 12346 - DNA, 786 bp, Artificial Sequence
  Description of Artificial Sequence: Synthetic coding sequence
atgagagagagcgccctggagagaggccccgtgcccgaggcccccgccggcggccccgtgcacgccgtgaccgtggtgaccctgctggagaagctggccagcatgctggagaccctgagagagagacagggcggcctggccagaagacagggcggcctggccggcagcgtgagaagaatccagagcggcctgggcgccctgagcagaagccacgacaccaccagcaacaccctggcccagctgctggccaaggccgagagagtgagcagccacgccaacgccgcccaggagagagccgtgagaagagccgcccaggtgcagagactggaggccaaccacggcctgctggtggccagaggcaagctgcacgtgctgctgttcaaggaggagggcgaggtgcccgccagcgccttccagaaggcccccgagcccctgggccccgccgaccagagcgagctgggccccgagcagctggaggccgaggtgggcgagagcagcgacgaggagcccgtggagagcagagcccagagactgagaagaaccggcctgcagaaggtgcagagcctgagaagagccctgagcggcagaaagggccccgccgcccccccccccacccccgtgaagccccccagactgggccccggcagaagcgccgaggcccagcccgaggcccagcccgccctggagcccaccctggagcccgagcccccccaggacaccgaggaggaccccggcagacccggcgccgccgaggaggccctgctgcagatggagagcgtggcctag

SEQ ID NO: 12347 - DNA, 2214 bp, Artificial Sequence
  Description of Artificial Sequence: Synthetic coding sequence
atggtggtgttcaacggcctgctgaagatcaagatctgcgaggccgtgagcctgaagcccaccgcctggagcctgagacacgccgtgggccccagaccccagaccttcctgctggacccctacatcgccctgaacgtggacgacagcagaatcggccagaccgccaccaagcagaagaccaacagccccgcctggcacgacgagttcgtgaccgacgtgtgcaacggcagaaagatcgagctggccgtgttccacgacgcccccatcggctacgacgacttcgtggccaactgcaccatccagttcgaggagctgctgcagaacggcagcagacacttcgaggactggatcgacctggagcccgagggcagagtgtacgtgatcatcgacctgagcggcagcagcggcgaggcccccaaggacaacgaggagagagtgttcagagagagaatgagacccagaaagagacagggcgccgtgagaagaagagtgcaccaggtgaacggccacaagttcatggccacctacctgagacagcccacctactgcagccactgcagagacttcatctggggcgtgatcggcaagcagggctaccagtgccaggtgtgcacctgcgtggtgcacaagagatgccacgagctgatcatcaccaagtgcgccggcctgaagaagcaggagacccccgaccaggtgggcagccagagattcagcgtgaacatgccccacaagttcggcatccacaactacaaggtgcccaccttctgcgaccactgcggcagcctgctgtggggcctgctgagacagggcctgcagtgcaaggtgtgcaagatgaacgtgcacagaagatgcgagaccaacgtggcccccaactgcggcgtggacgccagaggcatcgccaaggtgctggccgacctgggcgtgacccccgacaagatcaccaacagcggccagagaagaaagaagctgatcgccggcgccgagagcccccagcccgccagcggcagcagccccagcgaggaggacagaagcaagagcgcccccaccagcccctgcgaccaggagatcaaggagctggagaacaacatcagaaaggccctgagcttcgacaacagaggcgaggagcacagagccgccagcagccccgacggccagctgatgagccccggcgagaacggcgaggtgagacagggccaggccaagagactgggcctggacgagttcaacttcatcaaggtgctgggcaagggcagcttcggcaaggtgatgctggccgagctgaagggcaaggacgaggtgtacgccgtgaaggtgctgaagaaggacgtgatcctgcaggacgacgacgtggactgcaccatgaccgagaagagaatcctggccctggccagaaagcacccctacctgacccagctgtactgctgcttccagaccaaggacagactgttcttcgtgatggagtacgtgaacggcggcgacctgatgttccagatccagagaagcagaaagttcgacgagcccagaagcagattctacgccgccgaggtgaccagcgccctgatgttcctgcaccagcacggcgtgatctacagagacctgaagctggacaacatcctgctggacgccgagggccactgcaagctggccgacttcggcatgtgcaaggagggcatcctgaacggcgtgaccaccaccaccttctgcggcacccccgactacatcgcccccgagatcctgcaggagctggagtacggccccagcgtggactggtgggccctgggcgtgctgatgtacgagatgatggccggccagccccccttcgaggccgacaacgaggacgacctgttcgagagcatcctgcacgacgacgtgctgtaccccgtgtggctgagcaaggaggccgtgagcatcctgaaggccttcatgaccaagaacccccacaagagactgggctgcgtggccagccagaacggcgaggacgccatcaagcagcaccccttcttcaaggagatcgactgggtgctgctggagcagaagaagatcaagccccccttcaagcccagaatcaagaccaagagagacgtgaacaacttcgaccaggacttcaccagagaggagcccgtgctgaccctggtggacgaggccatcgtgaagcagatcaaccaggaggagttcaagggcttcagctacttcggcgaggacctgatgccctag

SEQ ID NO: 12348 - DNA, 384 bp, Artificial Sequence
  Description of Artificial Sequence: Synthetic coding sequence
atggtggtgttcaacggcctgctgaagatcaagatctgcgaggccgtgagcctgaagcccaccgcctggagcctgagacacgccgtgggccccagaccccagaccttcctgctggacccctacatcgccctgaacgtggacgacagcagaatcggccagaccgccaccaagcagaagaccaacagccccgcctggcacgacgagttcgtgaccgacgtgtgcaacggcagaaagatcgagctggccgtgttccacgacgcccccatcggctacgacgacttcgtggccaactgcaccatccagttcgaggagctgctgcagaacggcagcagacacttcgaggactggatcgacctggagcccgagggcagagtgtacgtgtag

SEQ ID NO: 12349 - DNA, 2094 bp, Artificial Sequence
  Description of Artificial Sequence: Synthetic coding sequence
atggccggcctgggccccggcgtgggcgacagcgagggcggccccagacccctgttctgcagaaagggcgccctgagacagaaggtggtgcacgaggtgaagagccacaagttcaccgccagattcttcaagcagcccaccttctgcagccactgcaccgacttcatctggggcatcggcaagcagggcctgcagtgccaggtgtgcagcttcgtggtgcacagaagatgccacgagttcgtgaccttcgagtgccccggcgccggcaagggcccccagaccgacgaccccagaaacaagcacaagttcagactgcacagctacagcagccccaccttctgcgaccactgcggcagcctgctgtacggcctggtgcaccagggcatgaagtgcagctgctgcgagatgaacgtgcacagaagatgcgtgagaagcgtgcccagcctgtgcggcgtggaccacaccgagagaagaggcagactgcagctggagatcagagcccccaccgccgacgagatccacgtgaccgtgggcgaggccagaaacctgatccccatggaccccaacggcctgagcgacccctacgtgaagctgaagctgatccccgaccccagaaacctgaccaagcagaagaccagaaccgtgaaggccaccctgaaccccgtgtggaacgagaccttcgtgttcaacctgaagcccggcgacgtggagagaagactgagcgtggaggtgtgggactgggacagaaccagcagaaacgacttcatgggcgccatgagcttcggcgtgagcgagctgctgaaggcccccgtggacggctggtacaagctgctgaaccaggaggagggcgagtactacaacgtgcccgtggccgacgccgacaactgcagcctgctgcagaagttcgaggcctgcaactaccccctggagctgtacgagagagtgagaatgggccccagcagcagccccatccccagccccagccccagccccaccgaccccaagagatgcttcttcggcgccagccccggcagactgcacatcagcgacttcagcttcctgatggtgctgggcaagggcagcttcggcaaggtgatgctggccgagagaagaggcagcgacgagctgtacgccatcaagatcctgaagaaggacgtgatcgtgcaggacgacgacgtggactgcaccctggtggagaagagagtgctggccctgggcggcagaggccccggcggcagaccccacttcctgacccagctgcacagcaccttccagacccccgacagactgtacttcgtgatggagtacgtgaccggcggcgacctgatgtaccacatccagcagctgggcaagttcaaggagccccacgccgccttctacgccgccgagatcgccatcggcctgttcttcctgcacaaccagggcatcatctacagagacctgaagctggacaacgtgatgctggacgccgagggccacatcaagatcaccgacttcggcatgtgcaaggagaacgtgttccccggcaccaccaccagaaccttctgcggcacccccgactacatcgcccccgagatcatcgcctaccagccctacggcaagagcgtggactggtggagcttcggcgtgctgctgtacgagatgctggccggccagccccccttcgacggcgaggacgaggaggagctgttccaggccatcatggagcagaccgtgacctaccccaagagcctgagcagagaggccgtggccatctgcaagggcttcctgaccaagcaccccggcaagagactgggcagcggccccgacggcgagcccaccatcagagcccacggcttcttcagatggatcgactgggagagactggagagactggagatccccccccccttcagacccagaccctgcggcagaagcggcgagaacttcgacaagttcttcaccagagccgcccccgccctgaccccccccgacagactggtgctggccagcatcgaccaggccgacttccagggcttcacctacgtgaaccccgacttcgtgcaccccgacgccagaagccccaccagccccgtgcccgtgcccgtgatgtag

SEQ ID NO: 12350 - DNA, 984 bp, Artificial Sequence
  Description of Artificial Sequence: Synthetic coding sequence
atggccggcctgggccccggcgtgggcgacagcgagggcggccccagacccctgttctgcagaaagggcgccctgagacagaaggtggtgcacgaggtgaagagccacaagttcaccgccagattcttcaagcagcccaccttctgcagccactgcaccgacttcatctggggcatcggcaagcagggcctgcagtgccaggtgtgcagcttcgtggtgcacagaagatgccacgagttcgtgaccttcgagtgccccggcgccggcaagggcccccagaccgacgaccccagaaacaagcacaagttcagactgcacagctacagcagccccaccttctgcgaccactgcggcagcctgctgtacggcctggtgcaccagggcatgaagtgcagctgctgcgagatgaacgtgcacagaagatgcgtgagaagcgtgcccagcctgtgcggcgtggaccacaccgagagaagaggcagactgcagctggagatcagagcccccaccgccgacgagatccacgtgaccgtgggcgaggccagaaacctgatccccatggaccccaacggcctgagcgacccctacgtgaagctgaagctgatccccgaccccagaaacctgaccaagcagaagaccagaaccgtgaaggccaccctgaaccccgtgtggaacgagaccttcgtgttcaacctgaagcccggcgacgtggagagaagactgagcgtggaggtgtgggactgggacagaaccagcagaaacgacttcatgggcgccatgagcttcggcgtgagcgagctgctgaaggcccccgtggacggctggctggtgaccaccccctggaactgcatgagcggctgcggctgggcccccctgcccctgcccagcccccccctgcccctggtgccccccacccccagcgccgccagcagcggcagagtgcaggacgcctgcaccagccccaccagcgccagcagctggttctag

SEQ ID NO: 12351 - DNA, 2133 bp, Artificial Sequence
  Description of Artificial Sequence: Synthetic coding sequence
atggccggcctgggccccggcgtgggcgacagcgagggcggccccagacccctgttctgcagaaagggcgccctgagacagaaggtggtgcacgaggtgaagagccacaagttcaccgccagattcttcaagcagcccaccttctgcagccactgcaccgacttcatctggggcatcggcaagcagggcctgcagtgccaggtgtgcagcttcgtggtgcacagaagatgccacgagttcgtgaccttcgagtgccccggcgccggcaagggcccccagaccgacgaccccagaaacaagcacaagttcagactgcacagctacagcagccccaccttctgcgaccactgcggcagcctgctgtacggcctggtgcaccagggcatgaagtgcagctgctgcgagatgaacgtgcacagaagatgcgtgagaagcgtgcccagcctgtgcggcgtggaccacaccgagagaagaggcagactgcagctggagatcagagcccccaccgccgacgagatccacgtgaccgtgggcgaggccagaaacctgatccccatggaccccaacggcctgagcgacccctacgtgaagctgaagctgatccccgaccccagaaacctgaccaagcagaagaccagaaccgtgaaggccaccctgaaccccgtgtggaacgagaccttcgtgttcaacctgaagcccggcgacgtggagagaagactgagcgtggaggtgtgggactgggacagaaccagcagaaacgacttcatgggcgccatgagcttcggcgtgagcgagctgctgaaggcccccgtggacggctggtacaagctgctgaaccaggaggagggcgagtactacaacgtgcccgtggccgacgccgacaactgcagcctgctgcagaagttcgaggcctgcaactaccccctggagctgtacgagagagtgagaatgggccccagcagcagccccatccccagccccagccccagccccaccgaccccaagagatgcttcttcggcgccagccccggcagactgcacatcagcgacttcagcttcctgatggtgctgggcaagggcagcttcggcaaggtgatgctggccgagagaagaggcagcgacgagctgtacgccatcaagatcctgaagaaggacgtgatcgtgcaggacgacgacgtggactgcaccctggtggagaagagagtgctggccctgggcggcagaggccccggcggcagaccccacttcctgacccagctgcacagcaccttccagacccccgacagactgtacttcgtgatggagtacgtgaccggcggcgacctgatgtaccacatccagcagctgggcaagttcaaggagccccacgccgccttctacgccgccgagatcgccatcggcctgttcttcctgcacaaccagggcatcatctacagagacctgaagctggacaacgtgatgctggacgccgagggccacatcaagatcaccgacttcggcatgtgcaaggagaacgtgttccccggcaccaccaccagaaccttctgcggcacccccgactacatcgcccccgagatcatcgcctaccagccctacggcaagagcgtggactggtggagcttcggcgtgctgctgtacgagatgctggccggccagccccccttcgacggcgaggacgaggaggagctgttccaggccatcatggagcagaccgtgacctaccccaagagcctgagcagagaggccgtggccatctgcaagggcttcctgaccaagcaccccggcaagagactgggcagcggccccgacggcgagcccaccatcagagcccacggcttcttcagatggatcgactgggagagactggagagactggagatccccccccccttcagacccagaccctgcggcagaagcggcgagaacttcgacaagttcttcaccagagccgcccccgccctgaccccccccgacagactggtgctggccagcatcgaccaggccgacttccagggcttcacctacgtgaaccccgacttcgtgcaccccgacgccagaagccccaccagccccgtgcccgtgcccgtgatcagctgcacccccgccttccagctgtgccccagaggcttctag

SEQ ID NO: 12352 - DNA, 1647 bp, Artificial Sequence
  Description of Artificial Sequence: Synthetic coding sequence
atgcccagaatctgcgacctgagagtgagcagaagatgggagggcccccccgacggcagatgcgagatgaacgtgcacagaagatgcgtgagaagcgtgcccagcctgtgcggcgtggaccacaccgagagaagaggcagactgcagctggagatcagagcccccaccgccgacgagatccacgtgaccgtgggcgaggccagaaacctgatccccatggaccccaacggcctgagcgacccctacgtgaagctgaagctgatccccgaccccagaaacctgaccaagcagaagaccagaaccgtgaaggccaccctgaaccccgtgtggaacgagaccttcgtgttcaacctgaagcccggcgacgtggagagaagactgagcgtggaggtgtgggactgggacagaaccagcagaaacgacttcatgggcgccatgagcttcggcgtgagcgagctgctgaaggcccccgtggacggctggtacaagctgctgaaccaggaggagggcgagtactacaacgtgcccgtggccgacgccgacaactgcagcctgctgcagaagttcgaggcctgcaactaccccctggagctgtacgagagagtgagaatgggccccagcagcagccccatccccagccccagccccagccccaccgaccccaagagatgcttcttcggcgccagccccggcagactgcacatcagcgacttcagcttcctgatggtgctgggcaagggcagcttcggcaaggtgatgctggccgagagaagaggcagcgacgagctgtacgccatcaagatcctgaagaaggacgtgatcgtgcaggacgacgacgtggactgcaccctggtggagaagagagtgctggccctgggcggcagaggccccggcggcagaccccacttcctgacccagctgcacagcaccttccagacccccgacagactgtacttcgtgatggagtacgtgaccggcggcgacctgatgtaccacatccagcagctgggcaagttcaaggagccccacgccgccttctacgccgccgagatcgccatcggcctgttcttcctgcacaaccagggcatcatctacagagacctgaagctggacaacgtgatgctggacgccgagggccacatcaagatcaccgacttcggcatgtgcaaggagaacgtgttccccggcaccaccaccagaaccttctgcggcacccccgactacatcgcccccgagatcatcgcctaccagccctacggcaagagcgtggactggtggagcttcggcgtgctgctgtacgagatgctggccggccagttcctgaccaagcaccccggcaagagactgggcagcggccccgacggcgagcccaccatcagagcccacggcttcttcagatggatcgactgggagagactggagagactggagatccccccccccttcagacccagaccctgcggcagaagcggcgagaacttcgacaagttcttcaccagagccgcccccgccctgaccccccccgacagactggtgctggccagcatcgaccaggccgacttccagggcttcacctacgtgaaccccgacttcgtgcaccccgacgccagaagccccaccagccccgtgcccgtgcccgtgatgtag

SEQ ID NO: 12353 - DNA, 1779 bp, Artificial Sequence
  Description of Artificial Sequence: Synthetic coding sequence
atgcccagcagaaccggccccaagatggagggcagcggcggcagagtgagactgaaggcccactacggcggcgacatcttcatcaccagcgtggacgccgccaccaccttcgaggagctgtgcgaggaggtgagagacatgtgcagactgcaccagcagcaccccctgaccctgaagtgggtggacagcgagggcgacccctgcaccgtgagcagccagatggagctggaggaggccttcagactggccagacagtgcagagacgagggcctgatcatccacgtgttccccagcacccccgagcagcccggcctgccctgccccggcgaggacaagagcatctacagaagaggcgccagaagatggagaaagctgtacagagccaacggccacctgttccaggccaagagattcaacagaagagcctactgcggccagtgcagcgagagaatctggggcctggccagacagggctacagatgcatcaactgcaagctgctggtgcacaagagatgccacggcctggtgcccctgacctgcagaaagcacatggacagcgtgatgcccagccaggagccccccgtggacgacaagaacgaggacgccgacctgcccagcgaggagaccgacggcatcgcctacatcagcagcagcagaaagcacgacagcatcaaggacgacagcgaggacctgaagcccgtgatcgacggcatggacggcatcaagatcagccagggcctgggcctgcaggacttcgacctgatcagagtgatcggcagaggcagctacgccaaggtgctgctggtgagactgaagaagaacgaccagatctacgccatgaaggtggtgaagaaggagctggtgcacgacgacgaggacatcgactgggtgcagaccgagaagcacgtgttcgagcaggccagcagcaaccccttcctggtgggcctgcacagctgcttccagaccaccagcagactgttcctggtgatcgagtacgtgaacggcggcgacctgatgttccacatgcagagacagagaaagctgcccgaggagcacgccagattctacgccgccgagatctgcatcgccctgaacttcctgcacgagagaggcatcatctacagagacctgaagctggacaacgtgctgctggacgccgacggccacatcaagctgaccgactacggcatgtgcaaggagggcctgggccccggcgacaccaccagcaccttctgcggcacccccaactacatcgcccccgagatcctgagaggcgaggagtacggcttcagcgtggactggtgggccctgggcgtgctgatgttcgagatgatggccggcagaagccccttcgacatcatcaccgacaaccccgacatgaacaccgaggactacctgttccaggtgatcctggagaagcccatcagaatccccagattcctgagcgtgaaggccagccacgtgctgaagggcttcctgaacaaggaccccaaggagagactgggctgcagaccccagaccggcttcagcgacatcaagagccacgccttcttcagaagcatcgactgggacctgctggagaagaagcaggccctgccccccttccagccccagatcaccgacgactacggcctggacaacttcgacacccagttcaccagcgagcccgtgcagctgacccccgacgacgaggacgccatcaagagaatcgaccagagcgagttcgagggcttcgagtacatcaaccccctgctgctgagcaccgaggagagcgtgtag

SEQ ID NO: 12354 - DNA, 1230 bp, Artificial Sequence
  Description of Artificial Sequence: Synthetic coding sequence
atggacagcgtgatgcccagccaggagccccccgtggacgacaagaacgaggacgccgacctgcccagcgaggagaccgacggcatcgcctacatcagcagcagcagaaagcacgacagcatcaaggacgacagcgaggacctgaagcccgtgatcgacggcatggacggcatcaagatcagccagggcctgggcctgcaggacttcgacctgatcagagtgatcggcagaggcagctacgccaaggtgctgctggtgagactgaagaagaacgaccagatctacgccatgaaggtggtgaagaaggagctggtgcacgacgacgaggacatcgactgggtgcagaccgagaagcacgtgttcgagcaggccagcagcaaccccttcctggtgggcctgcacagctgcttccagaccaccagcagactgttcctggtgatcgagtacgtgaacggcggcgacctgatgttccacatgcagagacagagaaagctgcccgaggagcacgccagattctacgccgccgagatctgcatcgccctgaacttcctgcacgagagaggcatcatctacagagacctgaagctggacaacgtgctgctggacgccgacggccacatcaagctgaccgactacggcatgtgcaaggagggcctgggccccggcgacaccaccagcaccttctgcggcacccccaactacatcgcccccgagatcctgagaggcgaggagtacggcttcagcgtggactggtgggccctgggcgtgctgatgttcgagatgatggccggcagaagccccttcgacatcatcaccgacaaccccgacatgaacaccgaggactacctgttccaggtgatcctggagaagcccatcagaatccccagattcctgagcgtgaaggccagccacgtgctgaagggcttcctgaacaaggaccccaaggagagactgggctgcagaccccagaccggcttcagcgacatcaagagccacgccttcttcagaagcatcgactgggacctgctggagaagaagcaggccctgccccccttccagccccagatcaccgacgactacggcctggacaacttcgacacccagttcaccagcgagcccgtgcagctgacccccgacgacgaggacgccatcaagagaatcgaccagagcgagttcgagggcttcgagtacatcaaccccctgctgctgagcaccgaggagagcgtgtag

SEQ ID NO: 12355 - DNA, 1230 bp, Artificial Sequence; identical to SEQ ID NO: 12354
  Description of Artificial Sequence: Synthetic coding sequence

SEQ ID NO: 12356 - DNA, 1467 bp, Artificial Sequence
  Description of Artificial Sequence: Synthetic coding sequence
atgctgacccccagaaccgacgagagcatctacagaagaggcgccagaagatggagaaagctgtacagagccaacggccacctgttccaggccaagagattcaacagaagagcctactgcggccagtgcagcgagagaatctggggcctggccagacagggctacagatgcatcaactgcaagctgctggtgcacaagagatgccacggcctggtgcccctgacctgcagaaagcacatggacagcgtgatgcccagccaggagccccccgtggacgacaagaacgaggacgccgacctgcccagcgaggagaccgacggcatcgcctacatcagcagcagcagaaagcacgacagcatcaaggacgacagcgaggacctgaagcccgtgatcgacggcatggacggcatcaagatcagccagggcctgggcctgcaggacttcgacctgatcagagtgatcggcagaggcagctacgccaaggtgctgctggtgagactgaagaagaacgaccagatctacgccatgaaggtggtgaagaaggagctggtgcacgacgacgaggacatcgactgggtgcagaccgagaagcacgtgttcgagcaggccagcagcaaccccttcctggtgggcctgcacagctgcttccagaccaccagcagactgttcctggtgatcgagtacgtgaacggcggcgacctgatgttccacatgcagagacagagaaagctgcccgaggagcacgccagattctacgccgccgagatctgcatcgccctgaacttcctgcacgagagaggcatcatctacagagacctgaagctggacaacgtgctgctggacgccgacggccacatcaagctgaccgactacggcatgtgcaaggagggcctgggccccggcgacaccaccagcaccttctgcggcacccccaactacatcgcccccgagatcctgagaggcgaggagtacggcttcagcgtggactggtgggccctgggcgtgctgatgttcgagatgatggccggcagaagccccttcgacatcatcaccgacaaccccgacatgaacaccgaggactacctgttccaggtgatcctggagaagcccatcagaatccccagattcctgagcgtgaaggccagccacgtgctgaagggcttcctgaacaaggaccccaaggagagactgggctgcagaccccagaccggcttcagcgacatcaagagccacgccttcttcagaagcatcgactgggacctgctggagaagaagcaggccctgccccccttccagccccagatcaccgacgactacggcctggacaacttcgacacccagttcaccagcgagcccgtgcagctgacccccgacgacgaggacgccatcaagagaatcgaccagagcgagttcgagggcttcgagtacatcaaccccctgctgctgagcaccgaggagagcgtgtag

SEQ ID NO: 12357 - DNA, 78 bp, Artificial Sequence
  Description of Artificial Sequence: Synthetic coding sequence
atggacagcgtgatgcccagccaggagccccccgtggacgacaagaacgaggacgccgacctgcccagcgaggagtag

SEQ ID NO: 12358 - DNA, 249 bp, Artificial Sequence
  Description of Artificial Sequence: Synthetic coding sequence
atggacagcgtgatgcccagccaggagccccccgtggacgacaagaacgaggacgccgacctgcccagcgaggagaccgacggcatcgcctacatcagcagcagcagaaagcacgacagcatcaaggacgacagcgaggacctgaagcccgtgatcgacggcatggacggcatcaagatcagccagggcctgggcctgcaggacttcgacctgatcagagtgatcggcagaggcagctacgccaagtag

SEQ ID NO: 12359 - DNA, 297 bp, Artificial Sequence
  Description of Artificial Sequence: Synthetic coding sequence
atggacagcgtgatgcccagccaggagccccccgtggacgacaagaacgaggacgccgacctgcccagcgaggagaccgacggcatcgcctacatcagcagcagcagaaagcacgacagcatcaaggacgacagcgaggacctgaagcccgtgatcgacggcatggacggcatcaagatcagccagggcctgggcctgcaggacttcgacctgatcagagtgatcggcagaggcagctacgccaaggtgctgctggtgagactgaagaagaacgaccagatctacgccatgaagtag

SEQ ID NO: 12360 - DNA, 330 bp, Artificial Sequence
  Description of Artificial Sequence: Synthetic coding sequence
atggacagcgtgatgcccagccaggagccccccgtggacgacaagaacgaggacgccgacctgcccagcgaggagaccgacggcatcgcctacatcagcagcagcagaaagcacgacagcatcaaggacgacagcgaggacctgaagcccgtgatcgacggcatggacggcatcaagatcagccagggcctgggcctgcaggacttcgacctgatcagagtgatcggcagaggcagctacgccaaggtgctgctggtgagactgaagaagaacgaccagatctacgccatgaaggtggtgaagaaggagctggtgcacgacgacgagtag

SEQ ID NO: 12361 - DNA, 141 bp, Artificial Sequence
  Description of Artificial Sequence: Synthetic coding sequence
atggacagcgtgatgcccagccaggagccccccgtggacgacaagaacgaggacgccgacctgcccagcgaggagaccgacggcatcgcctacatcagcagcagcagaaagcacgacagcatcaaggacgacagcgagtag

SEQ ID NO: 12362 - DNA, 222 bp, Artificial Sequence
  Description of Artificial Sequence: Synthetic coding sequence
atggacagcgtgatgcccagccaggagccccccgtggacgacaagaacgaggacgccgacctgcccagcgaggagaccgacggcatcgcctacatcagcagcagcagaaagcacgacagcatcaaggacgacagcgaggacctgaagcccgtgatcgacggcatggacggcatcaagatcagccagggcctgggcctgcaggacttcgacctgatcagatag

SEQ ID NO: 12363 - DNA, 66 bp, Artificial Sequence
  Description of Artificial Sequence: Synthetic coding sequence
atggacagcgtgatgcccagccaggagccccccgtggacgacaagaacgaggacgccgacctgtag

SEQ ID NO: 12364 - DNA, 216 bp, Artificial Sequence
  Description of Artificial Sequence: Synthetic coding sequence
atggacagcgtgatgcccagccaggagccccccgtggacgacaagaacgaggacgccgacctgcccagcgaggagaccgacggcatcgcctacatcagcagcagcagaaagcacgacagcatcaaggacgacagcgaggacctgaagcccgtgatcgacggcatggacggcatcaagatcagccagggcctgggcctgcaggacttcgacctgtag

SEQ ID NO: 12365 - DNA, 417 bp, Artificial Sequence
  Description of Artificial Sequence: Synthetic coding sequence
atgatcagcctgaccgacacccagaagatcggcatgggcctgaccggcttcggcgtgttcttcctgttcttcggcatgatcctgttcttcgacaaggccctgctggccatcggcaacgtgctgttcgtggccggcctggccttcgtgatcggcctggagagaaccttcagattcttcttccagaagcacaagatgaaggccaccggcttcttcctgggcggcgtgttcgtggtgctgatcggctggcccctgatcggcatgatcttcgagatctacggcttcttcctgctgttcagaggcttcttccccgtggtggtgggcttcatcagaagagtgcccgtgctgggcagcctgctgaacctgcccggcatcagaagcttcgtggacaaggtgggcgagagcaacaacatggtgtag

SEQ ID NO: 12366 - DNA, 702 bp, Artificial Sequence
  Description of Artificial Sequence: Synthetic coding sequence
atggacagccccgaggacgccgacctgttccacagcgaggagatcaaggcccccgagaaggaggagttcctggcctggcagcacgacctggaggtgaacgacaaggcccccgcccaggccagacccaccgtgttcagatggaccggcggcggcaaggaggtgtacctgagcggcagcttcaacaactggagcaagctgcccctgaccagaagccacaacaacttcgtggccatcctggacctgcccgagggcgagcaccagtacaagttcttcgtggacggccagtggacccacgaccccagcgagcccatcgtgaccagccagctgggcaccgtgaacaacatcatccaggtgaagaagaccgacttcgaggtgttcgacgccctgatggtggacagccagaagtgcagcgacgtgagcgagctgagcagcagcccccccggcccctaccaccaggagccctacgtgtgcaagcccgaggagagattcagagccccccccatcctgcccccccacctgctgcaggtgatcctgaacaaggacaccggcatcagctgcgaccccgccctgctgcccgagcccaaccacgtgatgctgaaccacctgtacgccctgagcatcaaggacggcgtgatggtgctgagcgccacccacagatacaagaagaagtacgtgaccaccctgctgtacaagcccatctag

SEQ ID NO: 12367 - DNA, 813 bp, Artificial Sequence
  Description of Artificial Sequence: Synthetic coding sequence
atgggcaacaccagcagcgagagagccgccctggagagacacggcggccacaagacccccagaagagacagcagcggcggcaccaaggacggcgacagacccaagatcctgatggacagccccgaggacgccgacctgttccacagcgaggagatcaaggcccccgagaaggaggagttcctggcctggcagcacgacctggaggtgaacgacaaggcccccgcccaggccagacccaccgtgttcagatggaccggcggcggcaaggaggtgtacctgagcggcagcttcaacaactggagcaagctgcccctgaccagaagccacaacaacttcgtggccatcctggacctgcccgagggcgagcaccagtacaagttcttcgtggacggccagtggacccacgaccccagcgagcccatcgtgaccagccagctgggcaccgtgaacaacatcatccaggtgaagaagaccgacttcgaggtgttcgacgccctgatggtggacagccagaagtgcagcgacgtgagcgagctgagcagcagcccccccggcccctaccaccaggagccctacgtgtgcaagcccgaggagagattcagagccccccccatcctgcccccccacctgctgcaggtgatcctgaacaaggacaccggcatcagctgcgaccccgccctgctgcccgagcccaaccacgtgatgctgaaccacctgtacgccctgagcatcaaggacggcgtgatggtgctgagcgccacccacagatacaagaagaagtacgtgaccaccctgctgtacaagcccatctag

SEQ ID NO: 12368 - DNA, 12384 bp, Artificial Sequence
  Description of Artificial Sequence: Synthetic coding sequence
atggccggcagcggcgccggcgtgagatgcagcctgctgagactgcaggagaccctgagcgccgccgacagatgcggcgccgccctggccggccaccagctgatcagaggcctgggccaggagtgcgtgctgagcagcagccccgccgtgctggccctgcagaccagcctggtgttcagcagagacttcggcctgctggtgttcgtgagaaagagcctgaacagcatcgagttcagagagtgcagagaggagatcctgaagttcctgtgcatcttcctggagaagatgggccagaagatcgccccctacagcgtggagatcaagaacacctgcaccagcgtgtacaccaaggacagagccgccaagtgcaagatccccgccctggacctgctgatcaagctgctgcagaccttcagaagcagcagactgatggacgagttcaagatcggcgagctgttcagcaagttctacggcgagctggccctgaagaagaagatccccgacaccgtgctggagaaggtgtacgagctgctgggcctgctgggcgaggtgcaccccagcgagatgatcaacaacgccgagaacctgttcagagccttcctgggcgagctgaagacccagatgaccagcgccgtgagagagcccaagctgcccgtgctggccggctgcctgaagggcctgagcagcctgctgtgcaacttcaccaagagcatggaggaggacccccagaccagcagagagatcttcaacttcgtgctgaaggccatcagaccccagatcgacctgaagagatacgccgtgcccagcgccggcctgagactgttcgccctgcacgccagccagttcagcacctgcctgctggacaactacgtgagcctgttcgaggtgctgctgaagtggtgcgcccacaccaacgtggagctgaagaaggccgccctgagcgccctggagagcttcctgaagcaggtgagcaacatggtggccaagaacgccgagatgcacaagaacaagctgcagtacttcatggagcagttctacggcatcatcagaaacgtggacagcaacaacaaggagctgagcatcgccatcagaggctacggcctgttcgccggcccctgcaaggtgatcaacgccaaggacgtggacttcatgtacgtggagctgatccagagatgcaagcagatgttcctgacccagaccgacaccggcgacgacagagtgtaccagatgcccagcttcctgcagagcgtggccagcgtgctgctgtacctggacaccgtgcccgaggtgtacacccccgtgctggagcacctggtggtgatgcagatcgacagcttcccccagtacagccccaagatgcagctggtgtgctgcagagccatcgtgaaggtgttcctggccctggccgccaagggccccgtgctgagaaactgcatcagcaccgtggtgcaccagggcctgatcagaatctgcagcaagcccgtggtgctgcccaagggccccgagagcgagagcgaggaccacagagccagcggcgaggtgagaaccggcaagtggaaggtgcccacctacaaggactacgtggacctgttcagacacctgctgagcagcgaccagatgatggacagcatcctggccgacgaggccttcttcagcgtgaacagcagcagcgagagcctgaaccacctgctgtacgacgagttcgtgaagagcgtgctgaagatcgtggagaagctggacctgaccctggagatccagaccgtgggcgagcaggagaacggcgacgaggcccccggcgtgtggatgatccccaccagcgaccccgccgccaacctgcaccccgccaagcccaaggacttcagcgccttcatcaacctggtggagttctgcagagagatcctgcccgagaagcaggccgagttcttcgagccctgggtgtacagcttcagctacgagctgatcctgcagagcaccagactgcccctgatcagcggcttctacaagctgctgagcatcaccgtgagaaacgccaagaagatcaagtacttcgagggcgtgagccccaagagcctgaagcacagccccgaggaccccgagaagtacagctgcttcgccctgttcgtgaagttcggcaaggaggtggccgtgaagatgaagcagtacaaggacgagctgctggccagctgcctgaccttcctgctgagcctgccccacaacatcatcgagctggacgtgagagcctacgtgcccgccctgcagatggccttcaagctgggcctgagctacacccccctggccgaggtgggcctgaacgccctggaggagtggagcatctacatcgacagacacgtgatgcagccctactacaaggacatcctgccctgcctggacggctacctgaagaccagcgccctgagcgacgagaccaagaacaactgggaggtgagcgccctgagcagagccgcccagaagggcttcaacaaggtggtgctgaagcacctgaagaagaccaagaacctgagcagcaacgaggccatcagcctggaggagatcagaatcagagtggtgcagatgctgggcagcctgggcggccagatcaacaagaacctgctgaccgtgaccagcagcgacgagatgatgaagagctacgtggcctgggacagagagaagagactgagcttcgccgtgcccttcagagagatgaagcccgtgatcttcctggacgtgttcctgcccagagtgaccgagctggccctgaccgccagcgacagacagaccaaggtggccgcctgcgagctgctgcacagcatggtgatgttcatgctgggcaaggccacccagatgcccgagggcggccagggcgccccccccatgtaccagctgtacaagagaaccttccccgtgctgctgagactggcctgcgacgtggaccaggtgaccagacagctgtacgagcccctggtgatgcagctgatccactggttcaccaacaacaagaagttcgagagccaggacaccgtggccctgctggaggccatcctggacggcatcgtggaccccgtggacagcaccctgagagacttctgcggcagatgcatcagagagttcctgaagtggagcatcaagcagatcaccccccagcagcaggagaagagccccgtgaacaccaagagcctgttcaagagactgtacagcctggccctgcaccccaacgccttcaagagactgggcgccagcctggccttcaacaacatctacagagagttcagagaggaggagagcctggtggagcagttcgtgttcgaggccctggtgatctacatggagagcctggccctggcccacgccgacgagaagagcctgggcaccatccagcagtgctgcgacgccatcgaccacctgtgcagaatcatcgagaagaagcacgtgagcctgaacaaggccaagaagagaagactgcccagaggcttcccccccagcgccagcctgtgcctgctggacctggtgaagtggctgctggcccactgcggcagaccccagaccgagtgcagacacaagagcatcgagctgttctacaagttcgtgcccctgctgcccggcaacagaagccccaacctgtggctgaaggacgtgctgaaggaggagggcgtgagcttcctgatcaacaccttcgagggcggcggctgcggccagcccagcggcatcctggcccagcccaccctgctgtacagaggccccttcagcctgcaggccaccctgtgctggctggacctgctgctggccgccctggagtgctacaacaccttcatcggcgagagaaccgtgggcgccctgcaggtgctgggcaccgaggcccagagcagcctgctgaaggccgtggccttcttcctggagagcatcgccatgcacgacatcatcgccgccgagaagtgcttcggcaccggcgccgccggcaacagaaccagcccccaggagggcgagagatacaactacagcaagtgcaccgtggtggtgagaatcatggagttcaccaccaccctgctgaacaccagccccgagggctggaagctgctgaagaaggacctgtgcaacacccacctgatgagagtgctggtgcagaccctgtgcgagcccgccagcatcggcttcaacatcggcgacgtgcaggtgatggcccacctgcccgacgtgtgcgtgaacctgatgaaggccctgaagatgagcccctacaaggacatcctggagacccacctgagagagaagatcaccgcccagagcatcgaggagctgtgcgccgtgaacctgtacggccccgacgcccaggtggacagaagcagactggccgccgtggtgagcgcctgcaagcagctgcacagagccggcctgctgcacaacatcctgcccagccagagcaccgacctgcaccacagcgtgggcaccgagctgctgagcctggtgtacaagggcatcgcccccggcgacgagagacagtgcctgcccagcctggacctgagctgcaagcagctggccagcggcctgctggagctggccttcgccttcggcggcctgtgcgagagactggtgagcctgctgctgaaccccgccgtgctgagcaccgccagcctgggcagcagccagggcagcgtgatccacttcagccacggcgagtacttctacagcctgttcagcgagaccatcaacaccgagctgctgaagaacctggacctggccgtgctggagctgatgcagagcagcgtggacaacaccaagatggtgagcgccgtgctgaacggcatgctggaccagagcttcagagagagagccaaccagaagcaccagggcctgaagctggccaccaccatcctgcagcactggaagaagtgcgacagctggtgggccaaggacagccccctggagaccaagatggccgtgctggccctgctggccaagatcctgcagatcgacagcagcgtgagcttcaacaccagccacggcagcttccccgaggtgttcaccacctacatcagcctgctggccgacaccaagctggacctgcacctgaagggccaggccgtgaccctgctgcccttcttcaccagcctgaccggcggcagcctggaggagctgagaagagtgctggagcagctgatcgtggcccacttccccatgcagagcagagagttcccccccggcacccccagattcaacaactacgtggactgcatgaagaagttcctggacgccctggagctgagccagagccccatgctgctggagctgatgaccgaggtgctgtgcagagagcagcagcacgtgatggaggagctgttccagagcagcttcagaagaatcgccagaagaggcagctgcgtgacccaggtgggcctgctggagagcgtgtacgagatgttcagaaaggacgaccccagactgagcttcaccagacagagcttcgtggacagaagcctgctgaccctgctgtggcactgcagcctggacgccctgagagagttcttcagcaccatcgtggtggacgccatcgacgtgctgaagagcagattcaccaagctgaacgagagcaccttcgacacccagatcaccaagaagatgggctactacaagatcctggacgtgatgtacagcagactgcccaaggacgacgtgcacgccaaggagagcaagatcaaccaggtgttccacggcagctgcatcaccgagggcaacgagctgaccaagaccctgatcaagctgtgctacgacgccttcaccgagaacatggccggcgagaaccagctgctggagagaagaagactgtaccactgcgccgcctacaactgcgccatcagcgtgatctgctgcgtgttcaacgagctgaagttctaccagggcttcctgttcagcgagaagcccgagaagaacctgctgatcttcgagaacctgatcgacctgaagagaagatacaacttccccgtggaggtggaggtgcccatggagagaaagaagaagtacatcgagatcagaaaggaggccagagaggccgccaacggcgacagcgacggccccagctacatgagcagcctgagctacctggccgacagcaccctgagcgaggagatgagccagttcgacttcagcaccggcgtgcagagctacagctacagcagccaggaccccagacccgccaccggcagattcagaagaagagagcagagagaccccaccgtgcacgacgacgtgctggagctggagatggacgagctgaacagacacgagtgcatggcccccctgaccgccctggtgaagcacatgcacagaagcctgggccccccccagggcgaggaggacagcgtgcccagagacctgcccagctggatgaagttcctgcacggcaagctgggcaaccccatcgtgcccctgaacatcagactgttcctggccaagctggtgatcaacaccgaggaggtgttcagaccctacgccaagcactggctgagccccctgctgcagctggccgccagcgagaacaacggcggcgagggcatccactacatggtggtggagatcgtggccaccatcctgagctggaccggcctggccacccccaccggcgtgcccaaggacgaggtgctggccaacagactgctgaacttcctgatgaagcacgtgttccaccccaagagagccgtgttcagacacaacctggagatcatcaagaccctggtggagtgctggaaggactgcctgagcatcccctacagactgatcttcgagaagttcagcggcaaggaccccaacagcaaggacaacagcgtgggcatccagctgctgggcatcgtgatggccaacgacctgcccccctacgacccccagtgcggcatccagagcagcgagtacttccaggccctggtgaacaacatgagcttcgtgagatacaaggaggtgtacgccgccgccgccgaggtgctgggcctgatcctgagatacgtgatggagagaaagaacatcctggaggagagcctgtgcgagctggtggccaagcagctgaagcagcaccagaacaccatggaggacaagttcatcgtgtgcctgaacaaggtgaccaagagcttcccccccctggccgacagattcatgaacgccgtgttcttcctgctgcccaagttccacggcgtgctgaagaccctgtgcctggaggtggtgctgtgcagagtggagggcatgaccgagctgtacttccagctgaagagcaaggacttcgtgcaggtgatgagacacagagacgacgagagacagaaggtgtgcctggacatcatctacaagatgatgcccaagctgaagcccgtggagctgagagagctgctgaaccccgtggtggagttcgtgagccaccccagcaccacctgcagagagcagatgtacaacatcctgatgtggatccacgacaactacagagaccccgagagcgagaccgacaacgacagccaggagatcttcaagctggccaaggacgtgctgatccagggcctgatcgacgagaaccccggcctgcagctgatcatcagaaacttctggagccacgagaccagactgcccagcaacaccctggacagactgctggccctgaacagcctgtacagccccaagatcgaggtgcacttcctgagcctggccaccaacttcctgctggagatgaccagcatgagccccgactaccccaaccccatgttcgagcaccccctgagcgagtgcgagttccaggagtacaccatcgacagcgactggagattcagaagcaccgtgctgacccccatgttcgtggagacccaggccagccagggcaccctgcagaccagaacccaggagggcagcctgagcgccagatggcccgtggccggccagatcagagccacccagcagcagcacgacttcaccctgacccagaccgccgacggcagaagcagcttcgactggctgaccggcagcagcaccgaccccctggtggaccacaccagccccagcagcgacagcctgctgttcgcccacaagagaagcgagagactgcagagagcccccctgaagagcgtgggccccgacttcggcaagaagagactgggcctgcccggcgacgaggtggacaacaaggtgaagggcgccgccggcagaaccgacctgctgagactgagaagaagattcatgagagaccaggagaagctgagcctgatgtacgccagaaagggcgtggccgagcagaagagagagaaggagatcaagagcgagctgaagatgaagcaggacgcccaggtggtgctgtacagaagctacagacacggcgacctgcccgacatccagatcaagcacagcagcctgatcacccccctgcaggccgtggcccagagagaccccatcatcgccaagcagctgttcagcagcctgttcagcggcatcctgaaggagatggacaagttcaagaccctgagcgagaagaacaacatcacccagaagctgctgcaggacttcaacagattcctgaacaccaccttcagcttcttcccccccttcgtgagctgcatccaggacatcagctgccagcacgccgccctgctgagcctggaccccgccgccgtgagcgccggctgcctggccagcctgcagcagcccgtgggcatcagactgctggaggaggccctgctgagactgctgcccgccgagctgcccgccaagagagtgagaggcaaggccagactgccccccgacgtgctgagatgggtggagctggccaagctgtacagaagcatcggcgagtacgacgtgctgagaggcatcttcaccagcgagatcggcaccaagcagatcacccagagcgccctgctggccgaggccagaagcgactacagcgaggccgccaagcagtacgacgaggccctgaacaagcaggactgggtggacggcgagcccaccgaggccgagaaggacttctgggagctggccagcctggactgctacaaccacctggccgagtggaagagcctggagtactgcagcaccgccagcatcgacagcgagaacccccccgacctgaacaagatctggagcgagcccttctaccaggagacctacctgccctacatgatcagaagcaagctgaagctgctgctgcagggcgaggccgaccagagcctgctgaccttcatcgacaaggccatgcacggcgagctgcagaaggccatcctggagctgcactacagccaggagctgagcctgctgtacctgctgcaggacgacgtggacagagccaagtactacatccagaacggcatccagagcttcatgcagaactacagcagcatcgacgtgctgctgcaccagagcagactgaccaagctgcagagcgtgcaggccctgaccgagatccaggagttcatcagcttcatcagcaagcagggcaacctgagcagccaggtgcccctgaagagactgctgaacacctggaccaacagataccccgacgccaagatggaccccatgaacatctgggacgacatcatcaccaacagatgcttcttcctgagcaagatcgaggagaagctgacccccctgcccgaggacaacagcatgaacgtggaccaggacggcgaccccagcgacagaatggaggtgcaggagcaggaggaggacatcagcagcctgatcagaagctgcaagttcagcatgaagatgaagatgatcgacagcgccagaaagcagaacaacttcagcctggccatgaagctgctgaaggagctgcacaaggagagcaagaccagagacgactggctggtgagctgggtgcagagctactgcagactgagccactgcagaagcagaagccagggctgcagcgagcaggtgctgaccgtgctgaagaccgtgagcctgctggacgagaacaacgtgagcagctacctgagcaagaacatcctggccttcagagaccagaacatcctgctgggcaccacctacagaatcatcgccaacgccctgagcagcgagcccgcctgcctggccgagatcgaggaggacaaggccagaagaatcctggagctgagcggcagcagcagcgaggacagcgagaaggtgatcgccggcctgtaccagagagccttccagcacctgagcgaggccgtgcaggccgccgaggaggaggcccagccccccagctggagctgcggccccgccgccggcgtgatcgacgcctacatgaccctggccgacttctgcgaccagcagctgagaaaggaggaggagaacgccagcgtgatcgacagcgccgagctgcaggcctaccccgccctggtggtggagaagatgctgaaggccctgaagctgaacagcaacgaggccagactgaagttccccagactgctgcagatcatcgagagataccccgaggagaccctgagcctgatgaccaaggagatcagcagcgtgccctgctggcagttcatcagctggatcagccacatggtggccctgctggacaaggaccaggccgtggccgtgcagcacagcgtggaggagatcaccgacaactacccccaggccatcgtgtaccccttcatcatcagcagcgagagctacagcttcaaggacaccagcaccggccacaagaacaaggagttcgtggccagaatcaagagcaagctggaccagggcggcgtgatccaggacttcatcaacgccctggaccagctgagcaaccccgagctgctgttcaaggactggagcaacgacgtgagagccgagctggccaagacccccgtgaacaagaagaacatcgagaagatgtacgagagaatgtacgccgccctgggcgaccccaaggcccccggcctgggcgccttcagaagaaagttcatccagaccttcggcaaggagttcgacaagcacttcggcaagggcggcagcaagctgctgagaatgaagctgagcgacttcaacgacatcaccaacatgctgctgctgaagatgaacaaggacagcaagccccccggcaacctgaaggagtgcagcccctggatgagcgacttcaaggtggagttcctgagaaacgagctggagatccccggccagtacgacggcagaggcaagcccctgcccgagtaccacgtgagaatcgccggcttcgacgagagagtgaccgtgatggccagcctgagaagacccaagagaatcatcatcagaggccacgacgagagagagcaccccttcctggtgaagggcggcgaggacctgagacaggaccagagagtggagcagctgttccaggtgatgaacggcatcctggcccaggacagcgcctgcagccagagagccctgcagctgagaacctacagcgtggtgcccatgaccagcagactgggcctgatcgagtggctggagaacaccgtgaccctgaaggacctgctgctgaacaccatgagccaggaggagaaggccgcctacctgagcgaccccagagcccccccctgcgagtacaaggactggctgaccaagatgagcggcaagcacgacgtgggcgcctacatgctgatgtacaagggcgccaacagaaccgagaccgtgaccagcttcagaaagagagagagcaaggtgcccgccgacctgctgaagagagccttcgtgagaatgagcaccagccccgaggccttcctggccctgagaagccacttcgccagcagccacgccctgatctgcatcagccactggatcctgggcatcggcgacagacacctgaacaacttcatggtggccatggagaccggcggcgtgatcggcatcgacttcggccacgccttcggcagcgccacccagttcctgcccgtgcccgagctgatgcccttcagactgaccagacagttcatcaacctgatgctgcccatgaaggagaccggcctgatgtacagcatcatggtgcacgccctgagagccttcagaagcgaccccggcctgctgaccaacaccatggacgtgttcgtgaaggagcccagcttcgactggaagaacttcgagcagaagatgctgaagaagggcggcagctggatccaggagatcaacgtggccgagaagaactggtaccccagacagaagatctgctacgccaagagaaagctggccggcgccaaccccgccgtgatcacctgcgacgagctgctgctgggccacgagaaggcccccgccttcagagactacgtggccgtggccagaggcagcaaggaccacaacatcagagcccaggagcccgagagcggcctgagcgaggagacccaggtgaagtgcctgatggaccaggccaccgaccccaacatcctgggcagaacctgggagggctgggagccctggatgtag

SEQ ID NO: 12369 - DNA, 12291 bp, Artificial Sequence
  Description of Artificial Sequence: Synthetic coding sequence
atggccggcagcggcgccggcgtgagatgcagcctgctgagactgcaggagaccctgagcgccgccgacagatgcggcgccgccctggccggccaccagctgatcagaggcctgggccaggagtgcgtgctgagcagcagccccgccgtgctggccctgcagaccagcctggtgttcagcagagacttcggcctgctggtgttcgtgagaaagagcctgaacagcatcgagttcagagagtgcagagaggagatcctgaagttcctgtgcatcttcctggagaagatgggccagaagatcgccccctacagcgtggagatcaagaacacctgcaccagcgtgtacaccaaggacagagccgccaagtgcaagatccccgccctggacctgctgatcaagctgctgcagaccttcagaagcagcagactgatggacgagttcaagatcggcgagctgttcagcaagttctacggcgagctggccctgaagaagaagatccccgacaccgtgctggagaaggtgtacgagctgctgggcctgctgggcgaggtgcaccccagcgagatgatcaacaacgccgagaacctgttcagagccttcctgggcgagctgaagacccagatgaccagcgccgtgagagagcccaagctgcccgtgctggccggctgcctgaagggcctgagcagcctgctgtgcaacttcaccaagagcatggaggaggacccccagaccagcagagagatcttcaacttcgtgctgaaggccatcagaccccagatcgacctgaagagatacgccgtgcccagcgccggcctgagactgttcgccctgcacgccagccagttcagcacctgcctgctggacaactacgtgagcctgttcgaggtgctgctgaagtggtgcgcccacaccaacgtggagctgaagaaggccgccctgagcgccctggagagcttcctgaagcaggtgagcaacatggtggccaagaacgccgagatgcacaagaacaagctgcagtacttcatggagcagttctacggcatcatcagaaacgtggacagcaacaacaaggagctgagcatcgccatcagaggctacggcctgttcgccggcccctgcaaggtgatcaacgccaaggacgtggacttcatgtacgtggagctgatccagagatgcaagcagatgttcctgacccagaccgacaccggcgacgacagagtgtaccagatgcccagcttcctgcagagcgtggccagcgtgctgctgtacctggacaccgtgcccgaggtgtacacccccgtgctggagcacctggtggtgatgcagatcgacagcttcccccagtacagccccaagatgcagctggtgtgctgcagagccatcgtgaaggtgttcctggccctggccgccaagggccccgtgctgagaaactgcatcagcaccgtggtgcaccagggcctgatcagaatctgcagcaagcccgtggtgctgcccaagggccccgagagcgagagcgaggaccacagagccagcggcgaggtgagaaccggcaagtggaaggtgcccacctacaaggactacgtggacctgttcagacacctgctgagcagcgaccagatgatggacagcatcctggccgacgaggccttcttcagcgtgaacagcagcagcgagagcctgaaccacctgctgtacgacgagttcgtgaagagcgtgctgaagatcgtggagaagctggacctgaccctggagatccagaccgtgggcgagcaggagaacggcgacgaggcccccggcgtgtggatgatccccaccagcgaccccgccgccaacctgcaccccgccaagcccaaggacttcagcgccttcatcaacctggtggagttctgcagagagatcctgcccgagaagcaggccgagttcttcgagccctgggtgtacagcttcagctacgagctgatcctgcagagcaccagactgcccctgatcagcggcttctacaagctgctgagcatcaccgtgagaaacgccaagaagatcaagtacttcgagggcgtgagccccaagagcctgaagcacagccccgaggaccccgagaagtacagctgcttcgccctgttcgtgaagttcggcaaggaggtggccgtgaagatgaagcagtacaaggacgagctgctggccagctgcctgaccttcctgctgagcctgccccacaacatcatcgagctggacgtgagagcctacgtgcccgccctgcagatggccttcaagctgggcctgagctacacccccctggccgaggtgggcctgaacgccctggaggagtggagcatctacatcgacagacacgtgatgcagccctactacaaggacatcctgccctgcctggacggctacctgaagaccagcgccctgagcgacgagaccaagaacaactgggaggtgagcgccctgagcagagccgcccagaagggcttcaacaaggtggtgctgaagcacctgaagaagaccaagaacctgagcagcaacgaggccatcagcctggaggagatcagaatcagagtggtgcagatgctgggcagcctgggcggccagatcaacaagaacctgctgaccgtgaccagcagcgacgagatgatgaagagctacgtggcctgggacagagagaagagactgagcttcgccgtgcccttcagagagatgaagcccgtgatcttcctggacgtgttcctgcccagagtgaccgagctggccctgaccgccagcgacagacagaccaaggtggccgcctgcgagctgctgcacagcatggtgatgttcatgctgggcaaggccacccagatgcccgagggcggccagggcgccccccccatgtaccagctgtacaagagaaccttccccgtgctgctgagactggcctgcgacgtggaccaggtgaccagacagctgtacgagcccctggtgatgcagctgatccactggttcaccaacaacaagaagttcgagagccaggacaccgtggccctgctggaggccatcctggacggcatcgtggaccccgtggacagcaccctgagagacttctgcggcagatgcatcagagagttcctgaagtggagcatcaagcagatcaccccccagcagcaggagaagagccccgtgaacaccaagagcctgttcaagagactgtacagcctggccctgcaccccaacgccttcaagagactgggcgccagcctggccttcaacaacatctacagagagttcagagaggaggagagcctggtggagcagttcgtgttcgaggccctggtgatctacatggagagcctggccctggcccacgccgacgagaagagcctgggcaccatccagcagtgctgcgacgccatcgaccacctgtgcagaatcatcgagaagaagcacgtgagcctgaacaaggccaagaagagaagactgcccagaggcttcccccccagcgccagcctgtgcctgctggacctggtgaagtggctgctggcccactgcggcagaccccagaccgagtgcagacacaagagcatcgagctgttctacaagttcgtgcccctgctgcccggcaacagaagccccaacctgtggctgaaggacgtgctgaaggaggagggcgtgagcttcctgatcaacaccttcgagggcggcggctgcggccagcccagcggcatcctggcccagcccaccctgctgtacagaggccccttcagcctgcaggccaccctgtgctggctggacctgctgctggccgccctggagtgctacaacaccttcatcggcgagagaaccgtgggcgccctgcaggtgctgggcaccgaggcccagagcagcctgctgaaggccgtggccttcttcctggagagcatcgccatgcacgacatcatcgccgccgagaagtgcttcggcaccggcgccgccggcaacagaaccagcccccaggagggcgagagatacaactacagcaagtgcaccgtggtggtgagaatcatggagttcaccaccaccctgctgaacaccagccccgagggctggaagctgctgaagaaggacctgtgcaacacccacctgatgagagtgctggtgcagaccctgtgcgagcccgccagcatcggcttcaacatcggcgacgtgcaggtgatggcccacctgcccgacgtgtgcgtgaacctgatgaaggccctgaagatgagcccctacaaggacatcctggagacccacctgagagagaagatcaccgcccagagcatcgaggagctgtgcgccgtgaacctgtacggccccgacgcccaggtggacagaagcagactggccgccgtggtgagcgcctgcaagcagctgcacagagccggcctgctgcacaacatcctgcccagccagagcaccgacctgcaccacagcgtgggcaccgagctgctgagcctggtgtacaagggcatcgcccccggcgacgagagacagtgcctgcccagcctggacctgagctgcaagcagctggccagcggcctgctggagctggccttcgccttcggcggcctgtgcgagagactggtgagcctgctgctgaaccccgccgtgctgagcaccgccagcctgggcagcagccagggcagcgtgatccacttcagccacggcgagtacttctacagcctgttcagcgagaccatcaacaccgagctgctgaagaacctggacctggccgtgctggagctgatgcagagcagcgtggacaacaccaagatggtgagcgccgtgctgaacggcatgctggaccagagcttcagagagagagccaaccagaagcaccagggcctgaagctggccaccaccatcctgcagcactggaagaagtgcgacagctggtgggccaaggacagccccctggagaccaagatggccgtgctggccctgctggccaagatcctgcagatcgacagcagcgtgagcttcaacaccagccacggcagcttccccgaggtgttcaccacctacatcagcctgctggccgacaccaagctggacctgcacctgaagggccaggccgtgaccctgctgcccttcttcaccagcctgaccggcggcagcctggaggagctgagaagagtgctggagcagctgatcgtggcccacttccccatgcagagcagagagttcccccccggcacccccagattcaacaactacgtggactgcatgaagaagttcctggacgccctggagctgagccagagccccatgctgctggagctgatgaccgaggtgctgtgcagagagcagcagcacgtgatggaggagctgttccagagcagcttcagaagaatcgccagaagaggcagctgcgtgacccaggtgggcctgctggagagcgtgtacgagatgttcagaaaggacgaccccagactgagcttcaccagacagagcttcgtggacagaagcctgctgaccctgctgtggcactgcagcctggacgccctgagagagttcttcagcaccatcgtggtggacgccatcgacgtgctgaagagcagattcaccaagctgaacgagagcaccttcgacacccagatcaccaagaagatgggctactacaagatcctggacgtgatgtacagcagactgcccaaggacgacgtgcacgccaaggagagcaagatcaaccaggtgttccacggcagctgcatcaccgagggcaacgagctgaccaagaccctgatcaagctgtgctacgacgccttcaccgagaacatggccggcgagaaccagctgctggagagaagaagactgtaccactgcgccgcctacaactgcgccatcagcgtgatctgctgcgtgttcaacgagctgaagttctaccagggcttcctgttcagcgagaagcccgagaagaacctgctgatcttcgagaacctgatcgacctgaagagaagatacaacttccccgtggaggtggaggtgcccatggagagaaagaagaagtacatcgagatcagaaaggaggccagagaggccgccaacggcgacagcgacggccccagctacatgagcagcctgagctacctggccgacagcaccctgagcgaggagatgagccagttcgacttcagcaccggcgtgcagagctacagctacagcagccaggaccccagacccgccaccggcagattcagaagaagagagcagagagaccccaccgtgcacgacgacgtgctggagctggagatggacgagctgaacagacacgagtgcatggcccccctgaccgccctggtgaagcacatgcacagaagcctgggccccccccagggcgaggaggacagcgtgcccagagacctgcccagctggatgaagttcctgcacggcaagctgggcaaccccatcgtgcccctgaacatcagactgttcctggccaagctggtgatcaacaccgaggaggtgttcagaccctacgccaagcactggctgagccccctgctgcagctggccgccagcgagaacaacggcggcgagggcatccactacatggtggtggagatcgtggccaccatcctgagctggaccggcctggccacccccaccggcgtgcccaaggacgaggtgctggccaacagactgctgaacttcctgatgaagcacgtgttccaccccaagagagccgtgttcagacacaacctggagatcatcaagaccctggtggagtgctggaaggactgcctgagcatcccctacagactgatcttcgagaagttcagcggcaaggaccccaacagcaaggacaacagcgtgggcatccagctgctgggcatcgtgatggccaacgacctgcccccctacgacccccagtgcggcatccagagcagcgagtacttccaggccctggtgaacaacatgagcttcgtgagatacaaggaggtgtacgccgccgccgccgaggtgctgggcctgatcctgagatacgtgatggagagaaagaacatcctggaggagagcctgtgcgagctggtggccaagcagctgaagcagcaccagaacaccatggaggacaagttcatcgtgtgcctgaacaaggtgaccaagagcttcccccccctggccgacagattcatgaacgccgtgttcttcctgctgcccaagttccacggcgtgctgaagaccctgtgcctggaggtggtgctgtgcagagtggagggcatgaccgagctgtacttccagctgaagagcaaggacttcgtgcaggtgatgagacacagagacgacgagagacagaaggtgtgcctggacatcatctacaagatgatgcccaagctgaagcccgtggagctgagagagctgctgaaccccgtggtggagttcgtgagccaccccagcaccacctgcagagagcagatgtacaacatcctgatgtggatccacgacaactacagagaccccgagagcgagaccgacaacgacagccaggagatcttcaagctggccaaggacgtgctgatccagggcctgatcgacgagaaccccggcctgcagctgatcatcagaaacttctggagccacgagaccagactgcccagcaacaccctggacagactgctggccctgaacagcctgtacagccccaagatcgaggtgcacttcctgagcctggccaccaacttcctgctggagatgaccagcatgagccccgactaccccaaccccatgttcgagcaccccctgagcgagtgcgagttccaggagtacaccatcgacagcgactggagattcagaagcaccgtgctgacccccatgttcgtggagacccaggccagccagggcaccctgcagaccagaacccaggagggcagcctgagcgccagatggcccgtggccggccagatcagagccacccagcagcagcacgacttcaccctgacccagaccgccgacggcagaagcagcttcgactggctgaccggcagcagcaccgaccccctggtggaccacaccagccccagcagcgacagcctgctgttcgcccacaagagaagcgagagactgcagagagcccccctgaagagcgtgggccccgacttcggcaagaagagactgggcctgcccggcgacgaggtggacaacaaggtgaagggcgccgccggcagaaccgacctgctgagactgagaagaagattcatgagagaccaggagaagctgagcctgatgtacgccagaaagggcgtggccgagcagaagagagagaaggagatcaagagcgagctgaagatgaagcaggacgcccaggtggtgctgtacagaagctacagacacggcgacctgcccgacatccagatcaagcacagcagcctgatcacccccctgcaggccgtggcccagagagaccccatcatcgccaagcagctgttcagcagcctgttcagcggcatcctgaaggagatggacaagttcaagaccctgagcgagaagaacaacatcacccagaagctgctgcaggacttcaacagattcctgaacaccaccttcagcttcttcccccccttcgtgagctgcatccaggacatcagctgccagcacgccgccctgctgagcctggaccccgccgccgtgagcgccggctgcctggccagcctgcagcagcccgtgggcatcagactgctggaggaggccctgctgagactgctgcccgccgagctgcccgccaagagagtgagaggcaaggccagactgccccccgacgtgctgagatgggtggagctggccaagctgtacagaagcatcggcgagtacgacgtgctgagaggcatcttcaccagcgagatcggcaccaagcagatcacccagagcgccctgctggccgaggccagaagcgactacagcgaggccgccaagcagtacgacgaggccctgaacaagcaggactgggtggacggcgagcccaccgaggccgagaaggacttctgggagctggccagcctggactgctacaaccacctggccgagtggaagagcctggagtactgcagcaccgccagcatcgacagcgagaacccccccgacctgaacaagatctggagcgagcccttctaccaggagacctacctgccctacatgatcagaagcaagctgaagctgctgctgcagggcgaggccgaccagagcctgctgaccttcatcgacaaggccatgcacggcgagctgcagaaggccatcctggagctgcactacagccaggagctgagcctgctgtacctgctgcaggacgacgtggacagagccaagtactacatccagaacggcatccagagcttcatgcagaactacagcagcatcgacgtgctgctgcaccagagcagactgaccaagctgcagagcgtgcaggccctgaccgagatccaggagttcatcagcttcatcagcaagcagggcaacctgagcagccaggtgcccctgaagagactgctgaacacctggaccaacagataccccgacgccaagatggaccccatgaacatctgggacgacatcatcaccaacagatgcttcttcctgagcaagatcgaggagaagctgacccccctgcccgaggacaacagcatgaacgtggaccaggacggcgaccccagcgacagaatggaggtgcaggagcaggaggaggacatcagcagcctgatcagaagctgcaagttcagcatgaagatgaagatgatcgacagcgccagaaagcagaacaacttcagcctggccatgaagctgctgaaggagctgcacaaggagagcaagaccagagacgactggctggtgagctgggtgcagagctactgcagactgagccactgcagaagcagaagccagggctgcagcgagcaggtgctgaccgtgctgaagaccgtgagcctgctggacgagaacaacgtgagcagctacctgagcaagaacatcctggccttcagagaccagaacatcctgctgggcaccacctacagaatcatcgccaacgccctgagcagcgagcccgcctgcctggccgagatcgaggaggacaaggccagaagaatcctggagctgagcggcagcagcagcgaggacagcgagaaggtgatcgccggcctgtaccagagagccttccagcacctgagcgaggccgtgcaggccgccgaggaggaggcccagccccccagctggagctgcggccccgccgccggcgtgatcgacgcctacatgaccctggccgacttctgcgaccagcagctgagaaaggaggaggagaacgccagcgtgatcgacagcgccgagctgcaggcctaccccgccctggtggtggagaagatgctgaaggccctgaagctgaacagcaacgaggccagactgaagttccccagactgctgcagatcatcgagagataccccgaggagaccctgagcctgatgaccaaggagatcagcagcgtgccctgctggcagttcatcagctggatcagccacatggtggccctgctggacaaggaccaggccgtggccgtgcagcacagcgtggaggagatcaccgacaactacccccaggccatcgtgtaccccttcatcatcagcagcgagagctacagcttcaaggacaccagcaccggccacaagaacaaggagttcgtggccagaatcaagagcaagctggaccagggcggcgtgatccaggacttcatcaacgccctggaccagctgagcaaccccgagctgctgttcaaggactggagcaacgacgtgagagccgagctggccaagacccccgtgaacaagaagaacatcgagaagatgtacgagagaatgtacgccgccctgggcgaccccaaggcccccggcctgggcgccttcagaagaaagttcatccagaccttcggcaaggagttcgacaagcacttcggcaagggcggcagcaagctgctgagaatgaagctgagcgacttcaacgacatcaccaacatgctgctgctgaagatgaacaaggacagcaagccccccggcaacctgaaggagtgcagcccctggatgagcgacttcaaggtggagttcctgagaaacgagctggagatccccggccagtacgacggcagaggcaagcccctgcccgagtaccacgtgagaatcgccggcttcgacgagagagtgaccgtgatggccagcctgagaagacccaagagaatcatcatcagaggccacgacgagagagagcaccccttcctggtgaagggcggcgaggacctgagacaggaccagagagtggagcagctgttccaggtgatgaacggcatcctggcccaggacagcgcctgcagccagagagccctgcagctgagaacctacagcgtggtgcccatgaccagcagcgaccccagagcccccccctgcgagtacaaggactggctgaccaagatgagcggcaagcacgacgtgggcgcctacatgctgatgtacaagggcgccaacagaaccgagaccgtgaccagcttcagaaagagagagagcaaggtgcccgccgacctgctgaagagagccttcgtgagaatgagcaccagccccgaggccttcctggccctgagaagccacttcgccagcagccacgccctgatctgcatcagccactggatcctgggcatcggcgacagacacctgaacaacttcatggtggccatggagaccggcggcgtgatcggcatcgacttcggccacgccttcggcagcgccacccagttcctgcccgtgcccgagctgatgcccttcagactgaccagacagttcatcaacctgatgctgcccatgaaggagaccggcctgatgtacagcatcatggtgcacgccctgagagccttcagaagcgaccccggcctgctgaccaacaccatggacgtgttcgtgaaggagcccagcttcgactggaagaacttcgagcagaagatgctgaagaagggcggcagctggatccaggagatcaacgtggccgagaagaactggtaccccagacagaagatctgctacgccaagagaaagctggccggcgccaaccccgccgtgatcacctgcgacgagctgctgctgggccacgagaaggcccccgccttcagagactacgtggccgtggccagaggcagcaaggaccacaacatcagagcccaggagcccgagagcggcctgagcgaggagacccaggtgaagtgcctgatggaccaggccaccgaccccaacatcctgggcagaacctgggagggctgggagccctggatgtag

SEQ ID NO: 12370 - DNA, 444 bp, Artificial Sequence
  Description of Artificial Sequence: Synthetic coding sequence
atggccgcccagagactgggcaagagagtgctgagcaagctgcagagccccagcagagccagaggccccggcggcagccccggcggcctgcagaagagacacgccagagtgaccgtgaagtacgacagaagagagctgcagagaagactggacgtggagaagtggatcgacggcagactggaggagctgtacagaggcatggaggccgacatgcccgacgagatcaacatcgacgagctgctggagctggagagcgaggaggagagaagcagaaagatccagggcctgctgaagagctgcggcaagcccgtggaggacttcatccaggagctgctggccaagctgcagggcctgcacagacagcccggcctgagacagcccagccccagccacgacggcagcctgagccccctgcaggacagagccagaaccgcccacccctag

SEQ ID NO: 12371 - DNA, 363 bp, Artificial Sequence
  Description of Artificial Sequence: Synthetic coding sequence
atggccgcccagagactgggcaagagagtgctgagcaagctgcagagccccagcagagccagaggccccggcggcagccccggcggcctgcagaagagacacgccagagtgaccgtgaagtacgacagaagagagctgcagagaagactggacgtggagaagtggatcgacggcagactggaggagctgtacagaggcatgggcctgctgaagagctgcggcaagcccgtggaggacttcatccaggagctgctggccaagctgcagggcctgcacagacagcccggcctgagacagcccagccccagccacgacggcagcctgagccccctgcaggacagagccagaaccgcccacccctag

SEQ ID NO: 12372 - DNA, 2025 bp, Artificial Sequence
  Description of Artificial Sequence: Synthetic coding sequence
atggcccccggccaggccccccaccaggccaccccctggagagacgcccaccccttcttcctgctgagccccgtgatgggcctgctgagcagagcctggagcagactgagaggcctgggccccctggagccctggctggtggaggccgtgaagggcgccgccctggtggaggccggcctggagggcgaggccagaacccccctggccatcccccacaccccctggggcagaagacccgaggaggaggccgaggacagcggcggccccggcgaggacagagagaccctgggcctgaagaccagcagcagcctgcccgaggcctggggcctgctggacgacgacgacggcatgtacggcgagagagaggccaccagcgtgcccagaggccagggcagccagttcgccgacggccagagagcccccctgagccccagcctgctgatcagaaccctgcagggcagcgacaagaaccccggcgaggagaaggccgaggaggagggcgtggccgaggaggagggcgtgaacaagttcagctacccccccagccacagagagtgctgccccgccgtggaggaggaggacgacgaggaggccgtgaagaaggaggcccacagaaccagcaccagcgccctgagccccggcagcaagcccagcacctgggtgagctgccccggcgaggaggagaaccaggccaccgaggacaagagaaccgagagaagcaagggcgccagaaagaccagcgtgagccccagaagcagcggcagcgaccccagaagctgggagtacagaagcggcgaggccagcgaggagaaggaggagaaggcccacaaggagaccggcaagggcgaggccgcccccggcccccagagcagcgcccccgcccagagaccccagctgaagagctggtggtgccagcccagcgacgaggaggagggcgaggtgaaggccctgggcgccgccgagaaggacggcgaggccgagtgccccccctgcatccccccccccagcgccttcctgaaggcctgggtgtactggcccggcgaggacaccgaggaggaggaggacgaggaggaggacgaggacagcgacagcggcagcgacgaggaggagggcgaggccgaggccagcagcagcacccccgccaccggcgtgttcctgaagagctgggtgtaccagcccggcgaggacaccgaggaggaggaggacgaggacagcgacaccggcagcgccgaggacgagagagaggccgagaccagcgccagcaccccccccgccagcgccttcctgaaggcctgggtgtacagacccggcgaggacaccgaggaggaggaggacgaggacgtggacagcgaggacaaggaggacgacagcgaggccgccctgggcgaggccgagagcgacccccaccccagccaccccgaccagagagcccacttcagaggctggggctacagacccggcaaggagaccgaggaggaggaggccgccgaggactggggcgaggccgagccctgccccttcagagtggccatctacgtgcccggcgagaagcccccccccccctgggccccccccagactgcccctgagactgcagagaagactgaagagacccgagacccccacccacgaccccgaccccgagacccccctgaaggccagaaaggtgagattcagcgagaaggtgaccgtgcacttcctggccgtgtgggccggccccgcccaggccgccagacagggcccctgggagcagctggccagagacagaagcagattcgccagaagaatcacccaggcccaggaggagctgagcccctgcctgacccccgccgccagagccagagcctgggccagactgagaaacccccccctggcccccatccccgccctgacccagaccctgcccagcagcagcgtgcccagcagccccgtgcagaccacccccctgagccaggccgtggccacccccagcagaagcagcgccgccgccgccgccgccctggacctgagcggcagaagaggctag

SEQ ID NO: 12373 - DNA, 1545 bp, Artificial Sequence
  Description of Artificial Sequence: Synthetic coding sequence
atgaaggccgaggaggagggcgtggccgaggaggagggcgtgaacaagttcagctacccccccagccacagagagtgctgccccgccgtggaggaggaggacgacgaggaggccgtgaagaaggaggcccacagaaccagcaccagcgccctgagccccggcagcaagcccagcacctgggtgagctgccccggcgaggaggagaaccaggccaccgaggacaagagaaccgagagaagcaagggcgccagaaagaccagcgtgagccccagaagcagcggcagcgaccccagaagctgggagtacagaagcggcgaggccagcgaggagaaggaggagaaggcccacaaggagaccggcaagggcgaggccgcccccggcccccagagcagcgcccccgcccagagaccccagctgaagagctggtggtgccagcccagcgacgaggaggagggcgaggtgaaggccctgggcgccgccgagaaggacggcgaggccgagtgccccccctgcatccccccccccagcgccttcctgaaggcctgggtgtactggcccggcgaggacaccgaggaggaggaggacgaggaggaggacgaggacagcgacagcggcagcgacgaggaggagggcgaggccgaggccagcagcagcacccccgccaccggcgtgttcctgaagagctgggtgtaccagcccggcgaggacaccgaggaggaggaggacgaggacagcgacaccggcagcgccgaggacgagagagaggccgagaccagcgccagcaccccccccgccagcgccttcctgaaggcctgggtgtacagacccggcgaggacaccgaggaggaggaggacgaggacgtggacagcgaggacaaggaggacgacagcgaggccgccctgggcgaggccgagagcgacccccaccccagccaccccgaccagagagcccacttcagaggctggggctacagacccggcaaggagaccgaggaggaggaggccgccgaggactggggcgaggccgagccctgccccttcagagtggccatctacgtgcccggcgagaagcccccccccccctgggccccccccagactgcccctgagactgcagagaagactgaagagacccgagacccccacccacgaccccgaccccgagacccccctgaaggccagaaaggtgagattcagcgagaaggtgaccgtgcacttcctggccgtgtgggccggccccgcccaggccgccagacagggcccctgggagcagctggccagagacagaagcagattcgccagaagaatcacccaggcccaggaggagctgagcccctgcctgacccccgccgccagagccagagcctgggccagactgagaaacccccccctggcccccatccccgccctgacccagaccctgcccagcagcagcgtgcccagcagccccgtgcagaccacccccctgagccaggccgtggccacccccagcagaagcagcgccgccgccgccgccgccctggacctgagcggcagaagaggctag

SEQ ID NO: 12374 - DNA, 1899 bp, Artificial Sequence
  Description of Artificial Sequence: Synthetic coding sequence
atgccctggctggtggaggccgtgaagggcgccgccctggtggaggccggcctggagggcgaggccagaacccccctggccatcccccacaccccctggggcagaagacccgaggaggaggccgaggacagcggcggccccggcgaggacagagagaccctgggcctgaagaccagcagcagcctgcccgaggcctggggcctgctggacgacgacgacggcatgtacggcgagagagaggccaccagcgtgcccagaggccagggcagccagttcgccgacggccagagagcccccctgagccccagcctgctgatcagaaccctgcagggcagcgacaagaaccccggcgaggagaaggccgaggaggagggcgtggccgaggaggagggcgtgaacaagttcagctacccccccagccacagagagtgctgccccgccgtggaggaggaggacgacgaggaggccgtgaagaaggaggcccacagaaccagcaccagcgccctgagccccggcagcaagcccagcacctgggtgagctgccccggcgaggaggagaaccaggccaccgaggacaagagaaccgagagaagcaagggcgccagaaagaccagcgtgagccccagaagcagcggcagcgaccccagaagctgggagtacagaagcggcgaggccagcgaggagaaggaggagaaggcccacaaggagaccggcaagggcgaggccgcccccggcccccagagcagcgcccccgcccagagaccccagctgaagagctggtggtgccagcccagcgacgaggaggagggcgaggtgaaggccctgggcgccgccgagaaggacggcgaggccgagtgccccccctgcatccccccccccagcgccttcctgaaggcctgggtgtactggcccggcgaggacaccgaggaggaggaggacgaggaggaggacgaggacagcgacagcggcagcgacgaggaggagggcgaggccgaggccagcagcagcacccccgccaccggcgtgttcctgaagagctgggtgtaccagcccggcgaggacaccgaggaggaggaggacgaggacagcgacaccggcagcgccgaggacgagagagaggccgagaccagcgccagcaccccccccgccagcgccttcctgaaggcctgggtgtacagacccggcgaggacaccgaggaggaggaggacgaggacgtggacagcgaggacaaggaggacgacagcgaggccgccctgggcgaggccgagagcgacccccaccccagccaccccgaccagagagcccacttcagaggctggggctacagacccggcaaggagaccgaggaggaggaggccgccgaggactggggcgaggccgagccctgccccttcagagtggccatctacgtgcccggcgagaagcccccccccccctgggccccccccagactgcccctgagactgcagagaagactgaagagacccgagacccccacccacgaccccgaccccgagacccccctgaaggccagaaaggtgagattcagcgagaaggtgaccgtgcacttcctggccgtgtgggccggccccgcccaggccgccagacagggcccctgggagcagctggccagagacagaagcagattcgccagaagaatcacccaggcccaggaggagctgagcccctgcctgacccccgccgccagagccagagcctgggccagactgagaaacccccccctggcccccatccccgccctgacccagaccctgcccagcagcagcgtgcccagcagccccgtgcagaccacccccctgagccaggccgtggccacccccagcagaagcagcgccgccgccgccgccgccctggacctgagcggcagaagaggctag

SEQ ID NO: 12375 - DNA, 1671 bp, Artificial Sequence
  Description of Artificial Sequence: Synthetic coding sequence
atggccggcgccagcgagctgggcaccggccccggcgccgccggcggcgacggcgacgacagcctgtaccccatcgccgtgctgatcgacgagctgagaaacgaggacgtgcagctgagactgaacagcatcaagaagctgagcaccatcgccctggccctgggcgtggagagaaccagaagcgagctgctgcccttcctgaccgacaccatctacgacgaggacgaggtgctgctggccctggccgagcagctgggcaacttcaccggcctggtgggcggccccgacttcgcccactgcctgctgccccccctggagaacctggccaccgtggaggagaccgtggtgagagacaaggccgtggagagcctgagacagatcagccaggagcacacccccgtggccctggaggcctacttcgtgcccctggtgaagagactggccagcggcgactggttcaccagcagaaccagcgcctgcggcctgttcagcgtgtgctaccccagagccagcaacgccgtgaaggccgagatcagacagcagttcagaagcctgtgcagcgacgacacccccatggtgagaagagccgccgccagcaagctgggcgagttcgccaaggtgctggagctggacagcgtgaagagcgagatcgtgcccctgttcaccagcctggccagcgacgagcaggacagcgtgagactgctggccgtggaggcctgcgtgagcatcgcccagctgctgagccaggacgacctggagaccctggtgatgcccaccctgagacaggccgccgaggacaagagctggagagtgagatacatggtggccgacagattcagcgagctgcagaaggccatgggccccaagatcaccctgaacgacctgatccccgccttccagaacctgctgaaggactgcgaggccgaggtgagagccgccgccgcccacaaggtgaaggagctgggcgagaacctgcccatcgaggacagagagaccatcatcatgaaccagatcctgccctacatcaagtgccccgacgtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccaacaacctgatgaagctggtgcagaagttcggcaccgagtgggcccagaacaccatcgtgcccaaggtgctggtgatggccaacgaccccaactacctgcacagaatgaccaccctgttctgcatcaacgccctgagcgaggcctgcggccaggagatcaccaccaagcagatgctgcccatcgtgctgaagatggccggcgaccaggtggccaacgtgagattcaacgtggccaagagcctgcagaagatcggccccatcctggacaccaacgccctgcagggcgaggtgaagcccgtgctgcagaagctgggccaggacgaggacatggacgtgaagtacttcgcccaggaggccatcagcgtgctggccctggcctag

SEQ ID NO: 12376 - DNA, 1770 bp, Artificial Sequence
  Description of Artificial Sequence: Synthetic coding sequence
atggccgccgccgacggcgacgacagcctgtaccccatcgccgtgctgatcgacgagctgagaaacgaggacgtgcagctgagactgaacagcatcaagaagctgagcaccatcgccctggccctgggcgtggagagaaccagaagcgagctgctgcccttcctgaccgacaccatctacgacgaggacgaggtgctgctggccctggccgagcagctgggcaccttcaccaccctggtgggcggccccgagtacgtgcactgcctgctgccccccctggagagcctggccaccgtggaggagaccgtggtgagagacaaggccgtggagagcctgagagccatcagccacgagcacagccccagcgacctggaggcccacttcgtgcccctggtgaagagactggccggcggcgactggttcaccagcagaaccagcgcctgcggcctgttcagcgtgtgctaccccagagtgagcagcgccgtgaaggccgagctgagacagtacttcagaaacctgtgcagcgacgacacccccatggtgagaagagccgccgccagcaagctgggcgagttcgccaaggtgctggagctggacaacgtgaagagcgagatcatccccatgttcagcaacctggccagcgacgagcaggacagcgtgagactgctggccgtggaggcctgcgtgaacatcgcccagctgctgccccaggaggacctggaggccctggtgatgcccaccctgagacaggccgccgaggacaagagctggagagtgagatacatggtggccgacaagttcaccgagctgcagaaggccgtgggccccgagatcaccaagaccgacctggtgcccgccttccagaacctgatgaaggactgcgaggccgaggtgagagccgccgccagccacaaggtgaaggagttctgcgagaacctgagcgccgactgcagagagaacgtgatcatgagccagatcctgccctgcatcaaggagctggtgagcgacgccaaccagcacgtgaagagcgccctggccagcgtgatcatgggcctgagccccatcctgggcaaggacaacaccatcgagcacctgctgcccctgttcctggcccagctgaaggacgagtgccccgaggtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccagcaacctgaagaagctggtggagaagttcggcaaggagtgggcccacgccaccatcatccccaaggtgctggccatgagcggcgaccccaactacctgcacagaatgaccaccctgttctgcatcaacgtgctgagcgaggtgtgcggccaggacatcaccaccaagcacatgctgcccaccgtgctgagaatggccggcgaccccgtggccaacgtgagattcaacgtggccaagagcctgcagaagatcggccccatcctggacaacagcaccctgcagagcgaggtgaagcccatcctggagaagctgacccaggaccaggacgtggacgtgaagtacttcgcccaggaggccctgaccgtgctgagcctggcctag

SEQ ID NO: 12377 - DNA, 1740 bp, Artificial Sequence
  Description of Artificial Sequence: Synthetic coding sequence
atggccgccgccgacggcgacgacagcctgtaccccatcgccgtgctgatcgacgagctgagaaacgaggacgtgcagctgagactgaacagcatcaagaagctgagcaccatcgccctggccctgggcgtggagagaaccagaagcgagctgctgcccttcctgaccgacaccatctacgacgaggacgaggtgctgctggccctggccgagcagctgggcaccttcaccaccctggtgggcggccccgagtacgtgcactgcctgctgccccccctggagagcctggccaccgtggagagcctgagagccatcagccacgagcacagccccagcgacctggaggcccacttcgtgcccctggtgaagagactggccggcggcgactggttcaccagcagaaccagcgcctgcggcctgttcagcgtgtgctaccccagagtgagcagcgccgtgaaggccgagctgagacagtacttcagaaacctgtgcagcgacgacacccccatggtgagaagagccgccgccagcaagctgggcgagttcgccaaggtgctggagctggacaacgtgaagagcgagatcatccccatgttcagcaacctggccagcgacgagcaggacagcgtgagactgctggccgtggaggcctgcgtgaacatcgcccagctgctgccccaggaggacctggaggccctggtgatgcccaccctgagacaggccgccgaggacaagagctggagagtgagatacatggtggccgacaagttcaccgagctgcagaaggccgtgggccccgagatcaccaagaccgacctggtgcccgccttccagaacctgatgaaggactgcgaggccgaggtgagagccgccgccagccacaaggtgaaggagttctgcgagaacctgagcgccgactgcagagagaacgtgatcatgagccagatcctgccctgcatcaaggagctggtgagcgacgccaaccagcacgtgaagagcgccctggccagcgtgatcatgggcctgagccccatcctgggcaaggacaacaccatcgagcacctgctgcccctgttcctggcccagctgaaggacgagtgccccgaggtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccagcaacctgaagaagctggtggagaagttcggcaaggagtgggcccacgccaccatcatccccaaggtgctggccatgagcggcgaccccaactacctgcacagaatgaccaccctgttctgcatcaacgtgctgagcgaggtgtgcggccaggacatcaccaccaagcacatgctgcccaccgtgctgagaatggccggcgaccccgtggccaacgtgagattcaacgtggccaagagcctgcagaagatcggccccatcctggacaacagcaccctgcagagcgaggtgaagcccatcctggagaagctgacccaggaccaggacgtggacgtgaagtacttcgcccaggaggccctgaccgtgctgagcctggcctag

SEQ ID NO: 12378 - DNA, 471 bp, Artificial Sequence
  Description of Artificial Sequence: Synthetic coding sequence
atggccgccgccgacggcgacgacagcctgtaccccatcgccgtgctgatcgacgagctgagaaacgaggacgtgcagctgagactgaacagcaacctgaagaagctggtggagaagttcggcaaggagtgggcccacgccaccatcatccccaaggtgctggccatgagcggcgaccccaactacctgcacagaatgaccaccctgttctgcatcaacgtgctgagcgaggtgtgcggccaggacatcaccaccaagcacatgctgcccaccgtgctgagaatggccggcgaccccgtggccaacgtgagattcaacgtggccaagagcctgcagaagatcggccccatcctggacaacagcaccctgcagagcgaggtgaagcccatcctggagaagctgacccaggaccaggacgtggacgtgaagtacttcgcccaggaggccctgaccgtgctgagcctggcctag

SEQ ID NO: 12379 - DNA, 1605 bp, Artificial Sequence
  Description of Artificial Sequence: Synthetic coding sequence
atgagaaccttcagcttcgccagcaccgccagcagaagctgcccccccagcccctggcccctgggcctgaagggccccgaggtgagcttctgcctgagcctgcagccccccctggagagcctggccaccgtggaggagaccgtggtgagagacaaggccgtggagagcctgagagccatcagccacgagcacagccccagcgacctggaggcccacttcgtgcccctggtgaagagactggccggcggcgactggttcaccagcagaaccagcgcctgcggcctgttcagcgtgtgctaccccagagtgagcagcgccgtgaaggccgagctgagacagtacttcagaaacctgtgcagcgacgacacccccatggtgagaagagccgccgccagcaagctgggcgagttcgccaaggtgctggagctggacaacgtgaagagcgagatcatccccatgttcagcaacctggccagcgacgagcaggacagcgtgagactgctggccgtggaggcctgcgtgaacatcgcccagctgctgccccaggaggacctggaggccctggtgatgcccaccctgagacaggccgccgaggacaagagctggagagtgagatacatggtggccgacaagttcaccgagctgcagaaggccgtgggccccgagatcaccaagaccgacctggtgcccgccttccagaacctgatgaaggactgcgaggccgaggtgagagccgccgccagccacaaggtgaaggagttctgcgagaacctgagcgccgactgcagagagaacgtgatcatgagccagatcctgccctgcatcaaggagctggtgagcgacgccaaccagcacgtgaagagcgccctggccagcgtgatcatgggcctgagccccatcctgggcaaggacaacaccatcgagcacctgctgcccctgttcctggcccagctgaaggacgagtgccccgaggtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccagcaacctgaagaagctggtggagaagttcggcaaggagtgggcccacgccaccatcatccccaaggtgctggccatgagcggcgaccccaactacctgcacagaatgaccaccctgttctgcatcaacgtgctgagcgaggtgtgcggccaggacatcaccaccaagcacatgctgcccaccgtgctgagaatggccggcgaccccgtggccaacgtgagattcaacgtggccaagagcctgcagaagatcggccccatcctggacaacagcaccctgcagagcgaggtgaagcccatcctggagaagctgacccaggaccaggacgtggacgtgaagtacttcgcccaggaggccctgaccgtgctgagcctggcctag

SEQ ID NO: 12380 - DNA, 2004 bp, Artificial Sequence
  Description of Artificial Sequence: Synthetic coding sequence
atggccggcgccagcgagctgggcaccggccccggcgccgccggcggcgacggcgacgacagcctgtaccccatcgccgtgctgatcgacgagctgagaaacgaggacgtgcagctgagactgaacagcatcaagaagctgagcaccatcgccctggccctgggcgtggagagaaccagaagcgagctgctgcccttcctgaccgacaccatctacgacgaggacgaggtgctgctggccctggccgagcagctgggcaacttcaccggcctggtgggcggccccgacttcgcccactgcctgctgccccccctggagaacctggccaccgtggaggagaccgtggtgagagacaaggccgtggagagcctgagacagatcagccaggagcacacccccgtggccctggaggcctacttcgtgcccctggtgaagagactggccagcggcgactggttcaccagcagaaccagcgcctgcggcctgttcagcgtgtgctaccccagagccagcaacgccgtgaaggccgagatcagacagcagttcagaagcctgtgcagcgacgacacccccatggtgagaagagccgccgccagcaagctgggcgagttcgccaaggtgctggagctggacagcgtgaagagcgagatcgtgcccctgttcaccagcctggccagcgacgagcaggacagcgtgagactgctggccgtggaggcctgcgtgagcatcgcccagctgctgagccaggacgacctggagaccctggtgatgcccaccctgagacaggccgccgaggacaagagctggagagtgagatacatggtggccgacagattcagcgagctgcagaaggccatgggccccaagatcaccctgaacgacctgatccccgccttccagaacctgctgaaggactgcgaggccgaggtgagagccgccgccgcccacaaggtgaaggagctgggcgagaacctgcccatcgaggacagagagaccatcatcatgaaccagatcctgccctacatcaaggagctggtgagcgacaccaaccagcacgtgaagagcgccctggccagcgtgatcatgggcctgagcaccatcctgggcaaggagaacaccatcgagcacctgctgcccctgttcctggcccagctgaaggacgagtgccccgacgtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccaacaacctgatgaagctggtgcagaagttcggcaccgagtgggcccagaacaccatcgtgcccaaggtgctggtgatggccaacgaccccaactacctgcacagaatgaccaccctgttctgcatcaacgccctgagcgaggcctgcggccaggagatcaccaccaagcagatgctgcccatcgtgctgaagatggccggcgaccaggtggccaacgtgagattcaacgtggccaagagcctgcagaagatcggccccatcctggacaccaacgccctgcagggcgaggtgaagcccgtgctgcagaagctgggccaggacgaggacatggacgtgaagtacttcgcccaggaggccatcagcgtggtggcccagagactgagaaagctggagttccccgtgaaggacagcggcgagcccagcgtgcccagagccgacaagaaccacttccccagacccaccgtgcccggcgaggacatgggcaagggccccgtgtaccagctgagaggcgacaccagagacaccctggcccagctgggcatcgccgagctggtgcacttcagccagagcaccgactag

SEQ ID NO: 12381 - DNA, 1425 bp, Artificial Sequence
  Description of Artificial Sequence: Synthetic coding sequence
atggccggcgccagcgagctgggcaccggccccggcgccgccggcggcgacggcgacgacagcctgtaccccatcgccgtgctgatcgacgagctgagaaacgaggacgtgcagctgagactgaacagcatcaagaagctgagcaccatcgccctggccctgggcgtggagagaaccagaagcgagctgctgcccttcctgaccgacaccatctacgacgaggacgaggtgctgctggccctggccgagcagctgggcaacttcaccggcctggtgggcggccccgacttcgcccactgcctgctggacagcgtgagactgctggccgtggaggcctgcgtgagcatcgcccagctgctgagccaggacgacctggagaccctggtgatgcccaccctgagacaggccgccgaggacaagagctggagagtgagatacatggtggccgacagattcagcgagctgcagaaggccatgggccccaagatcaccctgaacgacctgatccccgccttccagaacctgctgaaggactgcgaggccgaggtgagagccgccgccgcccacaaggtgaaggagctgggcgagaacctgcccatcgaggacagagagaccatcatcatgaaccagatcctgccctacatcaaggagctggtgagcgacaccaaccagcacgtgaagagcgccctggccagcgtgatcatgggcctgagcaccatcctgggcaaggagaacaccatcgagcacctgctgcccctgttcctggcccagctgaaggacgagtgccccgacgtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccaacaacctgatgaagctggtgcagaagttcggcaccgagtgggcccagaacaccatcgtgcccaaggtgctggtgatggccaacgaccccaactacctgcacagaatgaccaccctgttctgcatcaacgccctgagcgaggcctgcggccaggagatcaccaccaagcagatgctgcccatcgtgctgaagatggccggcgaccaggtggccaacgtgagattcaacgtggccaagagcctgcagaagatcggccccatcctggacaccaacgccctgcagggcgaggtgaagcccgtgctgcagaagctgggccaggacgaggacatggacgtgaagtacttcgcccaggaggccatcagcgtgctggccctggcctag

SEQ ID NO: 12382 - DNA, 1365 bp, Artificial Sequence
  Description of Artificial Sequence: Synthetic coding sequence
atggccggcgccagcgagctgggcaccggccccggcgccgccggcggcgacggcgacgacagcctgtaccccatcgccgtgctgatcgacgagctgagaaacgaggacgtgcagctgagactgaacagcatcaagaagctgagcaccatcgccctggccctgggcgtggagagaaccagaagcgagctgctgcccttcctgaccgacaccatctacgacgaggacgaggtgctgctggccctggccgagcagctgggcaacttcaccggcctggtgggcggccccgacttcgcccactgcctgctggacagcgtgagactgctggccgtggaggcctgcgtgagcatcgcccagctgctgagccaggacgacctggagaccctggtgatgcccaccctgagacaggccgccgaggacaagagctggagagtgagatacatggtggccgacagattcagcgagctgcagaaggccatgggccccaagatcaccctgaacgacctgatccccgccttccagaacctgctgaaggactgcgaggccgaggtgagagccgccgccgcccacaaggtgaaggagctgggcgagaacctgcccatcgaggacagagagaccatcatcatgaaccagatcctgccctacatcaaggagctggtgagcgacaccaaccagcacgtgaagagcgccctggccagcgtgatcatgggcctgagcaccatcctgggcaaggagaacaccatcgagcacctgctgcccctgttcctggcccagctgaaggacgagtgccccgacgtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccaacaacctgatgaagctggtgcagaagttcggcaccgagtgggcccagaacaccatcgtgcccaaggtgctggtgatggccaacgaccccaactacctgcacagaatgaccaccctgttctgcatcaacgccctgagcgaggcctgcggccaggagatcaccaccaagcagatgctgcccatcgtgaagaacggcagaagacccagcagcaagtgcagcctgcagtgcggccagatcagcaccaaggactggaccaacagcagataccagtgcttcaccggcagaagcgaggccagcaccaccgaggtgagaagcagatag

SEQ ID NO: 12383 - DNA, 1812 bp, Artificial Sequence
  Description of Artificial Sequence: Synthetic coding sequence
atggccggcgccagcgagctgggcaccggccccggcgccgccggcggcgacggcgacgacagcctgtaccccatcgccgtgctgatcgacgagctgagaaacgaggacgtgcagccccccctggagaacctggccaccgtggaggagaccgtggtgagagacaaggccgtggagagcctgagacagatcagccaggagcacacccccgtggccctggaggcctacttcgtgcccctggtgaagagactggccagcggcgactggttcaccagcagaaccagcgcctgcggcctgttcagcgtgtgctaccccagagccagcaacgccgtgaaggccgagatcagacagcagttcagaagcctgtgcagcgacgacacccccatggtgagaagagccgccgccagcaagctgggcgagttcgccaaggtgctggagctggacagcgtgaagagcgagatcgtgcccctgttcaccagcctggccagcgacgagcaggacagcgtgagactgctggccgtggaggcctgcgtgagcatcgcccagctgctgagccaggacgacctggagaccctggtgatgcccaccctgagacaggccgccgaggacaagagctggagagtgagatacatggtggccgacagattcagcgagctgcagaaggccatgggccccaagatcaccctgaacgacctgatccccgccttccagaacctgctgaaggactgcgaggccgaggtgagagccgccgccgcccacaaggtgaaggagctgggcgagaacctgcccatcgaggacagagagaccatcatcatgaaccagatcctgccctacatcaaggagctggtgagcgacaccaaccagcacgtgaagagcgccctggccagcgtgatcatgggcctgagcaccatcctgggcaaggagaacaccatcgagcacctgctgcccctgttcctggcccagctgaaggacgagtgccccgacgtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccaacaacctgatgaagctggtgcagaagttcggcaccgagtgggcccagaacaccatcgtgcccaaggtgctggtgatggccaacgaccccaactacctgcacagaatgaccaccctgttctgcatcaacgccctgagcgaggcctgcggccaggagatcaccaccaagcagatgctgcccatcgtgctgaagatggccggcgaccaggtggccaacgtgagattcaacgtggccaagagcctgcagaagatcggccccatcctggacaccaacgccctgcagggcgaggtgaagcccgtgctgcagaagctgggccaggacgaggacatggacgtgaagtacttcgcccaggaggccatcagcgtggtggcccagagactgagaaagctggagttccccgtgaaggacagcggcgagcccagcgtgcccagagccgacaagaaccacttccccagacccaccgtgcccggcgaggacatgggcaagggccccgtgtaccagctgagaggcgacaccagagacaccctggcccagctgggcatcgccgagctggtgcacttcagccagagcaccgactag

SEQ ID NO: 12384 - DNA, 1323 bp, Artificial Sequence
  Description of Artificial Sequence: Synthetic coding sequence
atgatgcagctgaccttctggctgagagtgcccccccccttcagccacttcaagagacagttcagaagcctgtgcagcgacgacacccccatggtgagaagagccgccgccagcaagctgggcgagttcgccaaggtgctggagctggacagcgtgaagagcgagatcgtgcccctgttcaccagcctggccagcgacgagcaggacagcgtgagactgctggccgtggaggcctgcgtgagcatcgcccagctgctgagccaggacgacctggagaccctggtgatgcccaccctgagacaggccgccgaggacaagagctggagagtgagatacatggtggccgacagattcagcgagctgcagaaggccatgggccccaagatcaccctgaacgacctgatccccgccttccagaacctgctgaaggactgcgaggccgaggtgagagccgccgccgcccacaaggtgaaggagctgggcgagaacctgcccatcgaggacagagagaccatcatcatgaaccagatcctgccctacatcaaggagctggtgagcgacaccaaccagcacgtgaagagcgccctggccagcgtgatcatgggcctgagcaccatcctgggcaaggagaacaccatcgagcacctgctgcccctgttcctggcccagctgaaggacgagtgccccgacgtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccaacaacctgatgaagctggtgcagaagttcggcaccgagtgggcccagaacaccatcgtgcccaaggtgctggtgatggccaacgaccccaactacctgcacagaatgaccaccctgttctgcatcaacgccctgagcgaggcctgcggccaggagatcaccaccaagcagatgctgcccatcgtgctgaagatggccggcgaccaggtggccaacgtgagattcaacgtggccaagagcctgcagaagatcggccccatcctggacaccaacgccctgcagggcgaggtgaagcccgtgctgcagaagctgggccaggacgaggacatggacgtgaagtacttcgcccaggaggccatcagcgtgctggccctggcctag

SEQ ID NO: 12385 - DNA, 1806 bp, Artificial Sequence
  Description of Artificial Sequence: Synthetic coding sequence
atggccggcgccagcgagctgggcaccggccccggcgccgccggcggcgacggcgacgacagcctgtaccccatcgccgtgctgatcgacgagctgagaaacgaggacgtgcagctgagactgaacagcatcaagaagctgagcaccatcgccctggccctgggcgtggagagaaccagaagcgagctgctgcccttcctgaccgacaccatctacgacgaggacgaggtgctgctggccctggccgagcagctgggcaacttcaccggcctggtgggcggccccgacttcgcccactgcctgctgccccccctggagaacctggccaccgtggaggagaccgtggtgagagacaaggccgtggagagcctgagacagatcagccaggagcacacccccgtggccctggaggcctacttcgtgcccctggtgaagagactggccagcggcgactggttcaccagcagaaccagcgcctgcggcctgttcagcgtgtgctaccccagagccagcaacgccgtgaaggccgagatcagacagcagttcagaagcctgtgcagcgacgacacccccatggtgagaagagccgccgccagcaagctgggcgagttcgccaaggtgctggagctggacagcgtgaagagcgagatcgtgcccctgttcaccagcctggccagcgacgagcaggacagcgtgagactgctggccgtggaggcctgcgtgagcatcgcccagctgctgagccaggacgacctggagaccctggtgatgcccaccctgagacaggccgccgaggacaagagctggagagtgagatacatggtggccgacagattcagcgagctgcagaaggccatgggccccaagatcaccctgaacgacctgatccccgccttccagaacctgctgaaggactgcgaggccgaggtgagagccgccgccgcccacaaggtgaaggagctgggcgagaacctgcccatcgaggacagagagaccatcatcatgaaccagatcctgccctacatcaaggagctggtgagcgacaccaaccagcacgtgaagagcgccctggccagcgtgatcatgggcctgagcaccatcctgggcaaggagaacaccatcgagcacctgctgcccctgttcctggcccagctgaaggacgagtgccccgacgtgagactgaacatcatcagcaacctggactgcgtgaacgaggtgatcggcatcagacagctgagccagagcctgctgcccgccatcgtggagctggccgaggacgccaagtggagagtgagactggccatcatcgagtacatgcccctgctggccggccagctgggcgtggagttcttcgacgagaagctgaacagcctgtgcatggcctggctggtggaccacgtgtacgccatcagagaggccgccaccaacaacctgatgaagctggtgcagaagttcggcaccgagtgggcccagaacaccatcgtgcccaaggtgctggtgatggccaacgaccccaactacctgcacagaatgaccaccctgttctgcatcaacgccctgagcgaggcctgcggccaggagatcaccaccaagcagatgctgcccatcgtgctgaagatggccggcgaccaggtggccaacgtgagattcaacgtggccaagagcctgcagaagatcggccccatcctggacaccaacgccctgcagggcgaggtgaagcccgtgctgcagaagctgggccaggacgaggacatggacgtgaagtacttcgcccaggaggccatcagcgtgctggccctggcctag

SEQ ID NO: 12386 - DNA, 1566 bp, Artificial Sequence
  Description of Artificial Sequence: Synthetic coding sequence
atgagcggcagaagattccacctgagcaccaccgacagagtgatcaaggccgtgcccttcccccccacccagagactgaccttcaaggaggtgttcgagaacggcaagcccaaggtggacgtgctgaagaaccacctggtgaaggagggcagactggaggaggaggtggccctgaagatcatcaacgacggcgccgccatcctgagacaggagaagaccatgatcgaggtggacgcccccatcaccgtgtgcggcgacatccacggccagttcttcgacctgatgaagctgttcgaggtgggcggcagccccagcaacaccagatacctgttcctgggcgactacgtggacagaggctacttcagcatcgagtgcgtgctgtacctgtggagcctgaagatcaaccaccccaagaccctgttcctgctgagaggcaaccacgagtgcagacacctgaccgactacttcaccttcaagcaggagtgcagaatcaagtacagcgagcaggtgtacgacgcctgcatggagaccttcgactgcctgcccctggccgccctgctgaaccagcagttcctgtgcgtgcacggcggcatgagccccgagatcaccagcctggacgacatcagaaagctggacagattcaccgagccccccgccttcggccccgtgtgcgacctgctgtggagcgaccccagcgaggactacggcaacgagaagaccctggagcactacacccacaacaccgtgagaggctgcagctacttctacagctaccccgccgtgtgcgagttcctgcagaacaacaacctgctgagcatcatcagagcccacgaggcccaggacgccggctacagaatgtacagaaagagccaggccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgaacatctgcagcgacgacgagctgatcagcgacgacgaggccgaggaccactacatccccagctaccagaagggcagcaccaccgtgagaaaggagatcatcagaaacaagatcagagccatcggcaagatggccagagtgttcagcatcctgagacaggagagcgagagcgtgctgaccctgaagggcctgacccccaccggcaccctgcccctgggcgtgctgagcggcggcaagcagaccatcgagaccgccaccgtggaggccgtggaggccagagaggccatcagaggcttcagcctgcagcacaagatcagaagcttcgaggaggccagaggcctggacagaatcaacgagagaatgccccccagaaaggacagcatccacgccggcggccccatgaagagcgtgaccagcgcccacagccacgccgcccacagaagcgaccagggcaagaaggcccacagctag

SEQ ID NO: 12387 - DNA, 1410 bp, Artificial Sequence
  Description of Artificial Sequence: Synthetic coding sequence
atgagcgagcccaaggccatcgaccccaagctgagcaccaccgacagagtggtgaaggccgtgcccttcccccccagccacagactgaccgccaaggaggtgttcgacaacgacggcaagcccagagtggacatcctgaaggcccacctgatgaaggagggcagactggaggagagcgtggccctgagaatcatcaccgagggcgccagcatcctgagacaggagaagaacctgctggacatcgacgcccccgtgaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggccctgaagatcctgtaccccaagaccctgttcctgctgagaggcaaccacgagtgcagacacctgaccgagtacttcaccttcaagcaggagtgcaagatcaagtacagcgagagagtgtacgacgcctgcatggacgccttcgactgcctgcccctggccgccctgatgaaccagcagttcctgtgcgtgcacggcggcctgagccccgagatcaacaccctggacgacatcagaaagctggacagattcaaggagccccccgcctacggccccatgtgcgacatcctgtggagcgaccccctggaggacttcggcaacgagaagacccaggagcacttcacccacaacaccgtgagaggctgcagctacttctacagctaccccgccgtgtgcgagttcctgcagcacaacaacctgctgagcatcctgagagcccacgaggcccaggacgccggctacagaatgtacagaaagagccagaccaccggcttccccagcctgatcaccatcttcagcgcccccaactacctggacgtgtacaacaacaaggtgaccgagatgctggtgaacgtgctgaacatctgcagcgacgacgagctgggcagcgaggaggacggcttcgacggcgccaccgccgccgccagaaaggaggtgatcagaaacaagatcagagccatcggcaagatggccagagtgttcagcgtgctgagagaggagagcgagagcgtgctgaccctgaagggcctgacccccaccggcatgctgcccagcggcgtgctgagcggcggcaagcagaccctgcagagcgccatcaagggcttcagcccccagcacaagatcaccagcttcgaggaggccaagggcctggacagaatcaacgagagaatgccccccagaagagacgccatgcccagcgacgccaacctgaacagcatcaacaaggccctgaccagcgagaccaacggcaccgacagcaacggcagcaacagcagcaacatccagtag

SEQ ID NO: 12388 - DNA, 1536 bp, Artificial Sequence
  Description of Artificial Sequence: Synthetic coding sequence
atgagcgagcccaaggccatcgaccccaagctgagcaccaccgacagagtggtgaaggccgtgcccttcccccccagccacagactgaccgccaaggaggtgttcgacaacgacggcaagcccagagtggacatcctgaaggcccacctgatgaaggagggcagactggaggagagcgtggccctgagaatcatcaccgagggcgccagcatcctgagacaggagaagaacctgctggacatcgacgcccccgtgaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggccctgaagatcctgtaccccaagaccctgttcctgctgagaggcaaccacgagtgcagacacctgaccgagtacttcaccttcaagcaggagtgcaagatcaagtacagcgagagagtgtacgacgcctgcatggacgccttcgactgcctgcccctggccgccctgatgaaccagcagttcctgtgcgtgcacggcggcctgagccccgagatcaacaccctggacgacatcagaaagctggacagattcaaggagccccccgcctacggccccatgtgcgacatcctgtggagcgaccccctggaggacttcggcaacgagaagacccaggagcacttcacccacaacaccgtgagaggctgcagctacttctacagctaccccgccgtgtgcgagttcctgcagcacaacaacctgctgagcatcctgagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgaacatctgcagcgacgacgagctgggcagcgaggaggacggcttcgacggcgccaccgccgccgccagaaaggaggtgatcagaaacaagatcagagccatcggcaagatggccagagtgttcagcgtgctgagagaggagagcgagagcgtgctgaccctgaagggcctgacccccaccggcatgctgcccagcggcgtgctgagcggcggcaagcagaccctgcagagcgccatcaagggcttcagcccccagcacaagatcaccagcttcgaggaggccaagggcctggacagaatcaacgagagaatgccccccagaagagacgccatgcccagcgacgccaacctgaacagcatcaacaaggccctgaccagcgagaccaacggcaccgacagcaacggcagcaacagcagcaacatccagtag

SEQ ID NO: 12389 - DNA, 1566 bp, Artificial Sequence
  Description of Artificial Sequence: Synthetic coding sequence
atgagcgagcccaaggccatcgaccccaagctgagcaccaccgacagagtggtgaaggccgtgcccttcccccccagccacagactgaccgccaaggaggtgttcgacaacgacggcaagcccagagtggacatcctgaaggcccacctgatgaaggagggcagactggaggagagcgtggccctgagaatcatcaccgagggcgccagcatcctgagacaggagaagaacctgctggacatcgacgcccccgtgaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggccctgaagatcctgtaccccaagaccctgttcctgctgagaggcaaccacgagtgcagacacctgaccgagtacttcaccttcaagcaggagtgcaagatcaagtacagcgagagagtgtacgacgcctgcatggacgccttcgactgcctgcccctggccgccctgatgaaccagcagttcctgtgcgtgcacggcggcctgagccccgagatcaacaccctggacgacatcagaaagctggacagattcaaggagccccccgcctacggccccatgtgcgacatcctgtggagcgaccccctggaggacttcggcaacgagaagacccaggagcacttcacccacaacaccgtgagaggctgcagctacttctacagctaccccgccgtgtgcgagttcctgcagcacaacaacctgctgagcatcctgagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgaacatctgcagcgacgacgagctgggcagcgaggaggacggcttcgacggcgccaccgccgccgccagaaaggaggtgatcagaaacaagatcagagccatcggcaagatggccagagtgttcagcgtgctgagagaggagagcgagagcgtgctgaccctgaagggcctgacccccaccggcatgctgcccagcggcgtgctgagcggcggcaagcagaccctgcagagcgccaccgtggaggccatcgaggccgacgaggccatcaagggcttcagcccccagcacaagatcaccagcttcgaggaggccaagggcctggacagaatcaacgagagaatgccccccagaagagacgccatgcccagcgacgccaacctgaacagcatcaacaaggccctgaccagcgagaccaacggcaccgacagcaacggcagcaacagcagcaacatccagtag

SEQ ID NO: 12390 - DNA, 1272 bp, Artificial Sequence
  Description of Artificial Sequence: Synthetic coding sequence
atgaagctgttcgaggtgggcggcagccccgccaacaccagatacctgttcctgggcgactacgtggacagaggctacttcagcatcgagtgcgtgctgtacctgtgggccctgaagatcctgtaccccaagaccctgttcctgctgagaggcaaccacgagtgcagacacctgaccgagtacttcaccttcaagcaggagtgcaagatcaagtacagcgagagagtgtacgacgcctgcatggacgccttcgactgcctgcccctggccgccctgatgaaccagcagttcctgtgcgtgcacggcggcctgagccccgagatcaacaccctggacgacatcagaaagctggacagattcaaggagccccccgcctacggccccatgtgcgacatcctgtggagcgaccccctggaggacttcggcaacgagaagacccaggagcacttcacccacaacaccgtgagaggctgcagctacttctacagctaccccgccgtgtgcgagttcctgcagcacaacaacctgctgagcatcctgagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgaacatctgcagcgacgacgagctgggcagcgaggaggacggcttcgacggcgccaccgccgccgccagaaaggaggtgatcagaaacaagatcagagccatcggcaagatggccagagtgttcagcgtgctgagagaggagagcgagagcgtgctgaccctgaagggcctgacccccaccggcatgctgcccagcggcgtgctgagcggcggcaagcagaccctgcagagcgccaccgtggaggccatcgaggccgacgaggccatcaagggcttcagcccccagcacaagatcaccagcttcgaggaggccaagggcctggacagaatcaacgagagaatgccccccagaagagacgccatgcccagcgacgccaacctgaacagcatcaacaaggccctgaccagcgagaccaacggcaccgacagcaacggcagcaacagcagcaacatccagtag

SEQ ID NO: 12391 - DNA, 870 bp, Artificial Sequence
  Description of Artificial Sequence: Synthetic coding sequence
atgagcgagcccaaggccatcgaccccaagctgagcaccaccgacagagtggtgaaggccgtgcccttcccccccagccacagactgaccgccaaggaggtgttcgacaacgacggcaagcccagagtggacatcctgaaggcccacctgatgaaggagggcagactggaggagagcgtggccctgagaatcatcaccgagggcgccagcatcctgagacaggagaagaacctgctggacatcgacgcccccgtgaccgccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgaacatctgcagcgacgacgagctgggcagcgaggaggacggcttcgacggcgccaccgccgccgccagaaaggaggtgatcagaaacaagatcagagccatcggcaagatggccagagtgttcagcgtgctgagagaggagagcgagagcgtgctgaccctgaagggcctgacccccaccggcatgctgcccagcggcgtgctgagcggcggcaagcagaccctgcagagcgccaccgtggaggccatcgaggccgacgaggccatcaagggcttcagcccccagcacaagatcaccagcttcgaggaggccaagggcctggacagaatcaacgagagaatgccccccagaagagacgccatgcccagcgacgccaacctgaacagcatcaacaaggccctgaccagcgagaccaacggcaccgacagcaacggcagcaacagcagcaacatccagtag

SEQ ID NO: 12392 - DNA, 1365 bp, Artificial Sequence
  Description of Artificial Sequence: Synthetic coding sequence
atgagcgagcccaaggccatcgaccccaagctgagcaccaccgacagagtggtgaaggtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggccctgaagatcctgtaccccaagaccctgttcctgctgagaggcaaccacgagtgcagacacctgaccgagtacttcaccttcaagcaggagtgcaagatcaagtacagcgagagagtgtacgacgcctgcatggacgccttcgactgcctgcccctggccgccctgatgaaccagcagttcctgtgcgtgcacggcggcctgagccccgagatcaacaccctggacgacatcagaaagctggacagattcaaggagccccccgcctacggccccatgtgcgacatcctgtggagcgaccccctggaggacttcggcaacgagaagacccaggagcacttcacccacaacaccgtgagaggctgcagctacttctacagctaccccgccgtgtgcgagttcctgcagcacaacaacctgctgagcatcctgagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgaacatctgcagcgacgacgagctgggcagcgaggaggacggcttcgacggcgccaccgccgccgccagaaaggaggtgatcagaaacaagatcagagccatcggcaagatggccagagtgttcagcgtgctgagagaggagagcgagagcgtgctgaccctgaagggcctgacccccaccggcatgctgcccagcggcgtgctgagcggcggcaagcagaccctgcagagcgccaccgtggaggccatcgaggccgacgaggccatcaagggcttcagcccccagcacaagatcaccagcttcgaggaggccaagggcctggacagaatcaacgagagaatgccccccagaagagacgccatgcccagcgacgccaacctgaacagcatcaacaaggccctgaccagcgagaccaacggcaccgacagcaacggcagcaacagcagcaacatccagtag

SEQ ID NO: 12393 - DNA, 399 bp, Artificial Sequence
  Description of Artificial Sequence: Synthetic coding sequence
atgaaggagggcagactggaggagagcgtggccctgagaatcatcaccgagggcgccagcatcctgagacaggagaagaacctgctggacatcgacgcccccgtgaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggccctgaagatcctgtaccccaagaccctgttcctgctgagaggcaaccacgagtgcagacacctgaccgagtacttcaccttcaagcaggagtgcaagatcaagtacagcgagagagtgtacgacgcctgcatggacgccttctag

SEQ ID NO: 12394 - DNA, 444 bp, Artificial Sequence
  Description of Artificial Sequence: Synthetic coding sequence
atgaaggagggcagactggaggagagcgtggccctgagaatcatcaccgagggcgccagcatcctgagacaggagaagaacctgctggacatcgacgcccccgtgaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggccctgaagatcctgtaccccaagaccctgttcctgctgagaggcaaccacgagtgcagacacctgaccgagtacttcaccttcaagcaggagtgcaagatcaagtacagcgagagagtgtacgacgcctgcatggacgccttcgactgcctgcccctggccgccctgatgaaccagcagttcctgtgctag

SEQ ID NO: 12395 - DNA, 1491 bp, Artificial Sequence
  Description of Artificial Sequence: Synthetic coding sequence
atggccgcccccgagcccgccagagccgcccccccccccccccccccccccccccccccccccggcgccgacagagtggtgaaggccgtgcccttcccccccacccacagactgaccagcgaggaggtgttcgacctggacggcatccccagagtggacgtgctgaagaaccacctggtgaaggagggcagagtggacgaggagatcgccctgagaatcatcaacgagggcgccgccatcctgagaagagagaagaccatgatcgaggtggaggcccccatcaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggtgctgaagatcctgtaccccagcaccctgttcctgctgagaggcaaccacgagtgcagacacctgaccgagtacttcaccttcaagcaggagtgcaagatcaagtacagcgagagagtgtacgaggcctgcatggaggccttcgacagcctgcccctggccgccctgctgaaccagcagttcctgtgcgtgcacggcggcctgagccccgagatccacaccctggacgacatcagaagactggacagattcaaggagccccccgccttcggccccatgtgcgacctgctgtggagcgaccccagcgaggacttcggcaacgagaagagccaggagcacttcagccacaacaccgtgagaggctgcagctacttctacaactaccccgccgtgtgcgagttcctgcagaacaacaacctgctgagcatcatcagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgagcatctgcagcgacgacgagctgatgaccgagggcgaggaccagttcgacggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcggcaacgacgtgatgcagctggccgtgccccagatggactggggcaccccccacagcttcgccaacaacagccacaacgcctgcagagagttcctgctgttcttcagcagctgcctgagcagctag

SEQ ID NO: 12396 - DNA, 1575 bp, Artificial Sequence
  Description of Artificial Sequence: Synthetic coding sequence
atggccgcccccgagcccgccagagccgcccccccccccccccccccccccccccccccccccggcgccgacagagtggtgaaggccgtgcccttcccccccacccacagactgaccagcgaggaggtgttcgacctggacggcatccccagagtggacgtgctgaagaaccacctggtgaaggagggcagagtggacgaggagatcgccctgagaatcatcaacgagggcgccgccatcctgagaagagagaagaccatgatcgaggtggaggcccccatcaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggtgctgaagatcctgtaccccagcaccctgttcctgctgagaggcaaccacgagtgcagacacctgaccgagtacttcaccttcaagcaggagtgcaagatcaagtacagcgagagagtgtacgaggcctgcatggaggccttcgacagcctgcccctggccgccctgctgaaccagcagttcctgtgcgtgcacggcggcctgagccccgagatccacaccctggacgacatcagaagactggacagattcaaggagccccccgccttcggccccatgtgcgacctgctgtggagcgaccccagcgaggacttcggcaacgagaagagccaggagcacttcagccacaacaccgtgagaggctgcagctacttctacaactaccccgccgtgtgcgagttcctgcagaacaacaacctgctgagcatcatcagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgagcatctgcagcgacgacgagctgatgaccgagggcgaggaccagttcgacggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcgccaccgtggaggccatcgaggccgagaaggccatcagaggcttcagccccccccacagaatctgcagcttcgaggaggccaagggcctggacagaatcaacgagagaatgccccccagaaaggacgccgtgcagcaggacggcttcaacagcctgaacaccgcccacgccaccgagaaccacggcaccggcaaccacaccgcccagtag

SEQ ID NO: 12397 - DNA, 1545 bp, Artificial Sequence
  Description of Artificial Sequence: Synthetic coding sequence
atggccgcccccgagcccgccagagccgcccccccccccccccccccccccccccccccccccggcgccgacagagtggtgaaggccgtgcccttcccccccacccacagactgaccagcgaggaggtgttcgacctggacggcatccccagagtggacgtgctgaagaaccacctggtgaaggagggcagagtggacgaggagatcgccctgagaatcatcaacgagggcgccgccatcctgagaagagagaagaccatgatcgaggtggaggcccccatcaccgtgtgcggcgacatccacggccagttcttcgacctgatgaagctgttcgaggtgggcggcagccccgccaacaccagatacctgttcctgggcgactacgtggacagaggctacttcagcatcgagcacgtgctgggcaccgaggacatcagcatcaacccccacaacaacatcaacgagtgcgtgctgtacctgtgggtgctgaagatcctgtaccccagcaccctgttcctgctgagaggcaaccacgagtgcagacacctgaccgagtacttcaccttcaagcaggagtgcaagatcaagtacagcgagagagtgtacgaggcctgcatggaggccttcgacagcctgcccctggccgccctgctgaaccagcagttcctgtgcgtgcacggcggcctgagccccgagatccacaccctggacgacatcagaagactggacagattcaaggagccccccgccttcggccccatgtgcgacctgctgtggagcgaccccagcgaggacttcggcaacgagaagagccaggagcacttcagccacaacaccgtgagaggctgcagctacttctacaactaccccgccgtgtgcgagttcctgcagaacaacaacctgctgagcatcatcagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgagcatctgcagcgacgacgagctgatgaccgagggcgaggaccagttcgacggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcggcaacgacgtgatgcagctggccgtgccccagatggactggggcaccccccacagcttcgccaacaacagccacaacgcctgcagagagttcctgctgttcttcagcagctgcctgagcagctag

SEQ ID NO: 12398 - DNA, 591 bp, Artificial Sequence
  Description of Artificial Sequence: Synthetic coding sequence
atgaacatcagacagttcaactgcagcccccacccctactggctgcccaacttcatggacgtgttcacctggagcctgcccttcgtgggcgagaaggtgaccgagatgctggtgaacgtgctgagcatctgcagcgacgacgagctgatgaccgagggcgaggaccagttcgacgagagactgatctacggcaacaagaagggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcgccaccgtggaggccatcgaggccgagaaggccatcagaggcttcagccccccccacagaatctgcagcttcgaggaggccaagggcctggacagaatcaacgagagaatgccccccagaaaggacgccgtgcagcaggacggcttcaacagcctgaacaccgcccacgccaccgagaaccacggcaccggcaaccacaccgcccagtag

SEQ ID NO: 12399 - DNA, 1548 bp, Artificial Sequence
  Description of Artificial Sequence: Synthetic coding sequence
atggccgcccccgagcccgccagagccgcccccccccccccccccccccccccccccccccccggcgccgacagagtggtgaaggccgtgcccttcccccccacccacagactgaccagcgaggaggtgttcgacctggacggcatccccagagtggacgtgctgaagaaccacctggtgaaggagggcagagtggacgaggagatcgccctgagaatcatcaacgagggcgccgccatcctgagaagagagaagaccatgatcgaggtggaggcccccatcaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggtgctgaagatcctgtaccccagcaccctgttcctgctgagaggcaaccacgagtgcagacacctgaccgagtacttcaccttcaagcaggagtgcaagatcaagtacagcgagagagtgtacgaggcctgcatggaggccttcgacagcctgcccctggccgccctgctgaaccagcagttcctgtgcgtgcacggcggcctgagccccgagatccacaccctggacgacatcagaagactggacagattcaaggagccccccgccttcggccccatgtgcgacctgctgtggagcgaccccagcgaggacttcggcaacgagaagagccaggagcacttcagccacaacaccgtgagaggctgcagctacttctacaactaccccgccgtgtgcgagttcctgcagaacaacaacctgctgagcatcatcagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgagcatctgcagcgacgacgagctgatgaccgagggcgaggaccagttcgacgtgggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcgccatcagaggcttcagccccccccacagaatctgcagcttcgaggaggccaagggcctggacagaatcaacgagagaatgccccccagaaaggacgccgtgcagcaggacggcttcaacagcctgaacaccgcccacgccaccgagaaccacggcaccggcaaccacaccgcccagtag

SEQ ID NO: 12400 - DNA, 1578 bp, Artificial Sequence
  Description of Artificial Sequence: Synthetic coding sequence
atggccgcccccgagcccgccagagccgcccccccccccccccccccccccccccccccccccggcgccgacagagtggtgaaggccgtgcccttcccccccacccacagactgaccagcgaggaggtgttcgacctggacggcatccccagagtggacgtgctgaagaaccacctggtgaaggagggcagagtggacgaggagatcgccctgagaatcatcaacgagggcgccgccatcctgagaagagagaagaccatgatcgaggtggaggcccccatcaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggtgctgaagatcctgtaccccagcaccctgttcctgctgagaggcaaccacgagtgcagacacctgaccgagtacttcaccttcaagcaggagtgcaagatcaagtacagcgagagagtgtacgaggcctgcatggaggccttcgacagcctgcccctggccgccctgctgaaccagcagttcctgtgcgtgcacggcggcctgagccccgagatccacaccctggacgacatcagaagactggacagattcaaggagccccccgccttcggccccatgtgcgacctgctgtggagcgaccccagcgaggacttcggcaacgagaagagccaggagcacttcagccacaacaccgtgagaggctgcagctacttctacaactaccccgccgtgtgcgagttcctgcagaacaacaacctgctgagcatcatcagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgagcatctgcagcgacgacgagctgatgaccgagggcgaggaccagttcgacgtgggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcgccaccgtggaggccatcgaggccgagaaggccatcagaggcttcagccccccccacagaatctgcagcttcgaggaggccaagggcctggacagaatcaacgagagaatgccccccagaaaggacgccgtgcagcaggacggcttcaacagcctgaacaccgcccacgccaccgagaaccacggcaccggcaaccacaccgcccagtag

SEQ ID NO: 12401 - DNA, 561 bp, Artificial Sequence
  Description of Artificial Sequence: Synthetic coding sequence
cacccctactggctgcccaacttcatggacgtgttcacctggagcctgcccttcgtgggcgagaaggtgaccgagatgctggtgaacgtgctgagcatctgcagcgacgacgagctgatgaccgagggcgaggaccagttcgacgagagactgatctacggcaacaagaagggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcgccaccgtggaggccatcgaggccgagaaggccatcagaggcttcagccccccccacagaatctgcagcttcgaggaggccaagggcctggacagaatcaacgagagaatgccccccagaaaggacgccgtgcagcaggacggcttcaacagcctgaacaccgcccacgccaccgagaaccacggcaccggcaaccacaccgcccagtag

SEQ ID NO: 12402 - DNA, 459 bp, Artificial Sequence
  Description of Artificial Sequence: Synthetic coding sequence
atgctggtgaacgtgctgagcatctgcagcgacgacgagctgatgaccgagggcgaggaccagttcgacggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcgccaccgtggaggccatcgaggccgagaaggccatcagaggcttcagccccccccacagaatctgcagcttcgaggaggccaagggcctggacagaatcaacgagagaatgccccccagaaaggacgccgtgcagcaggacggcttcaacagcctgaacaccgcccacgccaccgagaaccacggcaccggcaaccacaccgcccagtag

SEQ ID NO: 12403 - DNA, 1236 bp, Artificial Sequence
  Description of Artificial Sequence: Synthetic coding sequence
atgatcgaggtggaggcccccatcaccgtgtgcggcgacatccacggccagttcttcgacctgatgaagctgttcgaggtgggcggcagccccgccaacaccagatacctgttcctgggcgactacgtggacagaggctacttcagcatcgagtgcgtgctgtacctgtgggtgctgaagatcctgtaccccagcaccctgttcctgctgagaggcaaccacgagtgcagacacctgaccgagtacttcaccttcaagcaggagtgcaagatcaagtacagcgagagagtgtacgaggcctgcatggaggccttcgacagcctgcccctggccgccctgctgaaccagcagttcctgtgcgtgcacggcggcctgagccccgagatccacaccctggacgacatcagaagactggacagattcaaggagccccccgccttcggccccatgtgcgacctgctgtggagcgaccccagcgaggacttcggcaacgagaagagccaggagcacttcagccacaacaccgtgagaggctgcagctacttctacaactaccccgccgtgtgcgagttcctgcagaacaacaacctgctgagcatcatcagagcccacgaggcccaggacgccggctacagaatgtacagaaagagccagaccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgagcatctgcagcgacgacgagctgatgaccgagggcgaggaccagttcgacgtgggcagcgccgccgccagaaaggagatcatcagaaacaagatcagagccatcggcaagatggccagagtgttcagcgtgctgagagaggagagcgagagcgtgctgaccctgaagggcctgacccccaccggcatgctgcccagcggcgtgctggccggcggcagacagaccctgcagagcggcaacgacgtgatgcagctggccgtgccccagatggactggggcaccccccacagcttcgccaacaacagccacaacgcctgcagagagttcctgctgttcttcagcagctgcctgagcagctag

SEQ ID NO: 12404 - DNA, 1539 bp, Artificial Sequence
  Description of Artificial Sequence: Synthetic coding sequence
atgagcggcagaagattccacctgagcaccaccgacagagtgatcaaggccgtgcccttcccccccacccagagactgaccttcaaggaggtgttcgagaacggcaagcccaaggtggacgtgctgaagaaccacctggtgaaggagggcagactggaggaggaggtggccctgaagatcatcaacgacggcgccgccatcctgagacaggagaagaccatgatcgaggtggacgcccccatcaccgtgtgcggcgacatccacggccagttcttcgacctgatgaagctgttcgaggtgggcggcagccccagcaacaccagatacctgttcctgggcgactacgtggacagaggctacttcagcatcgagtgcgtgctgtacctgtggagcctgaagatcaaccaccccaagaccctgttcctgctgagaggcaaccacgagtgcagacacctgaccgactacttcaccttcaagcaggagtgcagaatcaagtacagcgagcaggtgtacgacgcctgcatggagaccttcgactgcctgcccctggccgccctgctgaaccagcagttcctgtgcgtgcacggcggcatgagccccgagatcaccagcctggacgacatcagaaagctggacagattcaccgagccccccgccttcggccccgtgtgcgacctgctgtggagcgaccccagcgaggactacggcaacgagaagaccctggagcactacacccacaacaccgtgagaggctgcagctacttctacagctaccccgccgtgtgcgagttcctgcagaacaacaacctgctgagcatcatcagagcccacgaggcccaggacgccggctacagaatgtacagaaagagccaggccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgaacatctgcagcgacgacgagctgatcagcgacgacgaggccgagggcagcaccaccgtgagaaaggagatcatcagaaacaagatcagagccatcggcaagatggccagagtgttcagcatcctgagacaggagagcgagagcgtgctgaccctgaagggcctgacccccaccggcaccctgcccctgggcgtgctgagcggcggcaagcagaccatcgagaccgccaccgtggaggccgtggaggccagagaggccatcagaggcttcagcctgcagcacaagatcagaagcttcgaggaggccagaggcctggacagaatcaacgagagaatgccccccagaaaggacagcatccacgccggcggccccatgaagagcgtgaccagcgcccacagccacgccgcccacagaagcgaccagggcaagaaggcccacagctag

SEQ ID NO: 12405 - DNA, 1509 bp, Artificial Sequence
  Description of Artificial Sequence: Synthetic coding sequence
atgagcggcagaagattccacctgagcaccaccgacagagtgatcaaggccgtgcccttcccccccacccagagactgaccttcaaggaggtgttcgagaacggcaagcccaaggtggacgtgctgaagaaccacctggtgaaggagggcagactggaggaggaggtggccctgaagatcatcaacgacggcgccgccatcctgagacaggagaagaccatgatcgaggtggacgcccccatcaccgtgtgcggcgacatccacggccagttcttcgacctgatgaagctgttcgaggtgggcggcagccccagcaacaccagatacctgttcctgggcgactacgtggacagaggctacttcagcatcgagtgcgtgctgtacctgtggagcctgaagatcaaccaccccaagaccctgttcctgctgagaggcaaccacgagtgcagacacctgaccgactacttcaccttcaagcaggagtgcagaatcaagtacagcgagcaggtgtacgacgcctgcatggagaccttcgactgcctgcccctggccgccctgctgaaccagcagttcctgtgcgtgcacggcggcatgagccccgagatcaccagcctggacgacatcagaaagctggacagattcaccgagccccccgccttcggccccgtgtgcgacctgctgtggagcgaccccagcgaggactacggcaacgagaagaccctggagcactacacccacaacaccgtgagaggctgcagctacttctacagctaccccgccgtgtgcgagttcctgcagaacaacaacctgctgagcatcatcagagcccacgaggcccaggacgccggctacagaatgtacagaaagagccaggccaccggcttccccagcctgatcaccatcttcagcgcccccaactacctggacgtgtacaacaacaaggccgccgtgctgaagtacgagaacaacgtgatgaacatcagacagttcaactgcagcccccacccctactggctgcccaacttcatggacgtgttcacctggagcctgcccttcgtgggcgagaaggtgaccgagatgctggtgaacgtgctgaacatctgcagcgacgacgagctgatcagcgacgacgaggccgagggcagcaccaccgtgagaaaggagatcatcagaaacaagatcagagccatcggcaagatggccagagtgttcagcatcctgagacaggagagcgagagcgtgctgaccctgaagggcctgacccccaccggcaccctgcccctgggcgtgctgagcggcggcaagcagaccatcgagaccgccatcagaggcttcagcctgcagcacaagatcagaagcttcgaggaggccagaggcctggacagaatcaacgagagaatgccccccagaaaggacagcatccacgccggcggccccatgaagagcgtgaccagcgcccacagccacgccgcccacagaagcgaccagggcaagaaggcccacagctag

SEQ ID NO: 12406 - DNA, 345 bp, Artificial Sequence
  Description of Artificial Sequence: Synthetic coding sequence
atgtactacaagttcagcggcttcacccagaagctggccggcgcctgggccagcgaggcctacagcccccagggcctgaagcccgtggtgagcaccgaggccccccccatcatcttcgccacccccaccaagctgaccagcgacagcaccgtgtacgactacgccggcaagaacaaggtgcccgagctgcagaagttcttccagaaggccgacggcgtgcccgtgtacctgaagagaggcctgcccgaccagatgctgtacagaaccaccatggccctgaccgtgggcggcaccatctactgcctgatcgccctgtacatggccagccagcccaagaacaagtag

SEQ ID NO: 12407 - DNA, 522 bp, Artificial Sequence
  Description of Artificial Sequence: Synthetic coding sequence
atgagcaccatgggcaacgaggccagctaccccgccgagatgtgcagccacttcgacaacgacgagatcaagagactgggcagaagattcaagaagctggacctggacaagagcggcagcctgagcgtggaggagttcatgagcctgcccgagctgagacacaaccccctggtgagaagagtgatcgacgtgttcgacaccgacggcgacggcgaggtggacttcaaggagttcatcctgggcaccagccagttcagcgtgaagggcgacgaggagcagaagctgagattcgccttcagcatctacgacatggacaaggacggctacatcagcaacggcgagctgttccaggtgctgaagatgatggtgggcaacaacctgaccgactggcagctgcagcagctggtggacaagaccatcatcatcctggacaaggacggcgacggcaagatcagcttcgaggagttcagcgccgtggtgagagacctggagatccacaagaagctggtgctgatcgtgtag

SEQ ID NO: 12408 - DNA, 420 bp, Artificial Sequence
  Description of Artificial Sequence: Synthetic coding sequence
atgagcaccatgggcaacgaggccagctaccccgccgagatgtgcagccacttcgacaacgacgagatcaagagactgggcagaagattcaagaagctggacctggacaagagcggcagcctgagcgtggaggagttcatgagcctgcccgagctgagacacaaccccctggtgagaagagtgatcgacgtgttcgacaccgacggcgacggcgaggtggacttcaaggagttcatcctgggcaccagccagttcagcgtgaagggcgacgaggagcagaagctgagattcgccttcagcatctacgacatggacaaggacggctacatcagcaacggcgagctgttccaggtgctgaagatgatggtgggcaacaacctgaccgactggcagctgcagcagctggtgctgatcgtgtag

SEQ ID NO: 12409 - DNA, 1818 bp, Artificial Sequence
  Description of Artificial Sequence: Synthetic coding sequence
atggccggcctgtacagcctgggcgtgagcgtgttcagcgaccagggcggcagaaagtacatggaggacgtgacccagatcgtggtggagcccgagcccaccgccgaggagaagcccagccccagaagaagcctgagccagcccctgccccccagacccagccccgccgccctgcccggcggcgaggtgagcggcaagggccccgccgtggccgccagagaggccagagaccccctgcccgacgccggcgccagccccgcccccagcagatgctgcagaagaagaagcagcgtggccttcttcgccgtgtgcgacggccacggcggcagagaggccgcccagttcgccagagagcacctgtggggcttcatcaagaagcagaagggcttcaccagcagcgagcccgccaaggtgtgcgccgccatcagaaagggcttcctggcctgccacctggccatgtggaagaagctggccgagtggcccaagaccatgaccggcctgcccagcaccagcggcaccaccgccagcgtggtgatcatcagaggcatgaagatgtacgtggcccacgtgggcgacagcggcgtggtgctgggcatccaggacgaccccaaggacgacttcgtgagagccgtggaggtgacccaggaccacaagcccgagctgcccaaggagagagagagaatcgagggcctgggcggcagcgtgatgaacaagagcggcgtgaacagagtggtgtggaagagacccagactgacccacaacggccccgtgagaagaagcaccgtgatcgaccagatccccttcctggccgtggccagagccctgggcgacctgtggagctacgacttcttcagcggcgagttcgtggtgagccccgagcccgacaccagcgtgcacaccctggacccccagaagcacaagtacatcatcctgggcagcgacggcctgtggaacatgatccccccccaggacgccatcagcatgtgccaggaccaggaggagaagaagtacctgatgggcgagcacggccagagctgcgccaagatgctggtgaacagagccctgggcagatggagacagagaatgctgagagccgacaacaccagcgccatcgtgatctgcatcagccccgaggtggacaaccagggcaacttcaccaacgaggacgagctgtacctgaacctgaccgacagccccagctacaacagccaggagacctgcgtgatgacccccagcccctgcagcaccccccccgtgaagagcctggaggaggacccctggcccagagtgaacagcaaggaccacatccccgccctggtgagaagcaacgccttcagcgagaacttcctggaggtgagcgccgagatcgccagagagaacgtgcagggcgtggtgatccccagcaaggaccccgagcccctggaggagaactgcgccaaggccctgaccctgagaatccacgacagcctgaacaacagcctgcccatcggcctggtgcccaccaacagcaccaacaccgtgatggaccagaagaacctgaagatgagcacccccggccagatgaaggcccaggagatcgagagaaccccccccaccaacttcaagagaaccctggaggagagcaacagcggccccctgatgaagaagcacagaagaaacggcctgagcagaagcagcggcgcccagcccgccagcctgcccaccaccagccagagaaagaacagcgtgaagctgaccatgagaagaagactgagaggccagaagaagatcggcaaccccctgctgcaccagcacagaaagaccgtgtgcgtgtgctag

SEQ ID NO: 12410 - DNA, 1293 bp, Artificial Sequence
  Description of Artificial Sequence: Synthetic coding sequence
atggccggcctgtacagcctgggcgtgagcgtgttcagcgaccagggcggcagaaagtacatggaggacgtgacccagatcgtggtggagcccgagcccaccgccgaggagaagcccagccccagaagaagcctgagccagcccctgccccccagacccagccccgccgccctgcccggcggcgaggtgagcggcaagggccccgccgtggccgccagagaggccagagaccccctgcccgacgccggcgccagccccgcccccagcagatgctgcagaagaagaagcagcgtggccttcttcgccgtgtgcgacggccacggcggcagagaggccgcccagttcgccagagagcacctgtggggcttcatcaagaagcagaagggcttcaccagcagcgagcccgccaaggtgtgcgccgccatcagaaagggcttcctggcctgccacctggccatgtggaagaagctggccgagtggcccaagaccatgaccggcctgcccagcaccagcggcaccaccgccagcgtggtgatcatcagaggcatgaagatgtacgtggcccacgtgggcgacagcggcgtggtgctgggcatccaggacgaccccaaggacgacttcgtgagagccgtggaggtgacccaggaccacaagcccgagctgcccaaggagagagagagaatcgagggcctgggcggcagcgtgatgaacaagagcggcgtgaacagagtggtgtggaagagacccagactgacccacaacggccccgtgagaagaagcaccgtgatcgaccagatccccttcctggccgtggccagagccctgggcgacctgtggagctacgacttcttcagcggcgagttcgtggtgagccccgagcccgacaccagcgtgcacaccctggacccccagaagcacaagtacatcatcctgggcagcgacggcctgtggaacatgatccccccccaggacgccatcagcatgtgccaggaccaggaggagaagaagtacctgatgggcgagcacggccagagctgcgccaagatgctggtgaacagagccctgggcagatggagacagagaatgctgagagccgacaacaccagcgccatcgtgatctgcatcagccccgaggtggacaaccagggcaacttcaccaacgaggacgagctgtacctgaacctgaccgacagccccagctacaacagccaggagacctgcgtgatgacccccagcccctgcagcaccccccccgtgaaggacttcggcttcgagctggacagcagaaagtag

SEQ ID NO: 12411 - DNA, 837 bp, Artificial Sequence
  Description of Artificial Sequence: Synthetic coding sequence
atgtggaagaagctggccgagtggcccaagaccatgaccggcctgcccagcaccagcggcaccaccgccagcgtggtgatcatcagaggcatgaagatgtacgtggcccacgtgggcgacagcggcgtggtgctgggcatccaggacgaccccaaggacgacttcgtgagagccgtggaggtgacccaggaccacaagcccgagctgcccaaggagagagagagaatcgagggcctgggcggcagcgtgatgaacaagagcggcgtgaacagagtggtgtggaagagacccagactgacccacaacggccccgtgagaagaagcaccgtgatcgaccagatccccttcctggccgtggccagagccctgggcgacctgtggagctacgacttcttcagcggcgagttcgtggtgagccccgagcccgacaccagcgtgcacaccctggacccccagaagcacaagtacatcatcctgggcagcgacggcctgtggaacatgatccccccccaggacgccatcagcatgtgccaggaccaggaggagaagaagtacctgatgggcgagcacggccagagctgcgccaagatgctggtgaacagagccctgggcagatggagacagagaatgctgagagccgacaacaccagcgccatcgtgatctgcatcagccccgaggtggacaaccagggcaacttcaccaacgaggacgagctgtacctgaacctgaccgacagccccagctacaacagccaggagacctgcgtgatgacccccagcccctgcagcaccccccccgtgaaggacttcggcttcgagctggacagcagaaagtag

SEQ ID NO: 12412 - DNA, 3432 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcacgactgcacccaggtggagaaggccgacaccaccatctgcctgaagtggaagaacatcgagaccttcacctgcgacacccagaacatcacctacagattccagtgcggcaacatgatcttcgacaacaaggagatcaagctggagaacctggagcccgagcacgagtacaagtgcgacagcgagatcctgtacaacaaccacaagttcaccaacgccagcaagatcatcaagaccgacttcggcagccccggcgagccccagatcatcttctgcagaagcgaggccgcccaccagggcgtgatcacctggaaccccccccagagaagcttccacaacttcaccctgtgctacatcaaggagaccgagaaggactgcctgaacctggacaagaacctgatcaagtacgacctgcagaacctgaagccctacaccaagtacgtgctgagcctgcacgcctacatcatcgccaaggtgcagagaaacggcagcgccgccatgtgccacttcaccaccaagagcgccccccccagccaggtgtggaacatgaccgtgagcatgaccagcgacaacagcatgcacgtgaagtgcagaccccccagagacagaaacggcccccacgagagataccacctggaggtggaggccggcaacaccctggtgagaaacgagagccacaagaactgcgacttcagagtgaaggacctgcagtacagcaccgactacaccttcaaggcctacttccacaacggcgactaccccggcgagcccttcatcctgcaccacagcaccagctacaacagcaaggccctgatcgccttcctggccttcctgatcatcgtgaccagcatcgccctgctggtggtgctgtacaagatctacgacctgcacaagaagagaagctgcaacctggacgagcagcaggagctggtggagagagacgacgagaagcagctgatgaacgtggagcccatccacgccgacatcctgctggagacctacaagagaaagatcgccgacgagggcagactgttcctggccgagttccagagcatccccagagtgttcagcaagttccccatcaaggaggccagaaagcccttcaaccagaacaagaacagatacgtggacatcctgccctacgactacaacagagtggagctgagcgagatcaacggcgacgccggcagcaactacatcaacgccagctacatcgacggcttcaaggagcccagaaagtacatcgccgcccagggccccagagacgagaccgtggacgacttctggagaatgatctgggagcagaaggccaccgtgatcgtgatggtgaccagatgcgaggagggcaacagaaacaagtgcgccgagtactggcccagcatggaggagggcaccagagccttcggcgacgtggtggtgaagatcaaccagcacaagagatgccccgactacatcatccagaagctgaacatcgtgaacaagaaggagaaggccaccggcagagaggtgacccacatccagttcaccagctggcccgaccacggcgtgcccgaggacccccacctgctgctgaagctgagaagaagagtgaacgccttcagcaacttcttcagcggccccatcgtggtgcactgcagcgccggcgtgggcagaaccggcacctacatcggcatcgacgccatgctggagggcctggaggccgagaacaaggtggacgtgtacggctacgtggtgaagctgagaagacagagatgcctgatggtgcaggtggaggcccagtacatcctgatccaccaggccctggtggagtacaaccagttcggcgagaccgaggtgaacctgagcgagctgcacccctacctgcacaacatgaagaagagagacccccccagcgagcccagccccctggaggccgagttccagagactgcccagctacagaagctggagaacccagcacatcggcaaccaggaggagaacaagagcaagaacagaaacagcaacgtgatcccctacgactacaacagagtgcccctgaagcacgagctggagatgagcaaggagagcgagcacgacagcgacgagagcagcgacgacgacagcgacagcgaggagcccagcaagtacatcaacgccagcttcatcatgagctactggaagcccgaggtgatgatcgccgcccagggccccctgaaggagaccatcggcgacttctggcagatgatcttccagagaaaggtgaaggtgatcgtgatgctgaccgagctgaagcacggcgaccaggagatctgcgcccagtactggggcgagggcaagcagacctacggcgacatcgaggtggacctgaaggacaccgacaagagcagcacctacaccctgagagtgttcgagctgagacacagcaagagaaaggacagcagaaccgtgtaccagtaccagtacaccaactggagcgtggagcagctgcccgccgagcccaaggagctgatcagcatgatccaggtggtgaagcagaagctgccccagaagaacagcagcgagggcaacaagcaccacaagagcacccccctgctgatccactgcagagacggcagccagcagaccggcatcttctgcgccctgctgaacctgctggagagcgccgagaccgaggaggtggtggacatcttccaggtggtgaaggccctgagaaaggccagacccggcatggtgagcaccttcgagcagtaccagttcctgtacgacgtgatcgccagcacctaccccgcccagaacggccaggtgaagaagaacaaccaccaggaggacaagatcgagttcgacaacgaggtggacaaggtgaagcaggacgccaactgcgtgaaccccctgggcgcccccgagaagctgcccgaggccaaggagcaggccgagggcagcgagcccaccagcggcaccgagggccccgagcacagcgtgaacggccccgccagccccgccctgaaccagggcagctag

SEQ ID NO: 12413 - DNA, 105 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccggcaagaactag

SEQ ID NO: 12414 - DNA, 447 bp, Artificial Sequence
  Description of Artificial Sequence: Synthetic coding sequence
atggccagaatgaacagacccgcccccgtggaggtgacctacaagaacatgagattcctgatcacccacaaccccaccaacgccaccctgaacaagttcatcgaggagctgaagaagtacggcgtgaccaccatcgtgagagtgtgcgaggccacctacgacaccaccctggtggagaaggagggcatccacgtgctggactggcccttcgacgacggcgccccccccagcaaccagatcgtggacgactggctgagcctggtgaagatcaagttcagagaggagcccggctgctgcatcgccgtgcactgcgtggccggcctgggcagaaagagaagaggcgccttcaacagcaagcagctgctgtacctggagaagtacagacccaagatgagactgagattcaaggacagcaacggccacagaaacaactgctgcatccagtag

SEQ ID NO: 12415 - DNA, 447 bp, Artificial Sequence; identical to SEQ ID NO: 12414
  Description of Artificial Sequence: Synthetic coding sequence

SEQ ID NO: 12416 - DNA, 522 bp, Artificial Sequence
  Description of Artificial Sequence: Synthetic coding sequence
atggccagaatgaacagacccgcccccgtggaggtgacctacaagaacatgagattcctgatcacccacaaccccaccaacgccaccctgaacaagttcatcgaggagctgaagaagtacggcgtgaccaccatcgtgagagtgtgcgaggccacctacgacaccaccctggtggagaaggagggcatccacgtgctggactggcccttcgacgacggcgccccccccagcaaccagatcgtggacgactggctgagcctggtgaagatcaagttcagagaggagcccggctgctgcatcgccgtgcactgcgtggccggcctgggcagagcccccgtgctggtggccctggccctgatcgagggcggcatgaagtacgaggacgccgtgcagttcatcagacagaagagaagaggcgccttcaacagcaagcagctgctgtacctggagaagtacagacccaagatgagactgagattcaaggacagcaacggccacagaaacaactgctgcatccagtag

SEQ ID NO: 12417 - DNA, 1308 bp, Artificial Sequence
  Description of Artificial Sequence: Synthetic coding sequence
atggagatggagaaggagttcgagcagatcgacaagagcggcagctgggccgccatctaccaggacatcagacacgaggccagcgacttcccctgcagagtggccaagctgcccaagaacaagaacagaaacagatacagagacgtgagccccttcgaccacagcagaatcaagctgcaccaggaggacaacgactacatcaacgccagcctgatcaagatggaggaggcccagagaagctacatcctgacccagggccccctgcccaacacctgcggccacttctgggagatggtgtgggagcagaagagcagaggcgtggtgatgctgaacagagtgatggagaagggcagcctgaagtgcgcccagtactggccccagaaggaggagaaggagatgatcttcgaggacaccaacctgaagctgaccctgatcagcgaggacatcaagagctactacaccgtgagacagctggagctggagaacctgaccacccaggagaccagagagatcctgcacttccactacaccacctggcccgacttcggcgtgcccgagagccccgccagcttcctgaacttcctgttcaaggtgagagagagcggcagcctgagccccgagcacggccccgtggtggtgcactgcagcgccggcatcggcagaagcggcaccttctgcctggccgacacctgcctgctgctgatggacaagagaaaggaccccagcagcgtggacatcaagaaggtgctgctggagatgagaaagttcagaatgggcctgatccagaccgccgaccagctgagattcagctacctggccgtgatcgagggcgccaagttcatcatgggcgacagcagcgtgcaggaccagtggaaggagctgagccacgaggacctggagcccccccccgagcacatcccccccccccccagaccccccaagagaatcctggagccccacaacggcaagtgcagagagttcttccccaaccaccagtgggtgaaggaggagacccaggaggacaaggactgccccatcaaggaggagaagggcagccccctgaacgccgccccctacggcatcgagagcatgagccaggacaccgaggtgagaagcagagtggtgggcggcagcctgagaggcgcccaggccgccagccccgccaagggcgagcccagcctgcccgagaaggacgaggaccacgccctgagctactggaagcccttcctggtgaacatgtgcgtggccaccgtgctgaccgccggcgcctacctgtgctacagattcctgttcaacagcaacacctag

SEQ ID NO: 12418 - DNA, 1089 bp, Artificial Sequence
  Description of Artificial Sequence: Synthetic coding sequence
atggaggaggcccagagaagctacatcctgacccagggccccctgcccaacacctgcggccacttctgggagatggtgtgggagcagaagagcagaggcgtggtgatgctgaacagagtgatggagaagggcagcctgaagtgcgcccagtactggccccagaaggaggagaaggagatgatcttcgaggacaccaacctgaagctgaccctgatcagcgaggacatcaagagctactacaccgtgagacagctggagctggagaacctgaccacccaggagaccagagagatcctgcacttccactacaccacctggcccgacttcggcgtgcccgagagccccgccagcttcctgaacttcctgttcaaggtgagagagagcggcagcctgagccccgagcacggccccgtggtggtgcactgcagcgccggcatcggcagaagcggcaccttctgcctggccgacacctgcctgctgctgatggacaagagaaaggaccccagcagcgtggacatcaagaaggtgctgctggagatgagaaagttcagaatgggcctgatccagaccgccgaccagctgagattcagctacctggccgtgatcgagggcgccaagttcatcatgggcgacagcagcgtgcaggaccagtggaaggagctgagccacgaggacctggagcccccccccgagcacatcccccccccccccagaccccccaagagaatcctggagccccacaacggcaagtgcagagagttcttccccaaccaccagtgggtgaaggaggagacccaggaggacaaggactgccccatcaaggaggagaagggcagccccctgaacgccgccccctacggcatcgagagcatgagccaggacaccgaggtgagaagcagagtggtgggcggcagcctgagaggcgcccaggccgccagccccgccaagggcgagcccagcctgcccgagaaggacgaggaccacgccctgagctactggaagcccttcctggtgaacatgtgcgtggccaccgtgctgaccgccggcgcctacctgtgctacagattcctgttcaacagcaacacctag

SEQ ID NO: 12419 - DNA, 1782 bp, Artificial Sequence
  Description of Artificial Sequence: Synthetic coding sequence
atgaccagcagaagatggttccaccccaacatcaccggcgtggaggccgagaacctgctgctgaccagaggcgtggacggcagcttcctggccagacccagcaagagcaaccccggcgacttcaccctgagcgtgagaagaaacggcgccgtgacccacatcaagatccagaacaccggcgactactacgacctgtacggcggcgagaagttcgccaccctggccgagctggtgcagtactacatggagcaccacggccagctgaaggagaagaacggcgacgtgatcgagctgaagtaccccctgaactgcgccgaccccaccagcgagagatggttccacggccacctgagcggcaaggaggccgagaagctgctgaccgagaagggcaagcacggcagcttcctggtgagagagagccagagccaccccggcgacttcgtgctgagcgtgagaaccggcgacgacaagggcgagagcaacgacggcaagagcaaggtgacccacgtgatgatcagatgccaggagctgaagtacgacgtgggcggcggcgagagattcgacagcctgaccgacctggtggagcactacaagaagaaccccatggtggagaccctgggcaccgtgctgcagctgaagcagcccctgaacaccaccagaatcaacgccgccgagatcgagagcagagtgagagagctgagcaagctggccgagaccaccgacaaggtgaagcagggcttctgggaggagttcgagaccctgcagcagcaggagtgcaagctgctgtacagcagaaaggagggccagagacaggagaacaagaacaagaacagatacaagaacatcctgcccttcgaccacaccagagtggtgctgcacgacggcgaccccaacgagcccgtgagcgactacatcaacgccaacatcatcatgcccgagttcgagaccaagtgcaacaacagcaagcccaagaagagctacatcgccacccagggctgcctgcagaacaccgtgaacgacttctggagaatggtgttccaggagaacagcagagtgatcgtgatgaccaccaaggaggtggagagaggcaagagcaagtgcgtgaagtactggcccgacgagtacgccctgaaggagtacggcgtgatgagagtgagaaacgtgaaggagagcgccgcccacgactacaccctgagagagctgaagctgagcaaggtgggccagggcaacaccgagagaaccgtgtggcagtaccacttcagaacctggcccgaccacggcgtgcccagcgaccccggcggcgtgctggacttcctggaggaggtgcaccacaagcaggagagcatcatggacgccggccccgtggtggtgcactgcagcgccggcatcggcagaaccggcaccttcatcgtgatcgacatcctgatcgacatcatcagagagaagggcgtggactgcgacatcgacgtgcccaagaccatccagatggtgagaagccagagaagcggcatggtgcagaccgaggcccagtacagattcatctacatggccgtgcagcactacatcgagaccctgcagagaagaatcgaggaggagcagaagagcaagagaaagggccacgagtacaccaacatcaagtacagcctggccgaccagaccagcggcgaccagagccccctgcccccctgcacccccacccccccctgcgccgagatgagagaggacagcgccagagtgtacgagaacgtgggcctgatgcagcagcagaagagcttcagatag

SEQ ID NO: 12420 - DNA, 651 bp, Artificial Sequence
  Description of Artificial Sequence: Synthetic coding sequence
atgaccagcagaagatggttccaccccaacatcaccggcgtggaggccgagaacctgctgctgaccagaggcgtggacggcagcttcctggccagacccagcaagagcaaccccggcgacttcaccctgagcgtgagaagaaacggcgccgtgacccacatcaagatccagaacaccggcgactactacgacctgtacggcggcgagaagttcgccaccctggccgagctggtgcagtactacatggagcaccacggccagctgaaggagaagaacggcgacgtgatcgagctgaagtaccccctgaactgcgccgaccccaccagcgagagatggttccacggccacctgagcggcaaggaggccgagaagctgctgaccgagaagggcaagcacggcagcttcctggtgagagagagccagagccaccccggcgacttcgtgctgagcgtgagaaccggcgacgacaagggcgagagcaacgacggcaagagcaaggtgacccacgtgatgatcagatgccaggagctgaagtacgacgtgggcggcggcgagagattcgacagcctgaccgacctggtggagcactacaagaagaaccccatggtggagaccctgggcaccgtgctgcagctgaagcagcccctgtag

SEQ ID NO: 12421 - DNA, 1383 bp, Artificial Sequence
  Description of Artificial Sequence: Synthetic coding sequence
atgaccagcagaagatggttccaccccaacatcaccggcgtggaggccgagaacctgctgctgaccagaggcgtggacggcagcttcctggccagacccagcaagagcaaccccggcgacttcaccctgagcgtgagaagaaacggcgccgtgacccacatcaagatccagaacaccggcgactactacgacctgtacggcggcgagaagttcgccaccctggccgagctggtgcagtactacatggagcaccacggccagctgaaggagaagaacggcgacgtgatcgagctgaagtaccccctgaactgcgccgaccccaccagcgagagatggttccacggccacctgagcggcaaggaggccgagaagctgctgaccgagaagggcaagcacggcagcttcctggtgagagagagccagagccaccccggcgacttcgtgctgagcgtgagaaccggcgacgacaagggcgagagcaacgacggcaagagcaaggtgacccacgtgatgatcagatgccaggagctgaagtacgacgtgggcggcggcgagagattcgacagcctgaccgacctggtggagcactacaagaagaaccccatggtggagaccctgggcaccgtgctgcagctgaagcagcccctgaacaccaccagaatcaacgccgccgagatcgagagcagagtgagagagctgagcaagctggccgagaccaccgacaaggtgaagcagggcttctgggaggagttcgagaccctgcagcagcaggagtgcaagctgctgtacagcagaaaggagggccagagacaggagaacaagaacaagaacagatacaagaacatcctgcccttcgaccacaccagagtggtgctgcacgacggcgaccccaacgagcccgtgagcgactacatcaacgccaacatcatcatgcccgagttcgagaccaagtgcaacaacagcaagcccaagaagagctacatcgccacccagggctgcctgcagaacaccgtgaacgacttctggagaatggtgttccaggagaacagcagagtgatcgtgatgaccaccaaggaggtggagagaggcaagagcaagtgcgtgaagtactggcccgacgagtacgccctgaaggagtacggcgtgatgagagtgagaaacgtgaaggagagcgccgcccacgactacaccctgagagagctgaagctgagcaaggtgggccagggcaacaccgagagaaccgtgtggcagtaccacttcagaacctggcccgaccacggcgtgcccagcgaccccggcggcgtgctggacttcctggaggaggtgcaccacaagcaggagagcatcatggacgccggccccgtggtggtgcactgcagatag

SEQ ID NO: 12422 - DNA, 723 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccggccacctgcaggccgaggagcagggcagccagagcaagagccccaacctgaagagcagagaggccgacagcagcgccttcagctggtggcccaaggccagagagcccctgaccaaccactggagactgaccaccgccaagatgcccagcgtgcccctgagcagcgaccccctgcccacccacaccaccgccttcagccccgccagcaccttcgagagagagaacgacttcagcgagaccaccaccagcctgagccccgacaacaccagcacccaggtgagccccgacagcctggacaacgccagcgccttcaacaccaccggcgtgagcagcgtgcagaccccccacctgcccacccacgccgacagccagacccccagcgccggcaccgacacccagaccttcagcggcagcgccgccaacgccaagctgaaccccacccccggcagcaacgccatcagcgacgtgcccggcgagagaagcaccgccagcaccttccccaccgaccccgtgagccccctgaccaccaccctgagcctggcccaccacagcagcgccgccctgcccgccagaaccagcaacaccaccatcaccgccaacaccagcgacgcctacctgaacgccagctag

SEQ ID NO: 12423 - DNA, 3432 bp, Artificial Sequence; identical to SEQ ID NO: 12412
  Description of Artificial Sequence: Synthetic coding sequence

SEQ ID NO: 12424 - DNA, 3771 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccggcctgaccaccgccaagatgcccagcgtgcccctgagcagcgaccccctgcccacccacaccaccgccttcagccccgccagcaccttcgagagagagaacgacttcagcgagaccaccaccagcctgagccccgacaacaccagcacccaggtgagccccgacagcctggacaacgccagcgccttcaacaccaccggcgtgagcagcgtgcagaccccccacctgcccacccacgccgacagccagacccccagcgccggcaccgacacccagaccttcagcggcagcgccgccaacgccaagctgaaccccacccccggcagcaacgccatcagcgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcacgactgcacccaggtggagaaggccgacaccaccatctgcctgaagtggaagaacatcgagaccttcacctgcgacacccagaacatcacctacagattccagtgcggcaacatgatcttcgacaacaaggagatcaagctggagaacctggagcccgagcacgagtacaagtgcgacagcgagatcctgtacaacaaccacaagttcaccaacgccagcaagatcatcaagaccgacttcggcagccccggcgagccccagatcatcttctgcagaagcgaggccgcccaccagggcgtgatcacctggaaccccccccagagaagcttccacaacttcaccctgtgctacatcaaggagaccgagaaggactgcctgaacctggacaagaacctgatcaagtacgacctgcagaacctgaagccctacaccaagtacgtgctgagcctgcacgcctacatcatcgccaaggtgcagagaaacggcagcgccgccatgtgccacttcaccaccaagagcgccccccccagccaggtgtggaacatgaccgtgagcatgaccagcgacaacagcatgcacgtgaagtgcagaccccccagagacagaaacggcccccacgagagataccacctggaggtggaggccggcaacaccctggtgagaaacgagagccacaagaactgcgacttcagagtgaaggacctgcagtacagcaccgactacaccttcaaggcctacttccacaacggcgactaccccggcgagcccttcatcctgcaccacagcaccagctacaacagcaaggccctgatcgccttcctggccttcctgatcatcgtgaccagcatcgccctgctggtggtgctgtacaagatctacgacctgcacaagaagagaagctgcaacctggacgagcagcaggagctggtggagagagacgacgagaagcagctgatgaacgtggagcccatccacgccgacatcctgctggagacctacaagagaaagatcgccgacgagggcagactgttcctggccgagttccagagcatccccagagtgttcagcaagttccccatcaaggaggccagaaagcccttcaaccagaacaagaacagatacgtggacatcctgccctacgactacaacagagtggagctgagcgagatcaacggcgacgccggcagcaactacatcaacgccagctacatcgacggcttcaaggagcccagaaagtacatcgccgcccagggccccagagacgagaccgtggacgacttctggagaatgatctgggagcagaaggccaccgtgatcgtgatggtgaccagatgcgaggagggcaacagaaacaagtgcgccgagtactggcccagcatggaggagggcaccagagccttcggcgacgtggtggtgaagatcaaccagcacaagagatgccccgactacatcatccagaagctgaacatcgtgaacaagaaggagaaggccaccggcagagaggtgacccacatccagttcaccagctggcccgaccacggcgtgcccgaggacccccacctgctgctgaagctgagaagaagagtgaacgccttcagcaacttcttcagcggccccatcgtggtgcactgcagcgccggcgtgggcagaaccggcacctacatcggcatcgacgccatgctggagggcctggaggccgagaacaaggtggacgtgtacggctacgtggtgaagctgagaagacagagatgcctgatggtgcaggtggaggcccagtacatcctgatccaccaggccctggtggagtacaaccagttcggcgagaccgaggtgaacctgagcgagctgcacccctacctgcacaacatgaagaagagagacccccccagcgagcccagccccctggaggccgagttccagagactgcccagctacagaagctggagaacccagcacatcggcaaccaggaggagaacaagagcaagaacagaaacagcaacgtgatcccctacgactacaacagagtgcccctgaagcacgagctggagatgagcaaggagagcgagcacgacagcgacgagagcagcgacgacgacagcgacagcgaggagcccagcaagtacatcaacgccagcttcatcatgagctactggaagcccgaggtgatgatcgccgcccagggccccctgaaggagaccatcggcgacttctggcagatgatcttccagagaaaggtgaaggtgatcgtgatgctgaccgagctgaagcacggcgaccaggagatctgcgcccagtactggggcgagggcaagcagacctacggcgacatcgaggtggacctgaaggacaccgacaagagcagcacctacaccctgagagtgttcgagctgagacacagcaagagaaaggacagcagaaccgtgtaccagtaccagtacaccaactggagcgtggagcagctgcccgccgagcccaaggagctgatcagcatgatccaggtggtgaagcagaagctgccccagaagaacagcagcgagggcaacaagcaccacaagagcacccccctgctgatccactgcagagacggcagccagcagaccggcatcttctgcgccctgctgaacctgctggagagcgccgagaccgaggaggtggtggacatcttccaggtggtgaaggccctgagaaaggccagacccggcatggtgagcaccttcgagcagtaccagttcctgtacgacgtgatcgccagcacctaccccgcccagaacggccaggtgaagaagaacaaccaccaggaggacaagatcgagttcgacaacgaggtggacaaggtgaagcaggacgccaactgcgtgaaccccctgggcgcccccgagaagctgcccgaggccaaggagcaggccgagggcagcgagcccaccagcggcaccgagggccccgagcacagcgtgaacggccccgccagccccgccctgaaccagggcagctag

SEQ ID NO: 12425 - DNA, 2208 bp, Artificial Sequence
  Description of Artificial Sequence: Synthetic coding sequence
atgaccatgtacctgtggctgaagctgctggccttcggcttcgccttcctggacaccgaggtgttcgtgaccggccagagccccacccccagccccaccggcgtgagcagcgtgcagaccccccacctgcccacccacgccgacagccagacccccagcgccggcaccgacacccagaccttcagcggcagcgccgccaacgccaagctgaaccccacccccggcagcaacgccatcagcgacgtgcccggcgagagaagcaccgccagcaccttccccaccgaccccgtgagccccctgaccaccaccctgagcctggcccaccacagcagcgccgccctgcccgccagaaccagcaacaccaccatcaccgccaacaccagcgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcacgactgcacccaggtggagaaggccgacaccaccatctgcctgaagtggaagaacatcgagaccttcacctgcgacacccagaacatcacctacagattccagtgcggcaacatgatcttcgacaacaaggagatcaagctggagaacctggagcccgagcacgagtacaagtgcgacagcgagatcctgtacaacaaccacaagttcaccaacgccagcaagatcatcaagaccgacttcggcagccccggcgagccccagatcatcttctgcagaagcgaggccgcccaccagggcgtgatcacctggaaccccccccagagaagcttccacaacttcaccctgtgctacatcaaggagaccgagaaggactgcctgaacctggacaagaacctgatcaagtacgacctgcagaacctgaagccctacaccaagtacgtgctgagcctgcacgcctacatcatcgccaaggtgcagagaaacggcagcgccgccatgtgccacttcaccaccaagagcgccccccccagccaggtgtggaacatgaccgtgagcatgaccagcgacaacagcatgcacgtgaagtgcagaccccccagagacagaaacggcccccacgagagataccacctggaggtggaggccggcaacaccctggtgagaaacgagagccacaagaactgcgacttcagagtgaaggacctgcagtacagcaccgactacaccttcaaggcctacttccacaacggcgactaccccggcgagcccttcatcctgcaccacagcaccagctacaacagcaaggccctgatcgccttcctggccttcctgatcatcgtgaccagcatcgccctgctggtggtgctgtacaagatctacgacctgcacaagaagagaagctgcaacctggacgagcagcaggagctggtggagagagacgacgagaagcagctgatgaacgtggagcccatccacgccgacatcctgctggagacctacaagagaaagatcgccgacgagggcagactgttcctggccgagttccagagcatccccagagtgttcagcaagttccccatcaaggaggccagaaagcccttcaaccagaacaagaacagatacgtggacatcctgccctacgactacaacagagtggagctgagcgagatcaacggcgacgccggcagcaactacatcaacgccagctacatcgacggcttcaaggagcccagaaagtacatcgccgcccagggccccagagacgagaccgtggacgacttctggagaatgatctgggagcagaaggccaccgtgatcgtgatggtgaccagatgcgaggagggcaacagaaacaagtgcgccgagtactggcccagcatggaggagggcaccagagccttcggcgacgtggtggtgaagatcaaccagcacaagagatgccccgactacatcatccagaagctgaacatcgtgaactag

SEQ ID NO: 12426 - DNA, 2202 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccggcgtgagcagcgtgcagaccccccacctgcccacccacgccgacagccagacccccagcgccggcaccgacacccagaccttcagcggcagcgccgccaacgccaagctgaaccccacccccggcagcaacgccatcagcgacgtgcccggcgagagaagcaccgccagcaccttccccaccgaccccgtgagccccctgaccaccaccctgagcctggcccaccacagcagcgccgccctgcccgccagaaccagcaacaccaccatcaccgccaacaccagcgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcacgactgcacccaggtggagaaggccgacaccaccatctgcctgaagtggaagaacatcgagaccttcacctgcgacacccagaacatcacctacagattccagtgcggcaacatgatcttcgacaacaaggagatcaagctggagaacctggagcccgagcacgagtacaagtgcgacagcgagatcctgtacaacaaccacaagttcaccaacgccagcaagatcatcaagaccgacttcggcagccccggcgagccccagatcatcttctgcagaagcgaggccgcccaccagggcgtgatcacctggaaccccccccagagaagcttccacaacttcaccctgtgctacatcaaggagaccgagaaggactgcctgaacctggacaagaacctgatcaagtacgacctgcagaacctgaagccctacaccaagtacgtgctgagcctgcacgcctacatcatcgccaaggtgcagagaaacggcagcgccgccatgtgccacttcaccaccaagagcgccccccccagccaggtgtggaacatgaccgtgagcatgaccagcgacaacagcatgcacgtgaagtgcagaccccccagagacagaaacggcccccacgagagataccacctggaggtggaggccggcaacaccctggtgagaaacgagagccacaagaactgcgacttcagagtgaaggacctgcagtacagcaccgactacaccttcaaggcctacttccacaacggcgactaccccggcgagcccttcatcctgcaccacagcaccagctacaacagcaaggccctgatcgccttcctggccttcctgatcatcgtgaccagcatcgccctgctggtggtgctgtacaagatctacgacctgcacaagaagagaagctgcaacctggacgagcagcaggagctggtggagagagacgacgagaagcagctgatgaacgtggagcccatccacgccgacatcctgctggagacctacaagagaaagatcgccgacgagggcagactgttcctggccgagttccagagcatccccagagtgttcagcaagttccccatcaaggaggccagaaagcccttcaaccagaacaagaacagatacgtggacatcctgccctacgactacaacagagtggagctgagcgagatcaacggcgacgccggcagcaactacatcaacgccagctacatcgacggcttcaaggagcccagaaagtacatcgccgcccagggccccagagacgagaccgtggacgacttctggagaatgatctgggagcagaaggccaccgtgatcgtgatggtgaccagatgcgaggagggcaacagaaacaagtgcgccgagtactggcccagcatggaggagggcaccagagccttcggcgacgtggtggtgaagatcaaccagcacaagagatgccccgactacatcatccagaagctgaacatcgtgaactag

SEQ ID NO: 12427 - DNA, 3921 bp, Artificial Sequence
  Description of Artificial Sequence: Synthetic coding sequence
atgaccatgtacctgtggctgaagctgctggccttcggcttcgccttcctggacaccgaggtgttcgtgaccggccagagccccacccccagccccaccggcctgaccaccgccaagatgcccagcgtgcccctgagcagcgaccccctgcccacccacaccaccgccttcagccccgccagcaccttcgagagagagaacgacttcagcgagaccaccaccagcctgagccccgacaacaccagcacccaggtgagccccgacagcctggacaacgccagcgccttcaacaccaccggcgtgagcagcgtgcagaccccccacctgcccacccacgccgacagccagacccccagcgccggcaccgacacccagaccttcagcggcagcgccgccaacgccaagctgaaccccacccccggcagcaacgccatcagcgacgtgcccggcgagagaagcaccgccagcaccttccccaccgaccccgtgagccccctgaccaccaccctgagcctggcccaccacagcagcgccgccctgcccgccagaaccagcaacaccaccatcaccgccaacaccagcgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcacgactgcacccaggtggagaaggccgacaccaccatctgcctgaagtggaagaacatcgagaccttcacctgcgacacccagaacatcacctacagattccagtgcggcaacatgatcttcgacaacaaggagatcaagctggagaacctggagcccgagcacgagtacaagtgcgacagcgagatcctgtacaacaaccacaagttcaccaacgccagcaagatcatcaagaccgacttcggcagccccggcgagccccagatcatcttctgcagaagcgaggccgcccaccagggcgtgatcacctggaaccccccccagagaagcttccacaacttcaccctgtgctacatcaaggagaccgagaaggactgcctgaacctggacaagaacctgatcaagtacgacctgcagaacctgaagccctacaccaagtacgtgctgagcctgcacgcctacatcatcgccaaggtgcagagaaacggcagcgccgccatgtgccacttcaccaccaagagcgccccccccagccaggtgtggaacatgaccgtgagcatgaccagcgacaacagcatgcacgtgaagtgcagaccccccagagacagaaacggcccccacgagagataccacctggaggtggaggccggcaacaccctggtgagaaacgagagccacaagaactgcgacttcagagtgaaggacctgcagtacagcaccgactacaccttcaaggcctacttccacaacggcgactaccccggcgagcccttcatcctgcaccacagcaccagctacaacagcaaggccctgatcgccttcctggccttcctgatcatcgtgaccagcatcgccctgctggtggtgctgtacaagatctacgacctgcacaagaagagaagctgcaacctggacgagcagcaggagctggtggagagagacgacgagaagcagctgatgaacgtggagcccatccacgccgacatcctgctggagacctacaagagaaagatcgccgacgagggcagactgttcctggccgagttccagagcatccccagagtgttcagcaagttccccatcaaggaggccagaaagcccttcaaccagaacaagaacagatacgtggacatcctgccctacgactacaacagagtggagctgagcgagatcaacggcgacgccggcagcaactacatcaacgccagctacatcgacggcttcaaggagcccagaaagtacatcgccgcccagggccccagagacgagaccgtggacgacttctggagaatgatctgggagcagaaggccaccgtgatcgtgatggtgaccagatgcgaggagggcaacagaaacaagtgcgccgagtactggcccagcatggaggagggcaccagagccttcggcgacgtggtggtgaagatcaaccagcacaagagatgccccgactacatcatccagaagctgaacatcgtgaacaagaaggagaaggccaccggcagagaggtgacccacatccagttcaccagctggcccgaccacggcgtgcccgaggacccccacctgctgctgaagctgagaagaagagtgaacgccttcagcaacttcttcagcggccccatcgtggtgcactgcagcgccggcgtgggcagaaccggcacctacatcggcatcgacgccatgctggagggcctggaggccgagaacaaggtggacgtgtacggctacgtggtgaagctgagaagacagagatgcctgatggtgcaggtggaggcccagtacatcctgatccaccaggccctggtggagtacaaccagttcggcgagaccgaggtgaacctgagcgagctgcacccctacctgcacaacatgaagaagagagacccccccagcgagcccagccccctggaggccgagttccagagactgcccagctacagaagctggagaacccagcacatcggcaaccaggaggagaacaagagcaagaacagaaacagcaacgtgatcccctacgactacaacagagtgcccctgaagcacgagctggagatgagcaaggagagcgagcacgacagcgacgagagcagcgacgacgacagcgacagcgaggagcccagcaagtacatcaacgccagcttcatcatgagctactggaagcccgaggtgatgatcgccgcccagggccccctgaaggagaccatcggcgacttctggcagatgatcttccagagaaaggtgaaggtgatcgtgatgctgaccgagctgaagcacggcgaccaggagatctgcgcccagtactggggcgagggcaagcagacctacggcgacatcgaggtggacctgaaggacaccgacaagagcagcacctacaccctgagagtgttcgagctgagacacagcaagagaaaggacagcagaaccgtgtaccagtaccagtacaccaactggagcgtggagcagctgcccgccgagcccaaggagctgatcagcatgatccaggtggtgaagcagaagctgccccagaagaacagcagcgagggcaacaagcaccacaagagcacccccctgctgatccactgcagagacggcagccagcagaccggcatcttctgcgccctgctgaacctgctggagagcgccgagaccgaggaggtggtggacatcttccaggtggtgaaggccctgagaaaggccagacccggcatggtgagcaccttcgagcagtaccagttcctgtacgacgtgatcgccagcacctaccccgcccagaacggccaggtgaagaagaacaaccaccaggaggacaagatcgagttcgacaacgaggtggacaaggtgaagcaggacgccaactgcgtgaaccccctgggcgcccccgagaagctgcccgaggccaaggagcaggccgagggcagcgagcccaccagcggcaccgagggccccgagcacagcgtgaacggccccgccagccccgccctgaaccagggcagctag

SEQ ID NO: 12428 - DNA, 441 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcactag

SEQ ID NO: 12429 - DNA, 351 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccggcctgaccaccgccaagatgcccagcgtgcccctgagcagcgaccccctgcccacccacaccaccgccttcagccccgccagcaccttcgagagagagaacgacttcagcgagaccaccaccagcctgagccccgacaacaccagcacccaggtgagccccgacagcctggacaacgccagcgccttcaacaccaccggcgtgagcagcgtgcagaccccccacctgcccacccacgccgacagccagaccccctag

SEQ ID NO: 12430 - DNA, 3915 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccggcctgaccaccgccaagatgcccagcgtgcccctgagcagcgaccccctgcccacccacaccaccgccttcagccccgccagcaccttcgagagagagaacgacttcagcgagaccaccaccagcctgagccccgacaacaccagcacccaggtgagccccgacagcctggacaacgccagcgccttcaacaccaccggcgtgagcagcgtgcagaccccccacctgcccacccacgccgacagccagacccccagcgccggcaccgacacccagaccttcagcggcagcgccgccaacgccaagctgaaccccacccccggcagcaacgccatcagcgacgtgcccggcgagagaagcaccgccagcaccttccccaccgaccccgtgagccccctgaccaccaccctgagcctggcccaccacagcagcgccgccctgcccgccagaaccagcaacaccaccatcaccgccaacaccagcgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcacgactgcacccaggtggagaaggccgacaccaccatctgcctgaagtggaagaacatcgagaccttcacctgcgacacccagaacatcacctacagattccagtgcggcaacatgatcttcgacaacaaggagatcaagctggagaacctggagcccgagcacgagtacaagtgcgacagcgagatcctgtacaacaaccacaagttcaccaacgccagcaagatcatcaagaccgacttcggcagccccggcgagccccagatcatcttctgcagaagcgaggccgcccaccagggcgtgatcacctggaaccccccccagagaagcttccacaacttcaccctgtgctacatcaaggagaccgagaaggactgcctgaacctggacaagaacctgatcaagtacgacctgcagaacctgaagccctacaccaagtacgtgctgagcctgcacgcctacatcatcgccaaggtgcagagaaacggcagcgccgccatgtgccacttcaccaccaagagcgccccccccagccaggtgtggaacatgaccgtgagcatgaccagcgacaacagcatgcacgtgaagtgcagaccccccagagacagaaacggcccccacgagagataccacctggaggtggaggccggcaacaccctggtgagaaacgagagccacaagaactgcgacttcagagtgaaggacctgcagtacagcaccgactacaccttcaaggcctacttccacaacggcgactaccccggcgagcccttcatcctgcaccacagcaccagctacaacagcaaggccctgatcgccttcctggccttcctgatcatcgtgaccagcatcgccctgctggtggtgctgtacaagatctacgacctgcacaagaagagaagctgcaacctggacgagcagcaggagctggtggagagagacgacgagaagcagctgatgaacgtggagcccatccacgccgacatcctgctggagacctacaagagaaagatcgccgacgagggcagactgttcctggccgagttccagagcatccccagagtgttcagcaagttccccatcaaggaggccagaaagcccttcaaccagaacaagaacagatacgtggacatcctgccctacgactacaacagagtggagctgagcgagatcaacggcgacgccggcagcaactacatcaacgccagctacatcgacggcttcaaggagcccagaaagtacatcgccgcccagggccccagagacgagaccgtggacgacttctggagaatgatctgggagcagaaggccaccgtgatcgtgatggtgaccagatgcgaggagggcaacagaaacaagtgcgccgagtactggcccagcatggaggagggcaccagagccttcggcgacgtggtggtgaagatcaaccagcacaagagatgccccgactacatcatccagaagctgaacatcgtgaacaagaaggagaaggccaccggcagagaggtgacccacatccagttcaccagctggcccgaccacggcgtgcccgaggacccccacctgctgctgaagctgagaagaagagtgaacgccttcagcaacttcttcagcggccccatcgtggtgcactgcagcgccggcgtgggcagaaccggcacctacatcggcatcgacgccatgctggagggcctggaggccgagaacaaggtggacgtgtacggctacgtggtgaagctgagaagacagagatgcctgatggtgcaggtggaggcccagtacatcctgatccaccaggccctggtggagtacaaccagttcggcgagaccgaggtgaacctgagcgagctgcacccctacctgcacaacatgaagaagagagacccccccagcgagcccagccccctggaggccgagttccagagactgcccagctacagaagctggagaacccagcacatcggcaaccaggaggagaacaagagcaagaacagaaacagcaacgtgatcccctacgactacaacagagtgcccctgaagcacgagctggagatgagcaaggagagcgagcacgacagcgacgagagcagcgacgacgacagcgacagcgaggagcccagcaagtacatcaacgccagcttcatcatgagctactggaagcccgaggtgatgatcgccgcccagggccccctgaaggagaccatcggcgacttctggcagatgatcttccagagaaaggtgaaggtgatcgtgatgctgaccgagctgaagcacggcgaccaggagatctgcgcccagtactggggcgagggcaagcagacctacggcgacatcgaggtggacctgaaggacaccgacaagagcagcacctacaccctgagagtgttcgagctgagacacagcaagagaaaggacagcagaaccgtgtaccagtaccagtacaccaactggagcgtggagcagctgcccgccgagcccaaggagctgatcagcatgatccaggtggtgaagcagaagctgccccagaagaacagcagcgagggcaacaagcaccacaagagcacccccctgctgatccactgcagagacggcagccagcagaccggcatcttctgcgccctgctgaacctgctggagagcgccgagaccgaggaggtggtggacatcttccaggtggtgaaggccctgagaaaggccagacccggcatggtgagcaccttcgagcagtaccagttcctgtacgacgtgatcgccagcacctaccccgcccagaacggccaggtgaagaagaacaaccaccaggaggacaagatcgagttcgacaacgaggtggacaaggtgaagcaggacgccaactgcgtgaaccccctgggcgcccccgagaagctgcccgaggccaaggagcaggccgagggcagcgagcccaccagcggcaccgagggccccgagcacagcgtgaacggccccgccagccccgccctgaaccagggcagctag

SEQ ID NO: 12431 - DNA, 1797 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccggcgtgagcagcgtgcagaccccccacctgcccacccacgccgacagccagacccccagcgccggcaccgacacccagaccttcagcggcagcgccgccaacgccaagctgaaccccacccccggcagcaacgccatcagcgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcacgactgcacccaggtggagaaggccgacaccaccatctgcctgaagtggaagaacatcgagaccttcacctgcgacacccagaacatcacctacagattccagtgcggcaacatgatcttcgacaacaaggagatcaagctggagaacctggagcccgagcacgagtacaagtgcgacagcgagatcctgtacaacaaccacaagttcaccaacgccagcaagatcatcaagaccgacttcggcagccccggcgagccccagatcatcttctgcagaagcgaggccgcccaccagggcgtgatcacctggaaccccccccagagaagcttccacaacttcaccctgtgctacatcaaggagaccgagaaggactgcctgaacctggacaagaacctgatcaagtacgacctgcagaacctgaagccctacaccaagtacgtgctgagcctgcacgcctacatcatcgccaaggtgcagagaaacggcagcgccgccatgtgccacttcaccaccaagagcgccccccccagccaggtgtggaacatgaccgtgagcatgaccagcgacaacagcatgcacgtgaagtgcagaccccccagagacagaaacggcccccacgagagataccacctggaggtggaggccggcaacaccctggtgagaaacgagagccacaagaactgcgacttcagagtgaaggacctgcagtacagcaccgactacaccttcaaggcctacttccacaacggcgactaccccggcgagcccttcatcctgcaccacagcaccagctacaacagcaaggccctgatcgccttcctggccttcctgatcatcgtgaccagcatcgccctgctggtggtgctgtacaagatctacgacctgcacaagaagagaagctgcaacctggacgagcagcaggagctggtggagagagacgacgagaagcagctgatgaacgtggagcccatccacgccgacatcctgctggagacctacaagagaaagatcgccgacgagggcagactgttcctggccgagttccagagcatccccagagtgttcagcaagttccccatcaaggaggccagaaagcccttcaaccagaacaagaacagatacgtggacatcctgccctacgactacaacagagtggagctgagcgagatcaacggcgacgccggcagcaactacatcaacgccagctacatcgactag

SEQ ID NO: 12432 - DNA, 2271 bp, Artificial Sequence
  Description of Artificial Sequence: Synthetic coding sequence
atgtacctgtggctgaagctgctggccttcggcttcgccttcctggacaccgaggtgttcgtgaccggccagagccccacccccagccccaccggcctgaccaccgccaagatgcccagcgtgcccctgagcagcgaccccctgcccacccacaccaccgccttcagccccgccagcaccttcgagagagagaacgacttcagcgagaccaccaccagcctgagccccgacaacaccagcacccaggtgagccccgacagcctggacaacgccagcgccttcaacaccaccggcgtgagcagcgtgcagaccccccacctgcccacccacgccgacagccagacccccagcgccggcaccgacacccagaccttcagcggcagcgccgccaacgccaagctgaaccccacccccggcagcaacgccatcagcgacgcctacctgaacgccagcgagaccaccaccctgagccccagcggcagcgccgtgatcagcaccaccaccatcgccaccacccccagcaagcccacctgcgacgagaagtacgccaacatcaccgtggactacctgtacaacaaggagaccaagctgttcaccgccaagctgaacgtgaacgagaacgtggagtgcggcaacaacacctgcaccaacaacgaggtgcacaacctgaccgagtgcaagaacgccagcgtgagcatcagccacaacagctgcaccgcccccgacaagaccctgatcctggacgtgccccccggcgtggagaagttccagctgcacgactgcacccaggtggagaaggccgacaccaccatctgcctgaagtggaagaacatcgagaccttcacctgcgacacccagaacatcacctacagattccagtgcggcaacatgatcttcgacaacaaggagatcaagctggagaacctggagcccgagcacgagtacaagtgcgacagcgagatcctgtacaacaaccacaagttcaccaacgccagcaagatcatcaagaccgacttcggcagccccggcgagccccagatcatcttctgcagaagcgaggccgcccaccagggcgtgatcacctggaaccccccccagagaagcttccacaacttcaccctgtgctacatcaaggagaccgagaaggactgcctgaacctggacaagaacctgatcaagtacgacctgcagaacctgaagccctacaccaagtacgtgctgagcctgcacgcctacatcatcgccaaggtgcagagaaacggcagcgccgccatgtgccacttcaccaccaagagcgccccccccagccaggtgtggaacatgaccgtgagcatgaccagcgacaacagcatgcacgtgaagtgcagaccccccagagacagaaacggcccccacgagagataccacctggaggtggaggccggcaacaccctggtgagaaacgagagccacaagaactgcgacttcagagtgaaggacctgcagtacagcaccgactacaccttcaaggcctacttccacaacggcgactaccccggcgagcccttcatcctgcaccacagcaccagctacaacagcaaggccctgatcgccttcctggccttcctgatcatcgtgaccagcatcgccctgctggtggtgctgtacaagatctacgacctgcacaagaagagaagctgcaacctggacgagcagcaggagctggtggagagagacgacgagaagcagctgatgaacgtggagcccatccacgccgacatcctgctggagacctacaagagaaagatcgccgacgagggcagactgttcctggccgagttccagagcatccccagagtgttcagcaagttccccatcaaggaggccagaaagcccttcaaccagaacaagaacagatacgtggacatcctgccctacgactacaacagagtggagctgagcgagatcaacggcgacgccggcagcaactacatcaacgccagctacatcgacggcttcaaggagcccagaaagtacatcgccgcccagggccccagagacgagaccgtggacgacttctggagaatgatctgggagcagaaggccaccgtgatcgtgatggtgaccagatgcgaggagggcaacagaaacaagtgcgccgagtactggcccagcatggaggagggcaccagagccttcggcgacgtggtggtgaagatcaaccagcacaagagatgccccgactacatcatccagaagctgaacatcgtgaacaagcagaagagcaagtag

SEQ ID NO: 12433 - DNA, 1662 bp, Artificial Sequence
  Description of Artificial Sequence: Synthetic coding sequence
agcgactacatgatcatcaagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggcctgccactacaccagcctgcactggaactggtgcagatacatcagcgaccccaacgtggactgccccgaccccagaaacgccgaggtgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcttccagaaccccgcccagatgctgcccgccagcggcagactgcccaaccagccctgccccgagagagagaactacagcttcgccaccttctag

SEQ ID NO: 12434 - DNA, 2931 bp, Artificial Sequence
  Description of Artificial Sequence: Synthetic coding sequence
agaagcttcatcatcctgaaggccatcgtgagccagccccccggccccgtgctgagcggcatggagatgctgctgatgagcggctacgagctgagaatcagatacctgcccaagggcttcctgaaccagttcaccgaggacaagcccaccctgaacttcttctaccagcaggtgaagagcgactacatgctggagatcgccgaccaggtggaccaggagatcgccctgaagctgggctgcctggagatcagaagaagctactgggagatgagaggcaacgccctggagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgacgagatccccggcgccgagaccgacgactacgccgagatcatcgacgaggaggacacctacaccatgcccagcatcaagagctactgcatcgacgtggccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagcccctgagactgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12435 - DNA, 3024 bp, Artificial Sequence
  Description of Artificial Sequence: Synthetic coding sequence
aaggccgagtacgacagatacctggccagcagcaagatcatggccgccgcctacctggaccccaacctgaaccacacccccaaggagtggaagtacgagctgagaatcagatacctgcccaagggcttcctgaaccagttcaccgaggacaagcccaccctgaacttcttctaccagcaggtgaagagcgactacatgctggagatcgccgaccaggtggaccaggagatcgccctgaagctgggctgcctggagatcagaagaagctactgggagatgagaggcaacgccctggagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcggcgtgagccactgccagcacaaggtgaagaaggccagaagattcctgcccctggtgttctgcagccacgacccccccagcaccgacgagatcagcggcgacgagaccgacgactacgccgagatcatcgacgaggaggacacctacaccatgcccagcatcaagagctactgcatcgacgtggccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagcccctgagactgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12436 - DNA, 3198 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtggaagtacgagctgagaatcagatacctgcccaagggcttcctgaaccagttcaccgaggacaagcccaccctgaacttcttctaccagcaggtgaagagcgactacatgctggagatcgccgaccaggtggaccaggagatcgccctgaagctgggctgcctggagatcagaagaagctactgggagatgagaggcaacgccctggagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccggcaaggaggagaagaactgggccgagagaaaccccgccgccccccccaagaagccccccagacccggcgcccccggccacctgggcagcctggccagcctgagcagccccgccgacagctacaacgagggcgtgaagcccaaccagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12437 - DNA, 2253 bp, Artificial Sequence
  Description of Artificial Sequence: Synthetic coding sequence
atggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcggcgtgagccactgccagcacaaggtgaagaaggccagaagattcctgcccctggtgttctgcagccacgacccccccagcaccgacgagatcagcggcgacgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagccctgcagactgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12438 - DNA, 1089 bp, Artificial Sequence
  Description of Artificial Sequence: Synthetic coding sequence
atgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12439 - DNA, 354 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccaccccccctag

SEQ ID NO: 12440 - DNA, 3291 bp, Artificial Sequence
  Description of Artificial Sequence: Synthetic coding sequence
atgctgctggagctggccggccaggaggccctgaagcccgccggcgccatctacatggagaagagcggctgcagccccttccccgtgtgctgggccaaggagtacgacagatacctggccagcagcaagatcatggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtggaagtacgagctgagaatcagatacctgcccaagggcttcctgaaccagttcaccgaggacaagcccaccctgaacttcttctaccagcaggtgaagagcgactacatgctggagatcgccgaccaggtggaccaggagatcgccctgaagctgggctgcctggagatcagaagaagctactgggagatgagaggcaacgccctggagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12441 - DNA, 3291 bp, Artificial Sequence; identical to SEQ ID NO: 12440
  Description of Artificial Sequence: Synthetic coding sequence

SEQ ID NO: 12442 - DNA, 2043 bp, Artificial Sequence
  Description of Artificial Sequence: Synthetic coding sequence
atgaagtaccaggaggtgagatgcctgaccagcttcaacatcagcgtgagcttccccgccgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12443 - DNA, 3054 bp, Artificial Sequence
  Description of Artificial Sequence: Synthetic coding sequence
tgatacgacagatacctggccagcagcaagatcatggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtggaagtacgagctgagaatcagatacctgcccaagggcttcctgaaccagttcaccgaggacaagcccaccctgaacttcttctaccagcaggtgaagagcgactacatgctggagatcgccgaccaggtggaccaggagatcgccctgaagctgggctgcctggagatcagaagaagctactgggagatgagaggcaacgccctggagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12444 - DNA, 354 bp, Artificial Sequence; identical to SEQ ID NO: 12439
  Description of Artificial Sequence: Synthetic coding sequence

SEQ ID NO: 12445 - DNA, 471 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtggaagtacgagctgagaatcagatacctgcccaagggcttcctgaaccagttcaccgaggacaagcccaccctgaacttcttctaccagcaggtgaagagcgactacatgtag

SEQ ID NO: 12446 - DNA, 3159 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtggaagtacgagctgagaatcagatacctgcccaagggcttcctgaaccagttcaccgaggacaagcccaccctgaacttcttctaccagcaggtgaagagcgactacatgctggagatcgccgaccaggtggaccaggagatcgccctgaagctgggctgcctggagatcagaagaagctactgggagatgagaggcaacgccctggagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12447 - DNA, 198 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagatag

SEQ ID NO: 12448 - DNA, 324 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgtag

SEQ ID NO: 12449 - DNA, 360 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtag

SEQ ID NO: 12450 - DNA, 2262 bp, Artificial Sequence
  Description of Artificial Sequence: Synthetic coding sequence
gccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcggcgtgagccactgccagcacaaggtgaagaaggccagaagattcctgcccctggtgttctgcagccacgacccccccagcaccgacgagatcagcggcgacgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagccctggagactgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12451 - DNA, 3159 bp, Artificial Sequence; identical to SEQ ID NO: 12446
  Description of Artificial Sequence: Synthetic coding sequence

SEQ ID NO: 12452 - DNA, 2175 bp, Artificial Sequence
  Description of Artificial Sequence: Synthetic coding sequence
atcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaagagctacggcatcgacgaggccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12453 - DNA, 363 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtggtag

SEQ ID NO: 12454 - DNA, 156 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctag

SEQ ID NO: 12455 - DNA, 3021 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtggaagtacgagctgagaatcagatacctgcccaagggcttcctgaaccagttcaccgaggacaagcccaccctgaacttcttctaccagcaggtgaagagcgactacatgctggagatcgccgaccaggtggaccaggagatcgccctgaagctgggctgcctggagatcagaagaagctactgggagatgagaggcaacgccctggagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12456 - DNA, 2163 bp, Artificial Sequence
  Description of Artificial Sequence: Synthetic coding sequence
atggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaagagctacggcatcgacgaggccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccgaccccgccgccccccccaagaagccccccagacccggcgcccccggccacctgggcagcctggccagcctgagcagccccgccgacagctacaacgagggcgtgaagctgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12457 - DNA, 3198 bp, Artificial Sequence
  Description of Artificial Sequence: Synthetic coding sequence
atggccgccgcctacctggaccccaacctgaaccacacccccaacagcagcaccaagacccacctgggcaccggcatggagagaagccccggcgccatggagagagtgctgaaggtgttccactacttcgagagcaacagcgagcccaccacctgggccagcatcatcagacacggcgacgccaccgacgtgagaggcatcatccagaagatcgtggacagccacaaggtgaagcacgtggcctgctacggcttcagactgagccacctgagaagcgaggaggtgcactggctgcacgtggacatgggcgtgagcagcgtgagagagaagtacgagctggcccacccccccgaggagtggaagtacgagctgagaatcagatacctgcccaagggcttcctgaaccagttcaccgaggacaagcccaccctgaacttcttctaccagcaggtgaagagcgactacatgctggagatcgccgaccaggtggaccaggagatcgccctgaagctgggctgcctggagatcagaagaagctactgggagatgagaggcaacgccctggagaagaagagcaactacgaggtgctggagaaggacgtgggcctgaagagattcttccccaagagcctgctggacagcgtgaaggccaagaccctgagaaagctgatccagcagaccttcagacagttcgccaacctgaacagagaggagagcatcctgaagttcttcgagatcctgagccccgtgtacagattcgacaaggagtgcttcaagtgcgccctgggcagcagctggatcatcagcgtggagctggccatcggccccgaggagggcatcagctacctgaccgacaagggctgcaaccccacccacctggccgacttcacccaggtgcagaccatccagtacagcaacagcgaggacaaggacagaaagggcatgctgcagctgaagatcgccggcgcccccgagcccctgaccgtgaccgcccccagcctgaccatcgccgagaacatggccgacctgatcgacggctactgcagactggtgaacggcaccagccagagcttcatcatcagaccccagaaggagggcgagagagccctgcccagcatccccaagctggccaacagcgagaagcagggcatgagaacccacgccgtgagcgtgagcgagaccgacgactacgccgagatcatcgacgaggaggacacctacaccatgcccagcaccagagactacgagatccagagagagagaatcgagctgggcagatgcatcggcgagggccagttcggcgacgtgcaccagggcatctacatgagccccgagaaccccgccctggccgtggccatcaagacctgcaagaactgcaccagcgacagcgtgagagagaagttcctgcaggaggccctgaccatgagacagttcgaccacccccacatcgtgaagctgatcggcgtgatcaccgagaaccccgtgtggatcatcatggagctgtgcaccctgggcgagctgagaagcttcctgcaggtgagaaagtacagcctggacctggccagcctgatcctgtacgcctaccagctgagcaccgccctggcctacctggagagcaagagattcgtgcacagagacatcgccgccagaaacgtgctggtgagcagcaacgactgcgtgaagctgggcgacttcggcctgagcagatacatggaggacagcacctactacaaggccagcaagggcaagctgcccatcaagtggatggcccccgagagcatcaacttcagaagattcaccagcgccagcgacgtgtggatgttcggcgtgtgcatgtgggagatcctgatgcacggcgtgaagcccttccagggcgtgaagaacaacgacgtgatcggcagaatcgagaacggcgagagactgcccatgccccccaactgcccccccaccctgtacagcctgatgaccaagtgctgggcctacgaccccagcagaagacccagattcaccgagctgaaggcccagctgagcaccatcctggaggaggagaaggcccagcaggaggagagaatgagaatggagagcagaagacaggccaccgtgagctgggacagcggcggcagcgacgaggccccccccaagcccagcagacccggctaccccagccccagaagcagcgagggcttctaccccagcccccagcacatggtgcagaccaaccactaccaggtgagcggctaccccggcagccacggcatcaccgccatggccggcagcatctaccccggccaggccagcctgctggaccagaccgacagctggaaccacagaccccaggagatcgccatgtggcagcccaacgtggaggacagcaccgtgctggacctgagaggcatcggccaggtgctgcccacccacctgatggaggagagactgatcagacagcagcaggagatggaggaggaccagagatggctggagaaggaggagagattcctgaagcccgacgtgagactgagcagaggcagcatcgacagagaggacggcagcctgcagggccccatcggcaaccagcacatctaccagcccgtgggcaagcccggcaaggaggagaagaactgggccgagagaaaccccgccgccccccccaagaagccccccagacccggcgcccccggccacctgggcagcctggccagcctgagcagccccgccgacagctacaacgagggcgtgaagccctggagactgcagccccaggagatcagccccccccccaccgccaacctggacagaagcaacgacaaggtgtacgagaacgtgaccggcctggtgaaggccgtgatcgagatgagcagcaagatccagcccgccccccccgaggagtacgtgcccatggtgaaggaggtgggcctggccctgagaaccctgctggccaccgtggacgagaccatccccctgctgcccgccagcacccacagagagatcgagatggcccagaagctgctgaacagcgacctgggcgagctgatcaacaagatgaagctggcccagcagtacgtgatgaccagcctgcagcaggagtacaagaagcagatgctgaccgccgcccacgccctggccgtggacgccaagaacctgctggacgtgatcgaccaggccagactgaagatgctgggccagaccagaccccactag

SEQ ID NO: 12458 - DNA, 2904 bp, Artificial Sequence
  Description of Artificial Sequence: Synthetic coding sequence
atgagcggcgtgagcgagcccctgagcagagtgaagctgggcaccctgagaagacccgagggccccgccgagcccatggtggtggtgcccgtggacgtggagaaggaggacgtgagaatcctgaaggtgtgcttctacagcaacagcttcaaccccggcaagaacttcaagctggtgaagtgcaccgtgcagaccgagatcagagagatcatcaccagcatcctgctgagcggcagaatcggccccaacatcagactggccgagtgctacggcctgagactgaagcacatgaagagcgacgagatccactggctgcacccccagatgaccgtgggcgaggtgcaggacaagtacgagtgcctgcacgtggaggccgagtggagatacgacctgcagatcagatacctgcccgaggacttcatggagagcctgaaggaggacagaaccaccctgctgtacttctaccagcagctgagaaacgactacatgcagagatacgccagcaaggtgagcgagggcatggccctgcagctgggctgcctggagctgagaagattcttcaaggacatgccccacaacgccctggacaagaagagcaacttcgagctgctggagaaggaggtgggcctggacctgttcttccccaagcagatgcaggagaacctgaagcccaagcagttcagaaagatgatccagcagaccttccagcagtacgccagcctgagagaggaggagtgcgtgatgaagttcttcaacaccctggccggcttcgccaacatcgaccaggagacctacagatgcgagctgatccagggctggaacatcaccgtggacctggtgatcggccccaagggcatcagacagctgaccagccaggacgccaagcccacctgcctggccgagttcaagcagatcagaagcatcagatgcctgcccctggaggagggccaggccgtgctgcagctgggcatcgagggcgccccccaggccctgagcatcaagaccagcagcctggccgaggccgagaacatggccgacctgatcgacggctactgcagactgcagggcgagcaccagggcagcctgatcatccaccccagaaaggacggcgagaagagaaacagcctgccccagatccccatgctgaacctggaggccagaagaagccacctgagcgagagctgcagcatcgagagcgacatctacgccgagatccccgacgagaccctgagaagacccggcggcccccagtacggcatcgccagagaggacgtggtgctgaacagaatcctgggcgagggcttcttcggcgaggtgtacgagggcgtgtacaccaaccacaagggcgagaagatcaacgtggccgtgaagacctgcaagaaggactgcaccctggacaacaaggagaagttcatgagcgaggccgtgatcatgaagaacctggaccacccccacatcgtgaagctgatcggcatcatcgaggaggagcccacctggatcatcatggagctgtacccctacggcgagctgggccactacctggagagaaacaagaacagcctgaaggtgctgaccctggtgctgtacagcctgcagatctgcaaggccatggcctacctggagagcatcaactgcgtgcacagagacatcgccgtgagaaacatcctggtggccagccccgagtgcgtgaagctgggcgacttcggcctgagcagatacatcgaggacgaggactactacaaggccagcgtgaccagactgcccatcaagtggatgagccccgagagcatcaacttcagaagattcaccaccgccagcgacgtgtggatgttcgccgtgtgcatgtgggagatcctgagcttcggcaagcagcccttcttctggctggagaacaaggacgtgatcggcgtgctggagaagggcgacagactgcccaagcccgacctgtgcccccccgtgctgtacaccctgatgaccagatgctgggactacgaccccagcgacagacccagattcaccgagctggtgtgcagcctgagcgacgtgtaccagatggagaaggacatcgccatggagcaggagagaaacgccagatacagaacccccaagatcctggagcccaccgccttccaggagcccccccccaagcccagcagacccaagtacagaccccccccccagaccaacctgctggcccccaagctgcagttccaggaggaggacttcatccagcccagcagcagagaggaggcccagcagctgtgggaggccgagaaggtgaagatgagacagatcctggacaagcagcagaagcagatggtggaggactaccagtggctgagacaggaggagaagagcctggaccccatggtgtacatgaacgacaagagccccctgacccccgagaaggaggtgggctacctggagttcaccggccccccccagaagccccccagactgggcgcccagagcatccagcccaccgccaacctggacagaaccgacgacctggtgtacctgaacgtgatggagctggtgagagccgtgctggagctgaagaacgagctgtgccagctgccccccgagggctacgtggtggtggtgaagaacgtgggcctgaccctgagaaagctgatcggcagcgtggacgacctgctgcccagcctgcccagcagcagcagaaccgagatcgagggcacccagaagctgctgaacaaggacctggccgagctgatcaacaagatgagactggcccagcagaacgccgtgaccagcctgagcgaggagtgcaagagacagatgctgaccgccagccacaccctggccgtggacgccaagaacctgctggacgccgtggaccaggccaaggtgctggccaacctggcccacccccccgccgagtag

SEQ ID NO: 12459 - DNA, 3030 bp, Artificial Sequence
  Description of Artificial Sequence: Synthetic coding sequence
atgagcggcgtgagcgagcccctgagcagagtgaagctgggcaccctgagaagacccgagggccccgccgagcccatggtggtggtgcccgtggacgtggagaaggaggacgtgagaatcctgaaggtgtgcttctacagcaacagcttcaaccccggcaagaacttcaagctggtgaagtgcaccgtgcagaccgagatcagagagatcatcaccagcatcctgctgagcggcagaatcggccccaacatcagactggccgagtgctacggcctgagactgaagcacatgaagagcgacgagatccactggctgcacccccagatgaccgtgggcgaggtgcaggacaagtacgagtgcctgcacgtggaggccgagtggagatacgacctgcagatcagatacctgcccgaggacttcatggagagcctgaaggaggacagaaccaccctgctgtacttctaccagcagctgagaaacgactacatgcagagatacgccagcaaggtgagcgagggcatggccctgcagctgggctgcctggagctgagaagattcttcaaggacatgccccacaacgccctggacaagaagagcaacttcgagctgctggagaaggaggtgggcctggacctgttcttccccaagcagatgcaggagaacctgaagcccaagcagttcagaaagatgatccagcagaccttccagcagtacgccagcctgagagaggaggagtgcgtgatgaagttcttcaacaccctggccggcttcgccaacatcgaccaggagacctacagatgcgagctgatccagggctggaacatcaccgtggacctggtgatcggccccaagggcatcagacagctgaccagccaggacgccaagcccacctgcctggccgagttcaagcagatcagaagcatcagatgcctgcccctggaggagggccaggccgtgctgcagctgggcatcgagggcgccccccaggccctgagcatcaagaccagcagcctggccgaggccgagaacatggccgacctgatcgacggctactgcagactgcagggcgagcaccagggcagcctgatcatccaccccagaaaggacggcgagaagagaaacagcctgccccagatccccatgctgaacctggaggccagaagaagccacctgagcgagagctgcagcatcgagagcgacatctacgccgagatccccgacgagaccctgagaagacccggcggcccccagtacggcatcgccagagaggacgtggtgctgaacagaatcctgggcgagggcttcttcggcgaggtgtacgagggcgtgtacaccaaccacaagggcgagaagatcaacgtggccgtgaagacctgcaagaaggactgcaccctggacaacaaggagaagttcatgagcgaggccgtgatcatgaagaacctggaccacccccacatcgtgaagctgatcggcatcatcgaggaggagcccacctggatcatcatggagctgtacccctacggcgagctgggccactacctggagagaaacaagaacagcctgaaggtgctgaccctggtgctgtacagcctgcagatctgcaaggccatggcctacctggagagcatcaactgcgtgcacagagacatcgccgtgagaaacatcctggtggccagccccgagtgcgtgaagctgggcgacttcggcctgagcagatacatcgaggacgaggactactacaaggccagcgtgaccagactgcccatcaagtggatgagccccgagagcatcaacttcagaagattcaccaccgccagcgacgtgtggatgttcgccgtgtgcatgtgggagatcctgagcttcggcaagcagcccttcttctggctggagaacaaggacgtgatcggcgtgctggagaagggcgacagactgcccaagcccgacctgtgcccccccgtgctgtacaccctgatgaccagatgctgggactacgaccccagcgacagacccagattcaccgagctggtgtgcagcctgagcgacgtgtaccagatggagaaggacatcgccatggagcaggagagaaacgccagatacagaacccccaagatcctggagcccaccgccttccaggagcccccccccaagcccagcagacccaagtacagaccccccccccagaccaacctgctggcccccaagctgcagttccaggtgcccgagggcctgtgcgccagcagccccaccctgaccagccccatggagtaccccagccccgtgaacagcctgcacaccccccccctgcacagacacaacgtgttcaagagacacagcatgagagaggaggacttcatccagcccagcagcagagaggaggcccagcagctgtgggaggccgagaaggtgaagatgagacagatcctggacaagcagcagaagcagatggtggaggactaccagtggctgagacaggaggagaagagcctggaccccatggtgtacatgaacgacaagagccccctgacccccgagaaggaggtgggctacctggagttcaccggccccccccagaagccccccagactgggcgcccagagcatccagcccaccgccaacctggacagaaccgacgacctggtgtacctgaacgtgatggagctggtgagagccgtgctggagctgaagaacgagctgtgccagctgccccccgagggctacgtggtggtggtgaagaacgtgggcctgaccctgagaaagctgatcggcagcgtggacgacctgctgcccagcctgcccagcagcagcagaaccgagatcgagggcacccagaagctgctgaacaaggacctggccgagctgatcaacaagatgagactggcccagcagaacgccgtgaccagcctgagcgaggagtgcaagagacagatgctgaccgccagccacaccctggccgtggacgccaagaacctgctggacgccgtggaccaggccaaggtgctggccaacctggcccacccccccgccgagtag

SEQ ID NO: 12460 - DNA, 3030 bp, Artificial Sequence; identical to SEQ ID NO: 12459
  Description of Artificial Sequence: Synthetic coding sequence

SEQ ID NO: 12461 - DNA, 2904 bp, Artificial Sequence; identical to SEQ ID NO: 12458
  Description of Artificial Sequence: Synthetic coding sequence

SEQ ID NO: 12462 - DNA, 2904 bp, Artificial Sequence; identical to SEQ ID NO: 12458
  Description of Artificial Sequence: Synthetic coding sequence

SEQ ID NO: 12463 - DNA, 2409 bp, Artificial Sequence
  Description of Artificial Sequence: Synthetic coding sequence
ctgctgcccgagagaatgagcggcgtgagcgagcccctgagcagagtgaagctgggcaccctgagaagacccgagggccccgccgagcccatggtggtggtgcccgtggacgtggagaaggaggacgtgagaatcctgaaggtgtgcttctacagcaacagcttcaaccccggcaagaacttcaagctggtgaagtgcaccgtgcagaccgagatcagagagatcatcaccagcatcctgctgagcggcagaatcggccccaacatcagactggccgagtgctacggcctgagactgaagcacatgaagagcgacgagatccactggctgcacccccagatgaccgtgggcgaggtgcaggacaagtacgagtgcctgcacgtggaggccgagtggagatacgacctgcagatcagatacctgcccgaggacttcatggagagcctgaaggaggacagaaccaccctgctgtacttctaccagcagctgagaaacgactacatgcagagatacgccagcaaggtgagcgagggcatggccctgcagctgggctgcctggagctgagaagattcttcaaggacatgccccacaacgccctggacaagaagagcaacttcgagctgctggagaaggaggtgggcctggacctgttcttccccaagcagatgcaggagaacctgaagcccaagcagttcagaaagatgatccagcagaccttccagcagtacgccagcctgagagaggaggagtgcgtgatgaagttcttcaacaccctggccggcttcgccaacatcgaccaggagacctacagatgcgagctgatccagggctggaacatcaccgtggacctggtgatcggccccaagggcatcagacagctgaccagccaggacgccaagcccacctgcctggccgagttcaagcagatcagaagcatcagatgcctgcccctggaggagggccaggccgtgctgcagctgggcatcgagggcgccccccaggccctgagcatcaagaccagcagcctggccgaggccgagaacatggccgacctgatcgacggctactgcagactgcagggcgagcaccagggcagcctgatcatccaccccagaaaggacggcgagaagagaaacagcctgccccagatccccatgctgaacctggaggccagaagaagccacctgagcgagagctgcagcatcgagagcgacatctacgccgagatccccgacgagaccctgagaagacccggcggcccccagtacggcatcgccagagaggacgtggtgctgaacagaatcctgggcgagggcttcttcggcgaggtgtacgagggcgtgtacaccaaccacaagggcgagaagatcaacgtggccgtgaagacctgcaagaaggactgcaccctggacaacaaggagaagttcatgagcgaggccgtgatcatgaagaacctggaccacccccacatcgtgaagctgatcggcatcatcgaggaggagcccacctggatcatcatggagctgtacccctacggcgagctgggccactacctggagagaaacaagaacagcctgaaggtgctgaccctggtgctgtacagcctgcagatctgcaaggccatggcctacctggagagcatcaactgcgtgcacagagacatcgccgtgagaaacatcctggtggccagccccgagtgcgtgaagctgggcgacttcggcctgagcagatacatcgaggacgaggactactacaaggccagcgtgaccagactgcccatcaagtggatgagccccgagagcatcaacttcagaagattcaccaccgccagcgacgtgtggatgttcgccgtgtgcatgtgggagatcctgagcttcggcaagcagcccttcttctggctggagaacaaggacgtgatcggcgtgctggagaagggcgacagactgcccaagcccgacctgtgcccccccgtgctgtacaccctgatgaccagatgctgggactacgaccccagcgacagacccagattcaccgagctggtgtgcagcctgagcgacgtgtaccagatggagaaggacatcgccatggagcaggagagaaacgccagatacagaacccccaagatcctggagcccaccgccttccaggagcccccccccaagcccagcagacccaagtacagaccccccccccagaccaacctgctggcccccaagctgcagttccaggtgcccgagggcctgtgcgccagcagccccaccctgaccagccccatggagtaccccagccccgtgaacagcctgcacaccccccccctgcacagacacaacgtgttcaagagacacagcatgagagaggaggacttcatccagcccagcagcagaggccccgccgccgtgggcggctag

SEQ ID NO: 12464 - DNA, 3030 bp, Artificial Sequence; identical to SEQ ID NO: 12459
  Description of Artificial Sequence: Synthetic coding sequence

SEQ ID NO: 12465 - DNA, 969 bp, Artificial Sequence
  Description of Artificial Sequence: Synthetic coding sequence
atggccgacagagacagcggcagcgagcagggcggcgccgccctgggcagcggcggcagcctgggccaccccggcagcggcagcggcagcggcggcggcggcggcggcggcggcggcggcggcggcagcggcggcggcggcggcggcgcccccggcggcctgcagcacgagacccaggagctggccagcaagagagtggacatccagaacaagagattctacctggacgtgaagcagaacgccaagggcagattcctgaagatcgccgaggtgggcgccggcggcaacaagagcagactgaccctgagcatgagcgtggccgtggagttcagagactacctgggcgacttcatcgagcactacgcccagctgggccccagccagccccccgacctggcccaggcccaggacgagcccagaagagccctgaagagcgagttcctggtgagagagaacagaaagtactacatggacctgaaggagaaccagagaggcagattcctgagaatcagacagaccgtgaacagaggccccggcctgggcagcacccagggccagaccatcgccctgcccgcccagggcctgatcgagttcagagacgccctggccaagctgatcgacgactacggcgtggaggaggagcccgccgagctgcccgagggcaccagcctgaccgtggacaacaagagattcttcttcgacgtgggcagcaacaagtacggcgtgttcatgagagtgagcgaggtgaagcccacctacagaaacagcatcaccgtgccctacaaggtgtgggccaagttcggccacaccttctgcaagtacagcgaggagatgaagaagatccaggagaagcagagagagaagagagccgcctgcgagcagctgcaccagcagcagcagcagcagcaggaggagaccgccgccgccaccctgctgctgcagggcgaggaggagggcgaggaggactag

SEQ ID NO: 12466 - DNA, 588 bp, Artificial Sequence
  Description of Artificial Sequence: Synthetic coding sequence
atgggcagagccagagacgccatcctggacgccctggagaacctgaccgccgaggagctgaagaagttcaagctgaagctgctgagcgtgcccctgagagagggctacggcagaatccccagaggcgccctgctgagcatggacgccctggacctgaccgacaagctggtgagcttctacctggagacctacggcgccgagctgaccgccaacgtgctgagagacatgggcctgcaggagatggccggccagctgcaggccgccacccaccagggcagcggcgccgcccccgccggcatccaggcccccccccagagcgccgccaagcccggcctgcacttcatcgaccagcacagagccgccctgatcgccagagtgaccaacgtggagtggctgctggacgccctgtacggcaaggtgctgaccgacgagcagtaccaggccgtgagagccgagcccaccaaccccagcaagatgagaaagctgttcagcttcacccccgcctggaactggacctgcaaggacctgctgctgcaggccctgagagagagccagagctacctggtggaggacctggagagaagctag

SEQ ID NO: 12467 - DNA, 531 bp, Artificial Sequence
  Description of Artificial Sequence: Synthetic coding sequence
atgggcagagccagagacgccatcctggacgccctggagaacctgaccgccgaggagctgaagaagttcaagctgaagctgctgagcgtgcccctgagagagggctacggcagaatccccagaggcgccctgctgagcatggacgccctggacctgaccgacaagctggtgagcttctacctggagacctacggcgccgagctgaccgccaacgtgctgagagacatgggcctgcaggagatggccggccagctgcaggccgccacccaccagggcctgcacttcatcgaccagcacagagccgccctgatcgccagagtgaccaacgtggagtggctgctggacgccctgtacggcaaggtgctgaccgacgagcagtaccaggccgtgagagccgagcccaccaaccccagcaagatgagaaagctgttcagcttcacccccgcctggaactggacctgcaaggacctgctgctgcaggccctgagagagagccagagctacctggtggaggacctggagagaagctag

SEQ ID NO: 12468 - DNA, 408 bp, Artificial Sequence
  Description of Artificial Sequence: Synthetic coding sequence
atgggcagagccagagacgccatcctggacgccctggagaacctgaccgccgaggagctgaagaagttcaagctgcaggccgccacccaccagggcagcggcgccgcccccgccggcatccaggcccccccccagagcgccgccaagcccggcctgcacttcatcgaccagcacagagccgccctgatcgccagagtgaccaacgtggagtggctgctggacgccctgtacggcaaggtgctgaccgacgagcagtaccaggccgtgagagccgagcccaccaaccccagcaagatgagaaagctgttcagcttcacccccgcctggaactggacctgcaaggacctgctgctgcaggccctgagagagagccagagctacctggtggaggacctggagagaagctag

SEQ ID NO: 12469 - DNA, 1311 bp, Artificial Sequence
  Description of Artificial Sequence: Synthetic coding sequence
atgagactggccagactgctgagaggcgccgccctggccggccccggccccggcctgagagccgccggcttcagcagaagcttcagcagcgacagcggcagcagccccgccagcgagagaggcgtgcccggccaggtggacttctacgccagattcagccccagccccctgagcatgaagcagttcctggacttcggcagcgtgaacgcctgcgagaagaccagcttcatgttcctgagacaggagctgcccgtgagactggccaacatcatgaaggagatcagcctgctgcccgacaacctgctgagaacccccagcgtgcagctggtgcagagctggtacatccagagcctgcaggagctgctggacttcaaggacaagagcgccgaggacgccaaggccatctacgacttcaccgacaccgtgatcagaatcagaaacagacacaacgacgtgatccccaccatggcccagggcgtgatcgagtacaaggagagcttcggcgtggaccccgtgaccagccagaacgtgcagtacttcctggacagattctacatgagcagaatcagcatcagaatgctgctgaaccagcacagcctgctgttcggcggcaagggcaagggcagccccagccacagaaagcacatcggcagcatcaaccccaactgcaacgtgctggaggtgatcaaggacggctacgagaacgccagaagactgtgcgacctgtactacatcaacagccccgagctggagctggaggagctgaacgccaagagccccggccagcccatccaggtggtgtacgtgcccagccacctgtaccacatggtgttcgagctgttcaagaacgccatgagagccaccatggagcaccacgccaacagaggcgtgtacccccccatccaggtgcacgtgaccctgggcaacgaggacctgaccgtgaagatgagcgacagaggcggcggcgtgcccctgagaaagatcgacagactgttcaactacatgtacagcaccgcccccagacccagagtggagaccagcagagccgtgcccctggccggcttcggctacggcctgcccatcagcagactgtacgcccagtacttccagggcgacctgaagctgtacagcctggagggctacggcaccgacgccgtgatctacatcaaggccctgagcaccgacagcatcgagagactgcccgtgtacaacaaggccgcctggaagcactacaacaccaaccacgaggccgacgactggtgcgtgcccagcagagagcccaaggacatgaccaccttcagaagcgcctag

SEQ ID NO: 12470 - DNA, 1371 bp, Artificial Sequence
  Description of Artificial Sequence: Synthetic coding sequence
atgagactggccagactgctgagaggcgccgccctggccggccccggccccggcctgagagccgccggcttcagcagaagcttcagcagcgacagcggcagcagccccgccagcgagagaggcgtgcccggccaggtggacttctacgccagattcagccccagccccctgagcatgaagcagttcctggacttcggcagcgtgaacgcctgcgagaagaccagcttcatgttcctgagacaggagctgcccgtgagactggccaacatcatgaaggagatcagcctgctgcccgacaacctgctgagaacccccagcgtgcagctggtgcagagctggtacatccagagcctgcaggagctgctggacttcaaggacaagagcgccgaggacgccaaggccatctacgagagacccagaagaacctggctgcaggtgagcagcctgtgctgcatggcctgcaagatgatcttcaccgacaccgtgatcagaatcagaaacagacacaacgacgtgatccccaccatggcccagggcgtgatcgagtacaaggagagcttcggcgtggaccccgtgaccagccagaacgtgcagtacttcctggacagattctacatgagcagaatcagcatcagaatgctgctgaaccagcacagcctgctgttcggcggcaagggcaagggcagccccagccacagaaagcacatcggcagcatcaaccccaactgcaacgtgctggaggtgatcaaggacggctacgagaacgccagaagactgtgcgacctgtactacatcaacagccccgagctggagctggaggagctgaacgccaagagccccggccagcccatccaggtggtgtacgtgcccagccacctgtaccacatggtgttcgagctgttcaagaacgccatgagagccaccatggagcaccacgccaacagaggcgtgtacccccccatccaggtgcacgtgaccctgggcaacgaggacctgaccgtgaagatgagcgacagaggcggcggcgtgcccctgagaaagatcgacagactgttcaactacatgtacagcaccgcccccagacccagagtggagaccagcagagccgtgcccctggccggcttcggctacggcctgcccatcagcagactgtacgcccagtacttccagggcgacctgaagctgtacagcctggagggctacggcaccgacgccgtgatctacatcaaggccctgagcaccgacagcatcgagagactgcccgtgtacaacaaggccgcctggaagcactacaacaccaaccacgaggccgacgactggtgcgtgcccagcagagagcccaaggacatgaccaccttcagaagcgcctag

SEQ ID NO: 12471 - DNA, 1311 bp, Artificial Sequence; identical to SEQ ID NO: 12469
  Description of Artificial Sequence: Synthetic coding sequence

SEQ ID NO: 12472 - DNA, 1083 bp, Artificial Sequence
  Description of Artificial Sequence: Synthetic coding sequence
atgttcctgagacaggagctgcccgtgagactggccaacatcatgaaggagatcagcctgctgcccgacaacctgctgagaacccccagcgtgcagctggtgcagagctggtacatccagagcctgcaggagctgctggacttcaaggacaagagcgccgaggacgccaaggccatctacgacttcaccgacaccgtgatcagaatcagaaacagacacaacgacgtgatccccaccatggcccagggcgtgatcgagtacaaggagagcttcggcgtggaccccgtgaccagccagaacgtgcagtacttcctggacagattctacatgagcagaatcagcatcagaatgctgctgaaccagcacagcctgctgttcggcggcaagggcaagggcagccccagccacagaaagcacatcggcagcatcaaccccaactgcaacgtgctggaggtgatcaaggacggctacgagaacgccagaagactgtgcgacctgtactacatcaacagccccgagctggagctggaggagctgaacgccaagagccccggccagcccatccaggtggtgtacgtgcccagccacctgtaccacatggtgttcgagctgttcaagaacgccatgagagccaccatggagcaccacgccaacagaggcgtgtacccccccatccaggtgcacgtgaccctgggcaacgaggacctgaccgtgaagatgagcgacagaggcggcggcgtgcccctgagaaagatcgacagactgttcaactacatgtacagcaccgcccccagacccagagtggagaccagcagagccgtgcccctggccggcttcggctacggcctgcccatcagcagactgtacgcccagtacttccagggcgacctgaagctgtacagcctggagggctacggcaccgacgccgtgatctacatcaaggccctgagcaccgacagcatcgagagactgcccgtgtacaacaaggccgcctggaagcactacaacaccaaccacgaggccgacgactggtgcgtgcccagcagagagcccaaggacatgaccaccttcagaagcgcctag

SEQ ID NO: 12473 - DNA, 846 bp, Artificial Sequence
  Description of Artificial Sequence: Synthetic coding sequence
atggcccagggcgtgatcgagtacaaggagagcttcggcgtggaccccgtgaccagccagaacgtgcagtacttcctggacagattctacatgagcagaatcagcatcagaatgctgctgaaccagcacagcctgctgttcggcggcaagggcaagggcagccccagccacagaaagcacatcggcagcatcaaccccaactgcaacgtgctggaggtgatcaaggacggctacgagaacgccagaagactgtgcgacctgtactacatcaacagccccgagctggagctggaggagctgaacgccaagagccccggccagcccatccaggtggtgtacgtgcccagccacctgtaccacatggtgttcgagctgttcaagaacgccatgagagccaccatggagcaccacgccaacagaggcgtgtacccccccatccaggtgcacgtgaccctgggcaacgaggacctgaccgtgaagatgagcgacagaggcggcggcgtgcccctgagaaagatcgacagactgttcaactacatgtacagcaccgcccccagacccagagtggagaccagcagagccgtgcccctggccggcttcggctacggcctgcccatcagcagactgtacgcccagtacttccagggcgacctgaagctgtacagcctggagggctacggcaccgacgccgtgatctacatcaaggccctgagcaccgacagcatcgagagactgcccgtgtacaacaaggccgcctggaagcactacaacaccaaccacgaggccgacgactggtgcgtgcccagcagagagcccaaggacatgaccaccttcagaagcgcctag

SEQ ID NO: 12474 - DNA, 1032 bp, Artificial Sequence
  Description of Artificial Sequence: Synthetic coding sequence
atgaaggagatcaacctgctgcccgacagagtgctgagcacccccagcgtgcagctggtgcagagctggtacgtgcagagcctgctggacatcatggagttcctggacaaggaccccgaggaccacagaaccctgagccagttcaccgacgccctggtgaccatcagaaacagacacaacgacgtggtgcccaccatggcccagggcgtgctggagtacaaggacacctacggcgacgaccccgtgagcaaccagaacatccagtacttcctggacagattctacctgagcagaatcagcatcagaatgctgatcaaccagcacaccctgatcttcgacggcagcaccaaccccgcccaccccaagcacatcggcagcatcgaccccaactgcaacgtgagcgaggtggtgaaggacgcctacgacatggccaagctgctgtgcgacaagtactacatggccagccccgacctggagatccaggagatcaacgccgccaacagcaagcagcccatccacatggtgtacgtgcccagccacctgtaccacatgctgttcgagctgttcaagaacgccatgagagccaccgtggagagccacgagagcagcctgatcctgccccccatcaaggtgatggtggccctgggcgaggaggacctgagcatcaagatgagcgacagaggcggcggcgtgcccctgagaaagatcgagagactgttcagctacatgtacagcaccgcccccaccccccagcccggcaccggcggcacccccctggccggcttcggctacggcctgcccatcagcagactgtacgccaagtacttccagggcgacctgcagctgttcagcatggagggcttcggcaccgacgccgtgatctacctgaaggccctgagcaccgacagcgtggagagactgcccgtgtacaacaagagcgcctggagacactaccagaccatccaggaggccggcgactggtgcgtgcccagcaccgagcccaagaacaccagcacctacagagtgagctag

SEQ ID NO: 12475 - DNA, 1224 bp, Artificial Sequence
  Description of Artificial Sequence: Synthetic coding sequence
atgagatgggtgtgggccctgctgaagaacgccagcctggccggcgcccccaagtacatcgagcacttcagcaagttcagccccagccccctgagcatgaagcagttcctggacttcggcagcagcaacgcctgcgagaagaccagcttcaccttcctgagacaggagctgcccgtgagactggccaacatcatgaaggagatcaacctgctgcccgacagagtgctgagcacccccagcgtgcagctggtgcagagctggtacgtgcagagcctgctggacatcatggagttcctggacaaggaccccgaggaccacagaaccctgagccagttcaccgacgccctggtgaccatcagaaacagacacaacgacgtggtgcccaccatggcccagggcgtgctggagtacaaggacacctacggcgacgaccccgtgagcaaccagaacatccagtacttcctggacagattctacctgagcagaatcagcatcagaatgctgatcaaccagcacaccctgatcttcgacggcagcaccaaccccgcccaccccaagcacatcggcagcatcgaccccaactgcaacgtgagcgaggtggtgaaggacgcctacgacatggccaagctgctgtgcgacaagtactacatggccagccccgacctggagatccaggagatcaacgccgccaacagcaagcagcccatccacatggtgtacgtgcccagccacctgtaccacatgctgttcgagctgttcaagaacgccatgagagccaccgtggagagccacgagagcagcctgatcctgccccccatcaaggtgatggtggccctgggcgaggaggacctgagcatcaagatgagcgacagaggcggcggcgtgcccctgagaaagatcgagagactgttcagctacatgtacagcaccgcccccaccccccagcccggcaccggcggcacccccctggccggcttcggctacggcctgcccatcagcagactgtacgccaagtacttccagggcgacctgcagctgttcagcatggagggcttcggcaccgacgccgtgatctacctgaaggccctgagcaccgacagcgtggagagactgcccgtgtacaacaagagcgcctggagacactaccagaccatccaggaggccggcgactggtgcgtgcccagcaccgagcccaagaacaccagcacctacagagtgagctag

SEQ ID NO: 12476 - DNA, 849 bp, Artificial Sequence
  Description of Artificial Sequence: Synthetic coding sequence
atgcccctgctgacccagcagatccaggacgaggacgaccagtacagcctggtggccagcctggacaacgtgagaaacctgagcaccatcctgaaggccatccacttcagagagcacgccacctgcttcgccaccaagaacggcatcaaggtgaccgtggagaacgccaagtgcgtgcaggccaacgccttcatccaggccggcatcttccaggagttcaaggtgcaggaggagagcgtgaccttcagaatcaacctgaccgtgctgctggactgcctgagcatcttcggcagcagccccatgcccggcaccctgaccgccctgagaatgtgctaccagggctacggctaccccctgatgctgttcctggaggagggcggcgtggtgaccgtgtgcaagatcaacacccaggagcccgaggagaccctggacttcgacttctgcagcaccaacgtgatcaacaagatcatcctgcagagcgagggcctgagagaggccttcagcgagctggacatgaccagcgaggtgctgcagatcaccatgagccccgacaagccctacttcagactgagcaccttcggcaacgccggcagcagccacctggactaccccaaggacagcgacctgatggaggccttccactgcaaccagacccaggtgaacagatacaagatcagcctgctgaagcccagcaccaaggccctggtgctgagctgcaaggtgagcatcagaaccgacaacagaggcttcctgagcctgcagtacatgatcagaaacgaggacggccagatctgcttcgtggagtactactgctgccccgacgaggaggtgcccgagagcgagagctag

SEQ ID NO: 12477 - DNA, 849 bp, Artificial Sequence; identical to SEQ ID NO: 12476
  Description of Artificial Sequence: Synthetic coding sequence

SEQ ID NO: 12478 - DNA, 741 bp, Artificial Sequence
  Description of Artificial Sequence: Synthetic coding sequence
atgcccctgctgacccagcagatccaggacgaggacgaccagtacagcctggtggccagcctggacaacgtgagaaacctgagcaccatcctgaaggccatccacttcagagagcacgccacctgcttcgccaccaagaacggcatcaaggtgaccgtggagaacgccaagtgcgtgcaggccaacgccttcatccagggcaccctgaccgccctgagaatgtgctaccagggctacggctaccccctgatgctgttcctggaggagggcggcgtggtgaccgtgtgcaagatcaacacccaggagcccgaggagaccctggacttcgacttctgcagcaccaacgtgatcaacaagatcatcctgcagagcgagggcctgagagaggccttcagcgagctggacatgaccagcgaggtgctgcagatcaccatgagccccgacaagccctacttcagactgagcaccttcggcaacgccggcagcagccacctggactaccccaaggacagcgacctgatggaggccttccactgcaaccagacccaggtgaacagatacaagatcagcctgctgaagcccagcaccaaggccctggtgctgagctgcaaggtgagcatcagaaccgacaacagaggcttcctgagcctgcagtacatgatcagaaacgaggacggccagatctgcttcgtggagtactactgctgccccgacgaggaggtgcccgagagcgagagctag

SEQ ID NO: 12479 - DNA, 1755 bp, Artificial Sequence
  Description of Artificial Sequence: Synthetic coding sequence
atgaaccagcacgagctggccgtgcacaagaagaagatcgaggaggtggagacctggctgaaggcccaggtgctggagagacagcccaagcagggcggcagcatcctgctgatcaccggcccccccggctgcggcaagaccaccaccctgaagatcctgagcaaggagcacggcatccaggtgcaggagtggatcaaccccgtgctgcccgacttccagaaggacgacttcaagggcatgttcaacaccgagagcagcttccacatgttcccctaccagagccagatcgccgtgttcaaggagttcctgctgagagccaccaagtacaacaagctgcagatgctgggcgacgacctgagaaccgacaagaagatcatcctggtggaggacctgcccaaccagttctacagagacagccacaccctgcacgaggtgctgagaaagtacgtgagaatcggcagatgccccctgatcttcatcatcagcgacagcctgagcggcgacaacaaccagagactgctgttccccaaggagatccaggaggagtgcagcatcagcaacatcagcttcaaccccgtggcccccaccatcatgatgaagttcctgaacagaatcgtgaccatcgaggccaacaagaacggcggcaagatcaccgtgcccgacaagaccagcctggagctgctgtgccagggctgcagcggcgacatcagaagcgccatcaacagcctgcagttcagcagcagcaagggcgagaacaacctgagacccagaaagaagggcatgagcctgaagagcgacgccgtgctgagcaagagcaagagaagaaagaagcccgacagagtgttcgagaaccaggaggtgcaggccatcggcggcaaggacgtgagcctgttcctgttcagagccctgggcaagatcctgtactgcaagagagccagcctgaccgagctggacagccccagactgcccagccacctgagcgagtacgagagagacaccctgctggtggagcccgaggaggtggtggagatgagccacatgcccggcgacctgttcaacctgtacctgcaccagaactacatcgacttcttcatggagatcgacgacatcgtgagagccagcgagttcctgagcttcgccgacatcctgagcggcgactggaacaccagaagcctgctgagagagtacagcaccagcatcgccaccagaggcgtgatgcacagcaacaaggccagaggctacgcccactgccagggcggcggcagcagcttcagacccctgcacaagccccagtggttcctgatcaacaagaagtacagagagaactgcctggccgccaaggccctgttccccgacttctgcctgcccgccctgtgcctgcagacccagctgctgccctacctggccctgctgaccatccccatgagaaaccaggcccagatcagcttcatccaggacatcggcagactgcccctgaagagacacttcggcagactgaagatggaggccctgaccgacagagagcacggcatgatcgaccccgacagcggcgacgaggcccagctgaacggcggccacagcgccgaggagagcctgggcgagcccacccaggccaccgtgcccgagacctggagcctgcccctgagccagaacagcgccagcgagctgcccgccagccagccccagcccttcagcgcccagggcgacatggaggagaacatcatcatcgaggactacgagagcgacggcacctag

SEQ ID NO: 12480 - DNA, 2013 bp, Artificial Sequence
  Description of Artificial Sequence: Synthetic coding sequence
atgaaccaggtgaccgactgggtggaccccagcttcgacgacttcctggagtgcagcggcgtgagcaccatcaccgccaccagcctgggcgtgaacaacagcagccacagaagaaagaacggccccagcaccctggagagcagcagattccccgccagaaagagaggcaacctgagcagcctggagcagatctacggcctggagaacagcaaggagtacctgagcgagaacgagccctgggtggacaagtacaagcccgagacccagcacgagctggccgtgcacaagaagaagatcgaggaggtggagacctggctgaaggcccaggtgctggagagacagcccaagcagggcggcagcatcctgctgatcaccggcccccccggctgcggcaagaccaccaccctgaagatcctgagcaaggagcacggcatccaggtgcaggagtggatcaaccccgtgctgcccgacttccagaaggacgacttcaagggcatgttcaacaccgagagcagcttccacatgttcccctaccagagccagatcgccgtgttcaaggagttcctgctgagagccaccaagtacaacaagctgcagatgctgggcgacgacctgagaaccgacaagaagatcatcctggtggaggacctgcccaaccagttctacagagacagccacaccctgcacgaggtgctgagaaagtacgtgagaatcggcagatgccccctgatcttcatcatcagcgacagcctgagcggcgacaacaaccagagactgctgttccccaaggagatccaggaggagtgcagcatcagcaacatcagcttcaaccccgtggcccccaccatcatgatgaagttcctgaacagaatcgtgaccatcgaggccaacaagaacggcggcaagatcaccgtgcccgacaagaccagcctggagctgctgtgccagggctgcagcggcgacatcagaagcgccatcaacagcctgcagttcagcagcagcaagggcgagaacaacctgagacccagaaagaagggcatgagcctgaagagcgacgccgtgctgagcaagagcaagagaagaaagaagcccgacagagtgttcgagaaccaggaggtgcaggccatcggcggcaaggacgtgagcctgttcctgttcagagccctgggcaagatcctgtactgcaagagagccagcctgaccgagctggacagccccagactgcccagccacctgagcgagtacgagagagacaccctgctggtggagcccgaggaggtggtggagatgagccacatgcccggcgacctgttcaacctgtacctgcaccagaactacatcgacttcttcatggagatcgacgacatcgtgagagccagcgagttcctgagcttcgccgacatcctgagcggcgactggaacaccagaagcctgctgagagagtacagcaccagcatcgccaccagaggcgtgatgcacagcaacaaggccagaggctacgcccactgccagggcggcggcagcagcttcagacccctgcacaagccccagtggttcctgatcaacaagaagtacagagagaactgcctggccgccaaggccctgttccccgacttctgcctgcccgccctgtgcctgcagacccagctgctgccctacctggccctgctgaccatccccatgagaaaccaggcccagatcagcttcatccaggacatcggcagactgcccctgaagagacacttcggcagactgaagatggaggccctgaccgacagagagcacggcatgatcgaccccgacagcggcgacgaggcccagctgaacggcggccacagcgccgaggagagcctgggcgagcccacccaggccaccgtgcccgagacctggagcctgcccctgagccagaacagcgccagcgagctgcccgccagccagccccagcccttcagcgcccagggcgacatggaggagaacatcatcatcgaggactacgagagcgacggcacctag

SEQ ID NO: 12481 - DNA, 2013 bp, Artificial Sequence; identical to SEQ ID NO: 12480
  Description of Artificial Sequence: Synthetic coding sequence

SEQ ID NO: 12482 - DNA, 2013 bp, Artificial Sequence; identical to SEQ ID NO: 12480
  Description of Artificial Sequence: Synthetic coding sequence

SEQ ID NO: 12483 - DNA, 2013 bp, Artificial Sequence; identical to SEQ ID NO: 12480
  Description of Artificial Sequence: Synthetic coding sequence

SEQ ID NO: 12484 - DNA, 1518 bp, Artificial Sequence
  Description of Artificial Sequence: Synthetic coding sequence
atgttcaacaccgagagcagcttccacatgttcccctaccagagccagatcgccgtgttcaaggagttcctgctgagagccaccaagtacaacaagctgcagatgctgggcgacgacctgagaaccgacaagaagatcatcctggtggaggacctgcccaaccagttctacagagacagccacaccctgcacgaggtgctgagaaagtacgtgagaatcggcagatgccccctgatcttcatcatcagcgacagcctgagcggcgacaacaaccagagactgctgttccccaaggagatccaggaggagtgcagcatcagcaacatcagcttcaaccccgtggcccccaccatcatgatgaagttcctgaacagaatcgtgaccatcgaggccaacaagaacggcggcaagatcaccgtgcccgacaagaccagcctggagctgctgtgccagggctgcagcggcgacatcagaagcgccatcaacagcctgcagttcagcagcagcaagggcgagaacaacctgagacccagaaagaagggcatgagcctgaagagcgacgccgtgctgagcaagagcaagagaagaaagaagcccgacagagtgttcgagaaccaggaggtgcaggccatcggcggcaaggacgtgagcctgttcctgttcagagccctgggcaagatcctgtactgcaagagagccagcctgaccgagctggacagccccagactgcccagccacctgagcgagtacgagagagacaccctgctggtggagcccgaggaggtggtggagatgagccacatgcccggcgacctgttcaacctgtacctgcaccagaactacatcgacttcttcatggagatcgacgacatcgtgagagccagcgagttcctgagcttcgccgacatcctgagcggcgactggaacaccagaagcctgctgagagagtacagcaccagcatcgccaccagaggcgtgatgcacagcaacaaggccagaggctacgcccactgccagggcggcggcagcagcttcagacccctgcacaagccccagtggttcctgatcaacaagaagtacagagagaactgcctggccgccaaggccctgttccccgacttctgcctgcccgccctgtgcctgcagacccagctgctgccctacctggccctgctgaccatccccatgagaaaccaggcccagatcagcttcatccaggacatcggcagactgcccctgaagagacacttcggcagactgaagatggaggccctgaccgacagagagcacggcatgatcgaccccgacagcggcgacgaggcccagctgaacggcggccacagcgccgaggagagcctgggcgagcccacccaggccaccgtgcccgagacctggagcctgcccctgagccagaacagcgccagcgagctgcccgccagccagccccagcccttcagcgcccagggcgacatggaggagaacatcatcatcgaggactacgagagcgacggcacctag

SEQ ID NO: 12485 - DNA, 2013 bp, Artificial Sequence; identical to SEQ ID NO: 12480
  Description of Artificial Sequence: Synthetic coding sequence

SEQ ID NO: 12486 - DNA, 2046 bp, Artificial Sequence
  Description of Artificial Sequence: Synthetic coding sequence
atgagcaagaccttcctgagacccaaggtgagcagcaccaaggtgaccgactgggtggaccccagcttcgacgacttcctggagtgcagcggcgtgagcaccatcaccgccaccagcctgggcgtgaacaacagcagccacagaagaaagaacggccccagcaccctggagagcagcagattccccgccagaaagagaggcaacctgagcagcctggagcagatctacggcctggagaacagcaaggagtacctgagcgagaacgagccctgggtggacaagtacaagcccgagacccagcacgagctggccgtgcacaagaagaagatcgaggaggtggagacctggctgaaggcccaggtgctggagagacagcccaagcagggcggcagcatcctgctgatcaccggcccccccggctgcggcaagaccaccaccctgaagatcctgagcaaggagcacggcatccaggtgcaggagtggatcaaccccgtgctgcccgacttccagaaggacgacttcaagggcatgttcaacaccgagagcagcttccacatgttcccctaccagagccagatcgccgtgttcaaggagttcctgctgagagccaccaagtacaacaagctgcagatgctgggcgacgacctgagaaccgacaagaagatcatcctggtggaggacctgcccaaccagttctacagagacagccacaccctgcacgaggtgctgagaaagtacgtgagaatcggcagatgccccctgatcttcatcatcagcgacagcctgagcggcgacaacaaccagagactgctgttccccaaggagatccaggaggagtgcagcatcagcaacatcagcttcaaccccgtggcccccaccatcatgatgaagttcctgaacagaatcgtgaccatcgaggccaacaagaacggcggcaagatcaccgtgcccgacaagaccagcctggagctgctgtgccagggctgcagcggcgacatcagaagcgccatcaacagcctgcagttcagcagcagcaagggcgagaacaacctgagacccagaaagaagggcatgagcctgaagagcgacgccgtgctgagcaagagcaagagaagaaagaagcccgacagagtgttcgagaaccaggaggtgcaggccatcggcggcaaggacgtgagcctgttcctgttcagagccctgggcaagatcctgtactgcaagagagccagcctgaccgagctggacagccccagactgcccagccacctgagcgagtacgagagagacaccctgctggtggagcccgaggaggtggtggagatgagccacatgcccggcgacctgttcaacctgtacctgcaccagaactacatcgacttcttcatggagatcgacgacatcgtgagagccagcgagttcctgagcttcgccgacatcctgagcggcgactggaacaccagaagcctgctgagagagtacagcaccagcatcgccaccagaggcgtgatgcacagcaacaaggccagaggctacgcccactgccagggcggcggcagcagcttcagacccctgcacaagccccagtggttcctgatcaacaagaagtacagagagaactgcctggccgccaaggccctgttccccgacttctgcctgcccgccctgtgcctgcagacccagctgctgccctacctggccctgctgaccatccccatgagaaaccaggcccagatcagcttcatccaggacatcggcagactgcccctgaagagacacttcggcagactgaagatggaggccctgaccgacagagagcacggcatgatcgaccccgacagcggcgacgaggcccagctgaacggcggccacagcgccgaggagagcctgggcgagcccacccaggccaccgtgcccgagacctggagcctgcccctgagccagaacagcgccagcgagctgcccgccagccagccccagcccttcagcgcccagggcgacatggaggagaacatcatcatcgaggactacgagagcgacggcacctag

SEQ ID NO: 12487 - DNA, 510 bp, Artificial Sequence
  Description of Artificial Sequence: Synthetic coding sequence
atgaaccaggtgaccgactgggtggaccccagcttcgacgacttcctggagtgcagcggcgtgagcaccatcaccgccaccagcctgggcgtgaacaacagcagccacagaagaaagaacggccccagcaccctggagagcagcagattccccgccagaaagagaggcaacctgagcagcctggagcagatctacggcctggagaacagcaaggagtacctgagcgagaacgagccctgggtggacaagtacaagcccgagacccagcacgagctggccgtgcacaagaagaagatcgaggaggtggagacctggctgaaggcccaggtgctggagagacagcccaagcagggcggcagcatcctgctgatcaccggcccccccggctgcggcaagaccaccaccctgaagatcctgagcaaggagcacggcatccaggtgcaggagtggatcaaccccgtgctgcccgacttccagaaggacgacttcaagggcatgttcaacacctag

SEQ ID NO: 12488 - DNA, 66 bp, Artificial Sequence
  Description of Artificial Sequence: Synthetic coding sequence
atgaaccaggtgaccgactgggtggaccccagcttcgacgacttcctggagtgcagcggcgtgtag

SEQ ID NO: 12489 - DNA, 2046 bp, Artificial Sequence; identical to SEQ ID NO: 12486
  Description of Artificial Sequence: Synthetic coding sequence

SEQ ID NO: 12490 - DNA, 1518 bp, Artificial Sequence; identical to SEQ ID NO: 12484
  Description of Artificial Sequence: Synthetic coding sequence

SEQ ID NO: 12491 - DNA, 1488 bp, Artificial Sequence
  Description of Artificial Sequence: Synthetic coding sequence
atggacagcctggccgagagcagatggccccccggcctggccgtgatgaagaccatcgacgacctgctgagatgcggcatctgcttcgagtacttcaacatcgccatgatcatcccccagtgcagccacaactactgcagcctgtgcatcagaaagttcctgagctacaagacccagtgccccacctgctgcgtgaccgtgaccgagcccgacctgaagaacaacagaatcctggacgagctggtgaagagcctgaacttcgccagaaaccacctgctgcagttcgccctggagagccccgccaagagccccgccagcagcagcagcaagaacctggccgtgaaggtgtacacccccgtggccagcagacagagcctgaagcagggcagcagactgatggacaacttcctgatcagagagatgagcggcagcaccagcgagctgctgatcaaggagaacaagagcaagttcagcccccagaaggaggccagccccgccgccaagaccaaggagaccagaagcgtggaggagatcgcccccgaccccagcgaggccaagagacccgagccccccagcaccagcaccctgaagcaggtgaccaaggtggactgccccgtgtgcggcgtgaacatccccgagagccacatcaacaagcacctggacagctgcctgagcagagaggagaagaaggagagcctgagaagcagcgtgcacaagagaaagcccctgcccaagaccgtgtacaacctgctgagcgacagagacctgaagaagaagctgaaggagcacggcctgagcatccagggcaacaagcagcagctgatcaagagacaccaggagttcgtgcacatgtacaacgcccagtgcgacgccctgcaccccaagagcgccgccgagatcgtgagagagatcgagaacatcgagaagaccagaatgagactggaggccagcaagctgaacgagagcgtgatggtgttcaccaaggaccagaccgagaaggagatcgacgagatccacagcaagtacagaaagaagcacaagagcgagttccagctgctggtggaccaggccagaaagggctacaagaagatcgccggcatgagccagaagaccgtgaccatcaccaaggaggacgagagcaccgagaagctgagcagcgtgtgcatgggccaggaggacaacatgaccagcgtgaccaaccacttcagccagagcaagctggacagccccgaggagctggagcccgacagagaggaggacagcagcagctgcatcgacatccaggaggtgctgagcagcagcgagagcgacagctgcaacagcagcagcagcgacatcatcagagacctgctggaggaggaggaggcctgggaggccagccacaagaacgacctgcaggacaccgagatcagccccagacagaacagaagaaccagagccgccgagagcgccgagatcgagcccagaaacaagagaaacagaaactag

SEQ ID NO: 12492 - DNA, 279 bp, Artificial Sequence
  Description of Artificial Sequence: Synthetic coding sequence
atggacagcctggccgagagcagatggccccccggcctggccgtgatgaagaccatcgacgacctgctgagatgcggcatctgcttcgagtacttcaacatcgccatgatcatcccccagtgcagccacaactactgcagcctgtgcatcagaaagttcctgagctacaagacccagtgccccacctgctgcgtgaccgtgaccgagcccgacctgaagaacaacagaatcctggacgagctggtgaagagcctgaacttcgccagaaaccacctgtag

SEQ ID NO: 12493 - DNA, 1092 bp, Artificial Sequence
  Description of Artificial Sequence: Synthetic coding sequence
atggccgtgaccatcaccctgaagaccctgcagcagcagaccttcaagatcagaatggagcccgacgagaccgtgaaggtgctgaaggagaagatcgaggccgagaagggcagagacgccttccccgtggccggccagaagctgatctacgccggcaagatcctgagcgacgacgtgcccatcagagactacagaatcgacgagaagaacttcgtggtggtgatggtgaccaagaccaaggccggccagggcaccagcgccccccccgaggccagccccaccgccgcccccgagagcagcaccagcttcccccccgcccccaccagcggcatgagccaccccccccccgccgccagagaggacaagagccccagcgaggagagcgcccccaccaccagccccgagagcgtgagcggcagcgtgcccagcagcggcagcagcggcagagaggaggacgccgccagcaccctggtgaccggcagcgagtacgagaccatgctgaccgagatcatgagcatgggctacgagagagagagagtggtggccgccctgagagccagctacaacaacccccacagagccgtggagtacctgctgaccggcatccccggcagccccgagcccgagcacggcagcgtgcaggagagccaggtgagcgagcagcccgccaccgaggccgccggcgagaaccccctggagttcctgagagaccagccccagttccagaacatgagacaggtgatccagcagaaccccgccctgctgcccgccctgctgcagcagctgggccaggagaacccccagctgctgcagcagatcagcagacaccaggagcagttcatccagatgctgaacgagccccccggcgagctggccgacatcagcgacgtggagggcgaggtgggcgccatcggcgaggaggccccccagatgaactacatccaggtgaccccccaggagaaggaggccatcgagagactgaaggccctgggcttccccgagagcctggtgatccaggcctacttcgcctgcgagaagaacgagaacctggccgccaacttcctgctgagccagaacttcgacgacgagtag

SEQ ID NO: 12494 - DNA, 597 bp, Artificial Sequence
  Description of Artificial Sequence: Synthetic coding sequence
atgctgaccgagatcatgagcatgggctacgagagagagagagtggtggccgccctgagagccagctacaacaacccccacagagccgtggagtacctgctgaccggcatccccggcagccccgagcccgagcacggcagcgtgcaggagagccaggtgagcgagcagcccgccaccgaggccgccggcgagaaccccctggagttcctgagagaccagccccagttccagaacatgagacaggtgatccagcagaaccccgccctgctgcccgccctgctgcagcagctgggccaggagaacccccagctgctgcagcagatcagcagacaccaggagcagttcatccagatgctgaacgagccccccggcgagctggccgacatcagcgacgtggagggcgaggtgggcgccatcggcgaggaggccccccagatgaactacatccaggtgaccccccaggagaaggaggccatcgagagactgaaggccctgggcttccccgagagcctggtgatccaggcctacttcgcctgcgagaagaacgagaacctggccgccaacttcctgctgagccagaacttcgacgacgagtag

SEQ ID NO: 12495 - DNA, 1092 bp, Artificial Sequence; identical to SEQ ID NO: 12493
  Description of Artificial Sequence: Synthetic coding sequence

SEQ ID NO: 12496 - DNA, 927 bp, Artificial Sequence
  Description of Artificial Sequence: Synthetic coding sequence
atggccgtgaccatcaccctgaagaccctgcagcagcagaccttcaagatcagaatggagcccgacgagaccgtgaaggtgctgaaggagaagatcgaggccgagaagggcagagacgccttccccgtggccggccagaagctgatctacgccggcaagatcctgagcgacgacgtgcccatcagagactacagaatcgacgagaagaacttcgtggtggtgatggtgaccaagaccaaggccggccagggcaccagcgccccccccgaggccagccccaccgccgcccccgagagcagcaccagcttcccccccgcccccaccagcggcatgagccaccccccccccgccgccagagaggacaagagccccagcgaggagagcgcccccaccaccagccccgagagcgtgagcggcagcgtgcccagcagcggcagcagcggcagagaggaggacgccgccagcaccctggtgaccggcagcgagtacgagaccatgctgaccgagatcatgagcatgggctacgagagagagagagtggtggccgccctgagagccagctacaacaacccccacagagccgtggagtacctgctgaccggcatccccggcagccccgagcccgagcacggcagcgtgcaggagagccaggtgagcgagcagcccgccaccgaggccgccggcgagaaccccctggagttcctgagagaccagccccagttccagaacatgagacaggtgatccagcagaaccccgccctgctgcccgccctgctgcagcagctgggccaggagaacccccagctgctgcagctgaaggccctgggcttccccgagagcctggtgatccaggcctacttcgcctgcgagaagaacgagaacctggccgccaacttcctgctgagccagaacttcgacgacgagtag

SEQ ID NO: 12497 - DNA, 1230 bp, Artificial Sequence
  Description of Artificial Sequence: Synthetic coding sequence
atgcaggtgaccctgaagaccctgcagcagcagaccttcaagatcgacatcgaccccgaggagaccgtgaaggccctgaaggagaagatcgagagcgagaagggcaaggacgccttccccgtggccggccagaagctgatctacgccggcaagatcctgaacgacgacaccgccctgaaggagtacaagatcgacgagaagaacttcgtggtggtgatggtgaccaagcccaaggccgtgagcacccccgcccccgccaccacccagcagagcgcccccgccagcaccaccgccgtgaccagcagcaccaccaccaccgtggcccaggcccccacccccgtgcccgccctggcccccaccagcacccccgccagcatcacccccgccagcgccaccgccagcagcgagcccgcccccgccagcgccgccaagcaggagaagcccgccgagaagcccgccgagacccccgtggccaccagccccaccgccaccgacagcaccagcggcgacagcagcagaagcaacctgttcgaggacgccaccagcgccctggtgaccggccagagctacgagaacatggtgaccgagatcatgagcatgggctacgagagagagcaggtgatcgccgccctgagagccagcttcaacaaccccgacagagccgtggagtacctgctgatgggcatccccggcgacagagagagccaggccgtggtggaccccccccaggccgccagcaccggcgccccccagagcagcgccgtggccgccgccgccgccaccaccaccgccaccaccaccaccaccagcagcggcggccaccccctggagttcctgagaaaccagccccagttccagcagatgagacagatcatccagcagaaccccagcctgctgcccgccctgctgcagcagatcggcagagagaacccccagctgctgcagcagatcagccagcaccaggagcacttcatccagatgctgaacgagcccgtgcaggaggccggcggccagggcggcggcggcggcggcggcagcggcggcatcgccgaggccggcagcggccacatgaactacatccaggtgaccccccaggagaaggaggccatcgagagactgaaggccctgggcttccccgagggcctggtgatccaggcctacttcgcctgcgagaagaacgagaacctggccgccaacttcctgctgcagcagaacttcgacgaggactag

SEQ ID NO: 12498 - DNA, 519 bp, Artificial Sequence
  Description of Artificial Sequence: Synthetic coding sequence
atggtgaccaagcccaaggccgtgagcacccccgcccccgccaccacccagcagagcgcccccgccagcaccaccgccgtgaccagcagcaccaccaccaccgtggcccaggcccccacccccgtgcccgccctggcccccaccagcacccccgccagcatcacccccgccagcgccaccgccagcagcgagcccgcccccgccagcgccgccaagcaggagaagcccgccgagaagcccgccgagacccccgtggccaccagccccaccgccaccgacagcaccagcggcgacagcagcagaagcaacctgttcgaggacgccaccagcgccctggtgaccggccagagctacgagaacatggtgaccgagatcatgagcatgggctacgagagagagcaggtgatcgccgccctgagagccagcttcaacaaccccgacagagccgtggagtacctgctgatgatcatcgtgaagaccggcaacaagaagaagaagcagcccctgctgggcaagtag

SEQ ID NO: 12499 - DNA, 1014 bp, Artificial Sequence
  Description of Artificial Sequence: Synthetic coding sequence
atggtgaccaagcccaaggccgtgagcacccccgcccccgccaccacccagcagagcgcccccgccagcaccaccgccgtgaccagcagcaccaccaccaccgtggcccaggcccccacccccgtgcccgccctggcccccaccagcacccccgccagcatcacccccgccagcgccaccgccagcagcgagcccgcccccgccagcgccgccaagcaggagaagcccgccgagaagcccgccgagacccccgtggccaccagccccaccgccaccgacagcaccagcggcgacagcagcagaagcaacctgttcgaggacgccaccagcgccctggtgaccggccagagctacgagaacatggtgaccgagatcatgagcatgggctacgagagagagcaggtgatcgccgccctgagagccagcttcaacaaccccgacagagccgtggagtacctgctgatgggcatccccggcgacagagagagccaggccgtggtggaccccccccaggccgccagcaccggcgccccccagagcagcgccgtggccgccgccgccgccaccaccaccgccaccaccaccaccaccagcagcggcggccaccccctggagttcctgagaaaccagccccagttccagcagatgagacagatcatccagcagaaccccagcctgctgcccgccctgctgcagcagatcggcagagagaacccccagctgctgcagcagatcagccagcaccaggagcacttcatccagatgctgaacgagcccgtgcaggaggccggcggccagggcggcggcggcggcggcggcagcggcggcatcgccgaggccggcagcggccacatgaactacatccaggtgaccccccaggagaaggaggccatcgagagactgaaggccctgggcttccccgagggcctggtgatccaggcctacttcgcctgcgagaagaacgagaacctggccgccaacttcctgctgcagcagaacttcgacgaggactag

SEQ ID NO: 12500 - DNA, 441 bp, Artificial Sequence
  Description of Artificial Sequence: Synthetic coding sequence
atgcaggtgaccctgaagaccctgcagcagcagaccttcaagatcgacatcgaccccgaggagaccgtgaaggccctgaaggagaagatcgagagcgagaagggcaaggacgccttccccgtggccggccagaagctgatctacgccggcaagatcctgaacgacgacaccgccctgaaggagtacaagatcgacgagaagaacttcgtggtggtgatggtgaccaagcccaaggccgtgagcacccccgcccccgccaccacccagcagagcgcccccgccagcaccaccgccgtgaccagcagcaccaccaccaccgtggcccaggcccccacccccgtgcccgccctggcccccaccagcacccccgccagcatcacccccgccagcgccaccgccagcagcgagcccgcccccgccagcgccgccaagcaggagtag

SEQ ID NO: 12501 - DNA, 243 bp, Artificial Sequence
  Description of Artificial Sequence: Synthetic coding sequence
atggtgaaggccctgaaggagaagatcgagagcgagaagggcaaggacgccttccccgtggccggccagaagctgatctacgccggcaagatcctgaacgacgacaccgccctgaaggagtacaagatcgacgagaagaacttcgtggtggtgatggtgaccaagcccaaggccgtgagcacccccgcccccgccaccacccagcagagcgcccccgccagcaccaccgccgtgaccagctag

SEQ ID NO: 12502 - DNA, 345 bp, Artificial Sequence
  Description of Artificial Sequence: Synthetic coding sequence
tgaaccgccagcagcgagcccgcccccgccagcgccgccaagcaggagaagcccgccgagaagcccgccgagacccccgtggccaccagccccaccgccaccgacagcaccagcggcgacagcagcagaagcaacctgttcgaggacgccaccagcgccctggtgaccggccagagctacgagaacatggtgaccgagatcatgagcatgggctacgagagagagcaggtgatcgccgccctgagagccagcttcaacaaccccgacagagccgtggagtacctgctgatgatcatcgtgaagaccggcaacaagaagaagaagcagcccctgctgggcaagtag

SEQ ID NO: 12503 - DNA, 3939 bp, Artificial Sequence
  Description of Artificial Sequence: Synthetic coding sequence
atgagcagaatcgagaagatgagcatcctgggcgtgagaagcttcggcatcgaggacaaggacaagcagatcatcaccttcttcagccccctgaccatcctggtgggccccaacggcgccggcaagaccaccatcatcgagtgcctgaagtacatctgcaccggcgacttcccccccggcaccaagggcaacaccttcgtgcacgaccccaaggtggcccaggagaccgacgtgagagcccagatcagactgcagttcagagacgtgaacggcgagctgatcgccgtgcagagaagcatggtgtgcacccagaagagcaagaagaccgagttcaagaccctggagggcgtgatcaccagaaccaagcacggcgagaaggtgagcctgagcagcaagtgcgccgagatcgacagagagatgatcagcagcctgggcgtgagcaaggccgtgctgaacaacgtgatcttctgccaccaggaggacagcaactggcccctgagcgagggcaaggccctgaagcagaagttcgacgagatcttcagcgccaccagatacatcaaggccctggagaccctgagacaggtgagacagacccagggccagaaggtgaaggagtaccagatggagctgaagtacctgaagcagtacaaggagaaggcctgcgagatcagagaccagatcaccagcaaggaggcccagctgaccagcagcaaggagatcgtgaagagctacgagaacgagctggaccccctgaagaacagactgaaggagatcgagcacaacctgagcaagatcatgaagctggacaacgagatcaaggccctggacagcagaaagaagcagatggagaaggacaacagcgagctggaggagaagatggagaaggtgttccagggcaccgacgagcagctgaacgacctgtaccacaaccaccagagaaccgtgagagagaaggagagaaagctggtggactgccacagagagctggagaagctgaacaaggagagcagactgctgaaccaggagaagagcgagctgctggtggagcagggcagactgcagctgcaggccgacagacaccaggagcacatcagagccagagacagcctgatccagagcctggccacccagctggagctggacggcttcgagagaggccccttcagcgagagacagatcaagaacttccacaagctggtgagagagagacaggagggcgaggccaagaccgccaaccagctgatgaacgacttcgccgagaaggagaccctgaagcagaagcagatcgacgagatcagagacaagaagaccggcctgggcagaatcatcgagctgaagagcgagatcctgagcaagaagcagaacgagctgaagaacgtgaagtacgagctgcagcagctggagggcagcagcgacagaatcctggagctggaccaggagctgatcaaggccgagagagagctgagcaaggccgagaagaacagcaacgtggagaccctgaagatggaggtgatcagcctgcagaacgagaaggccgacctggacagaaccctgagaaagctggaccaggagatggagcagctgaaccaccacaccaccaccagaacccagatggagatgctgaccaaggacaaggccgacaaggacgagcagatcagaaagatcaagagcagacacagcgacgagctgaccagcctgctgggctacttccccaacaagaagcagctggaggactggctgcacagcaagagcaaggagatcaaccagaccagagacagactggccaagctgaacaaggagctggccagcagcgagcagaacaagaaccacatcaacaacgagctgaagagaaaggaggagcagctgagcagctacgaggacaagctgttcgacgtgtgcggcagccaggacttcgagagcgacctggacagactgaaggaggagatcgagaagagcagcaagcagagagccatgctggccggcgccaccgccgtgtacagccagttcatcacccagctgaccgacgagaaccagagctgctgccccgtgtgccagagagtgttccagaccgaggccgagctgcaggaggtgatcagcgacctgcagagcaagctgagactggcccccgacaagctgaagagcaccgagagcgagctgaagaagaaggagaagagaagagacgagatgctgggcctggtgcccatgagacagagcatcatcgacctgaaggagaaggagatccccgagctgagaaacaagctgcagaacgtgaacagagacatccagagactgaagaacgacatcgaggagcaggagaccctgctgggcaccatcatgcccgaggaggagagcgccaaggtgtgcctgaccgacgtgaccatcatggagagattccagatggagctgaaggacgtggagagaaagatcgcccagcaggccgccaagctgcagggcatcgacctggacagaaccgtgcagcaggtgaaccaggagaagcaggagaagcagcacaagctggacaccgtgagcagcaagatcgagctgaacagaaagctgatccaggaccagcaggagcagatccagcacctgaagagcaccaccaacgagctgaagagcgagaagctgcagatcagcaccaacctgcagagaagacagcagctggaggagcagaccgtggagctgagcaccgaggtgcagagcctgtacagagagatcaaggacgccaaggagcaggtgagccccctggagaccaccctggagaagttccagcaggagaaggaggagctgatcaacaagaagaacaccagcaacaagatcgcccaggacaagctgaacgacatcaaggagaaggtgaagaacatccacggctacatgaaggacatcgagaactacatccaggacggcaaggacgactacaagaagcagaaggagaccgagctgaacaaggtgatcgcccagctgagcgagtgcgagaagcacaaggagaagatcaacgaggacatgagactgatgagacaggacatcgacacccagaagatccaggagagatggctgcaggacaacctgaccctgagaaagagaaacgaggagctgaaggaggtggaggaggagagaaagcagcacctgaaggagatgggccagatgcaggtgctgcagatgaagagcgagcaccagaagctggaggagaacatcgacaacatcaagagaaaccacaacctggccctgggcagacagaagggctacgaggaggagatcatccacttcaagaaggagctgagagagccccagttcagagacgccgaggagaagtacagagagatgatgatcgtgatgagaaccaccgagctggtgaacaaggacctggacatctactacaagaccctggaccaggccatcatgaagttccacagcatgaagatggaggagatcaacaagatcatcagagacctgtggagaagcacctacagaggccaggacatcgagtacatcgagatcagaagcgacgccgacgagaacgtgagcgccagcgacaagagaagaaactacaactacagagtggtgatgctgaagggcgacaccgccctggacatgagaggcagatgcagcgccggccagaaggtgctggccagcctgatcatcagactggccctggccgagaccttctgcctgaactgcggcatcatcgccctggacgagcccaccaccaacctggacagagagaacatcgagagcctggcccacgccctggtggagatcatcaagagcagaagccagcagagaaacttccagctgctggtgatcacccacgacgaggacttcgtggagctgctgggcagaagcgagtacgtggagaagttctacagaatcaagaagaacatcgaccagtgcagcgagatcgtgaagtgcagcgtgagcagcctgggcttcaacgtgcactag

SEQ ID NO: 12504 - DNA, 3522 bp, Artificial Sequence
  Description of Artificial Sequence: Synthetic coding sequence
atgatcagcagcctgggcgtgagcaaggccgtgctgaacaacgtgatcttctgccaccaggaggacagcaactggcccctgagcgagggcaaggccctgaagcagaagttcgacgagatcttcagcgccaccagatacatcaaggccctggagaccctgagacaggtgagacagacccagggccagaaggtgaaggagtaccagatggagctgaagtacctgaagcagtacaaggagaaggcctgcgagatcagagaccagatcaccagcaaggaggcccagctgaccagcagcaaggagatcgtgaagagctacgagaacgagctggaccccctgaagaacagactgaaggagatcgagcacaacctgagcaagatcatgaagctggacaacgagatcaaggccctggacagcagaaagaagcagatggagaaggacaacagcgagctggaggagaagatggagaaggtgttccagggcaccgacgagcagctgaacgacctgtaccacaaccaccagagaaccgtgagagagaaggagagaaagctggtggactgccacagagagctggagaagctgaacaaggagagcagactgctgaaccaggagaagagcgagctgctggtggagcagggcagactgcagctgcaggccgacagacaccaggagcacatcagagccagagacagcctgatccagagcctggccacccagctggagctggacggcttcgagagaggccccttcagcgagagacagatcaagaacttccacaagctggtgagagagagacaggagggcgaggccaagaccgccaaccagctgatgaacgacttcgccgagaaggagaccctgaagcagaagcagatcgacgagatcagagacaagaagaccggcctgggcagaatcatcgagctgaagagcgagatcctgagcaagaagcagaacgagctgaagaacgtgaagtacgagctgcagcagctggagggcagcagcgacagaatcctggagctggaccaggagctgatcaaggccgagagagagctgagcaaggccgagaagaacagcaacgtggagaccctgaagatggaggtgatcagcctgcagaacgagaaggccgacctggacagaaccctgagaaagctggaccaggagatggagcagctgaaccaccacaccaccaccagaacccagatggagatgctgaccaaggacaaggccgacaaggacgagcagatcagaaagatcaagagcagacacagcgacgagctgaccagcctgctgggctacttccccaacaagaagcagctggaggactggctgcacagcaagagcaaggagatcaaccagaccagagacagactggccaagctgaacaaggagctggccagcagcgagcagaacaagaaccacatcaacaacgagctgaagagaaaggaggagcagctgagcagctacgaggacaagctgttcgacgtgtgcggcagccaggacttcgagagcgacctggacagactgaaggaggagatcgagaagagcagcaagcagagagccatgctggccggcgccaccgccgtgtacagccagttcatcacccagctgaccgacgagaaccagagctgctgccccgtgtgccagagagtgttccagaccgaggccgagctgcaggaggtgatcagcgacctgcagagcaagctgagactggcccccgacaagctgaagagcaccgagagcgagctgaagaagaaggagaagagaagagacgagatgctgggcctggtgcccatgagacagagcatcatcgacctgaaggagaaggagatccccgagctgagaaacaagctgcagaacgtgaacagagacatccagagactgaagaacgacatcgaggagcaggagaccctgctgggcaccatcatgcccgaggaggagagcgccaaggtgtgcctgaccgacgtgaccatcatggagagattccagatggagctgaaggacgtggagagaaagatcgcccagcaggccgccaagctgcagggcatcgacctggacagaaccgtgcagcaggtgaaccaggagaagcaggagaagcagcacaagctggacaccgtgagcagcaagatcgagctgaacagaaagctgatccaggaccagcaggagcagatccagcacctgaagagcaccaccaacgagctgaagagcgagaagctgcagatcagcaccaacctgcagagaagacagcagctggaggagcagaccgtggagctgagcaccgaggtgcagagcctgtacagagagatcaaggacgccaaggagcaggtgagccccctggagaccaccctggagaagttccagcaggagaaggaggagctgatcaacaagaagaacaccagcaacaagatcgcccaggacaagctgaacgacatcaaggagaaggtgaagaacatccacggctacatgaaggacatcgagaactacatccaggacggcaaggacgactacaagaagcagaaggagaccgagctgaacaaggtgatcgcccagctgagcgagtgcgagaagcacaaggagaagatcaacgaggacatgagactgatgagacaggacatcgacacccagaagatccaggagagatggctgcaggacaacctgaccctgagaaagagaaacgaggagctgaaggaggtggaggaggagagaaagcagcacctgaaggagatgggccagatgcaggtgctgcagatgaagagcgagcaccagaagctggaggagaacatcgacaacatcaagagaaaccacaacctggccctgggcagacagaagggctacgaggaggagatcatccacttcaagaaggagctgagagagccccagttcagagacgccgaggagaagtacagagagatgatgatcgtgatgagaaccaccgagctggtgaacaaggacctggacatctactacaagaccctggaccaggccatcatgaagttccacagcatgaagatggaggagatcaacaagatcatcagagacctgtggagaagcacctacagaggccaggacatcgagtacatcgagatcagaagcgacgccgacgagaacgtgagcgccagcgacaagagaagaaactacaactacagagtggtgatgctgaagggcgacaccgccctggacatgagaggcagatgcagcgccggccagaaggtgctggccagcctgatcatcagactggccctggccgagaccttctgcctgaactgcggcatcatcgccctggacgagcccaccaccaacctggacagagagaacatcgagagcctggcccacgccctggtggagatcatcaagagcagaagccagcagagaaacttccagctgctggtgatcacccacgacgaggacttcgtggagctgctgggcagaagcgagtacgtggagaagttctacagaatcaagaagaacatcgaccagtgcagcgagatcgtgaagtgcagcgtgagcagcctgggcttcaacgtgcactag

SEQ ID NO: 12505 - DNA, 1020 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctggccgaggccgccaagctggtgcccatgggcttcaccaccgccaccgagttccaccagagaagaagcgagatcatccagatcaccaccggcagcaaggagctggacaagctgctgcagggcggcatcgagaccggcagcatcaccgagatgttcggcgagttcagaaccggcaagacccagatctgccacaccctggccgtgacctgccagctgcccatcgacagaggcggcggcgagggcaaggccatgtacatcgacaccgagggcaccttcagacccgagagactgctggccgtggccgagagatacggcctgagcggcagcgacgtgctggacaacgtggcctacgccagagccttcaacaccgaccaccagacccagctgctgtaccaggccagcgccatgatggtggagagcagatacgccctgctgatcgtggacagcgccaccgccctgtacagaaccgactacagcggcagaggcgagctgagcgccagacagatgcacctggccagattcctgagaatgctgctgagactggccgacgagttcggcgtggccgtggtgatcaccaaccaggtggtggcccaggtggacggcgccgccatgttcgccgccgaccccaagaagcccatcggcggcaacatcatcgcccacgccagcaccaccagactgtacctgagaaagggcagaggcgagaccagaatctgcaagatctacgacagcccctgcctgcccgaggccgaggccatgttcgccatcaacgccgacggcgtgggcgacgccaaggactag

SEQ ID NO: 12506 - DNA, 729 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctgctgctgagccacagatacggcctgagcggcagcgacgtgctggacaacgtggcctacgccagagccttcaacaccgaccaccagacccagctgctgtaccaggccagcgccatgatggtggagagcagatacgccctgctgatcgtggacagcgccaccgccctgtacagaaccgactacagcggcagaggcgagctgagcgccagacagatgcacctggccagattcctgagaatgctgctgagactggccgacgagttcggcgtggccgtggtgatcaccaaccaggtggtggcccaggtggacggcgccgccatgttcgccgccgaccccaagaagcccatcggcggcaacatcatcgcccacgccagcaccaccagactgtacctgagaaagggcagaggcgagaccagaatctgcaagatctacgacagcccctgcctgcccgaggccgaggccatgttcgccatcaacgccgacggcgtgggcgacgccaaggactag

SEQ ID NO: 12507 - DNA, 1023 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctgaccgagagcagaagcgtggccagactggagtgcaacagcgtgatcctggtgtactgcaccctgagactgagcggcagcagcgacagccccgccagcgccagcagagtggtgggcaccaccggcggcatcgagaccggcagcatcaccgagatgttcggcgagttcagaaccggcaagacccagatctgccacaccctggccgtgacctgccagctgcccatcgacagaggcggcggcgagggcaaggccatgtacatcgacaccgagggcaccttcagacccgagagactgctggccgtggccgagagatacggcctgagcggcagcgacgtgctggacaacgtggcctacgccagagccttcaacaccgaccaccagacccagctgctgtaccaggccagcgccatgatggtggagagcagatacgccctgctgatcgtggacagcgccaccgccctgtacagaaccgactacagcggcagaggcgagctgagcgccagacagatgcacctggccagattcctgagaatgctgctgagactggccgacgagttcggcgtggccgtggtgatcaccaaccaggtggtggcccaggtggacggcgccgccatgttcgccgccgaccccaagaagcccatcggcggcaacatcatcgcccacgccagcaccaccagactgtacctgagaaagggcagaggcgagaccagaatctgcaagatctacgacagcccctgcctgcccgaggccgaggccatgttcgccatcaacgccgacggcgtgggcgacgccaaggactag

SEQ ID NO: 12508 - DNA, 843 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctggccgaggccgccaagctggtgcccatgggcttcaccaccgccaccgagttccaccagagaagaagcgagatcatccagatcaccaccggcagcaaggagctggacaagctgctgcagggcggcatcgagaccggcagcatcaccgagatgttcggcgagttcagaaccggcaagacccagatctgccacaccctggccgtgacctgccagctgcccatcgacagaggcggcggcgagggcaaggccatgtacatcgacaccgagggcaccttcagacccgagagactgctggccgtggccgagagatacggcctgagcggcagcgacgtgctggacaacgtggcctacgccagagccttcaacaccgaccaccagacccagctgctgtaccaggccagcgccatgatggtggagagcagatacgccctgctgatcgtggacagcgccaccgccctgtacagaaccgactacagcggcagaggcgagctgagcgccagacagatgcacctggccagattcctgagaatgctgctgagactggccgacgagatcgtgagcgaggagagaaagagaggcaaccagaacctgcagaacctgagactgagcctgagcagctag

SEQ ID NO: 12509 - DNA, 456 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctggccgaggccgccaagctggtgcccatgggcttcaccaccgccaccgagttccaccagagaagaagcgagatcatccagatcaccaccggcagcaaggagctggacaagctgctgcagggcggcatcgagaccggcagcatcaccgagatgttcggcgagttcagaaccggcaagacccagatctgccacaccctggccgtgacctgccaggtgtggagcctgtggcagtag

SEQ ID NO: 12510 - DNA, 228 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctgtag

SEQ ID NO: 12511 - DNA, 519 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctggccgaggccgccaagctggtgcccatgggcttcaccaccgccaccgagttccaccagagaagaagcgagatcatccagatcaccaccggcagcaaggagctggacaagctgctgcagggcggcatcgagaccggcagcatcaccgagatgttcggcgagttcagaaccggcaagacccagatctgccacaccctggccgtgacctgccagctgcccatcgacagaggcggcggcgagggcaaggccatgtacatcgacaccgagggcaccttcagacccgagagactgctgtag

SEQ ID NO: 12512 - DNA, 303 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctggtggagctgagactggacctgagccagaagtgcctggagaacagcgagctgggcagacccagaagcgtgatcagatag

SEQ ID NO: 12513 - DNA, 1023 bp, Artificial Sequence; identical to SEQ ID NO: 12507
  Description of Artificial Sequence: Synthetic coding sequence

SEQ ID NO: 12514 - DNA, 729 bp, Artificial Sequence
  Description of Artificial Sequence: Synthetic coding sequence
atggccatgcagatgcagctggaggccaacgccgacaccagcgtggaggaggagagcttcggcccccagcccatcagcagactggagcagtgcggcatcaacgccaacgacgtgaagaagctggaggaggccggcttccacaccgtggaggccgtggcctacgcccccaagaaggagctgatcaacatcaagggcatcagcgaggccaaggccgacaagatcctggccgtggccgagagatacggcctgagcggcagcgacgtgctggacaacgtggcctacgccagagccttcaacaccgaccaccagacccagctgctgtaccaggccagcgccatgatggtggagagcagatacgccctgctgatcgtggacagcgccaccgccctgtacagaaccgactacagcggcagaggcgagctgagcgccagacagatgcacctggccagattcctgagaatgctgctgagactggccgacgagttcggcgtggccgtggtgatcaccaaccaggtggtggcccaggtggacggcgccgccatgttcgccgccgaccccaagaagcccatcggcggcaacatcatcgcccacgccagcaccaccagactgtacctgagaaagggcagaggcgagaccagaatctgcaagatctacgacagcccctgcctgcccgaggccgaggccatgttcgccatcaacgccgacggcgtgggcgacgccaaggactag

SEQ ID NO: 12515 - DNA, 1053 bp, Artificial Sequence
  Description of Artificial Sequence: Synthetic coding sequence
atgggcagcaagaagctgaagagagtgggcctgagccaggagctgtgcgacagactgagcagacaccagatcctgacctgccaggacttcctgtgcctgagccccctggagctgatgaaggtgaccggcctgagctacagaggcgtgcacgagctgctgtgcatggtgagcagagcctgcgcccccaagatgcagaccgcctacggcatcaaggcccagagaagcgccgacttcagccccgccttcctgagcaccaccctgagcgccctggacgaggccctgcacggcggcgtggcctgcggcagcctgaccgagatcaccggcccccccggctgcggcaagacccagttctgcatcatgatgagcatcctggccaccctgcccaccaacatgggcggcctggagggcgccgtggtgtacatcgacaccgagagcgccttcagcgccgagagactggtggagatcgccgagagcagattccccagatacttcaacaccgaggagaagctgctgctgaccagcagcaaggtgcacctgtacagagagctgacctgcgacgaggtgctgcagagaatcgagagcctggaggaggagatcatcagcaagggcatcaagctggtgatcctggacagcgtggccagcgtggtgagaaaggagttcgacgcccagctgcagggcaacctgaaggagagaaacaagttcctggccagagaggccagcagcctgaagtacctggccgaggagttcagcatccccgtgatcctgaccaaccagatcaccacccacctgagcggcgccctggccagccaggccgacctggtgagccccgccgacgacctgagcctgagcgagggcaccagcggcagcagctgcgtgatcgccgccctgggcaacacctggagccacagcgtgaacaccagactgatcctgcagtacctggacagcgagagaagacagatcctgatcgccaagagccccctggcccccttcaccagcttcgtgtacaccatcaaggaggagggcctggtgctgcaggcctacgcccagtgctag

SEQ ID NO: 12516 - DNA, 1101 bp, Artificial Sequence
  Description of Artificial Sequence: Synthetic coding sequence
atgggcagcaagaagctgaagagagtgggcctgagccaggagctgtgcgacagactgagcagacaccagatcctgacctgccaggacttcctgtgcctgagccccctggagctgatgaaggtgaccggcctgagctacagaggcgtgcacgagctgctgtgcatggtgagcagagcctgcgcccccaagatgcagaccgcctacggcatcaaggcccagagaagcgccgacttcagccccgccttcctgagcaccaccctgagcgccctggacgaggccctgcacggcggcgtggcctgcggcagcctgaccgagatcaccggcccccccggctgcggcaagacccagttctgcatcatgatgagcatcctggccaccctgcccaccaacatgggcggcctggagggcgccgtggtgtacatcgacaccgagagcgccttcagcgccgagagactggtggagatcgccgagagcagattccccagatacttcaacaccgaggagaagctgctgctgaccagcagcaaggtgcacctgtacagagagctgacctgcgacgaggtgctgcagagaatcgagagcctggaggaggagatcatcagcaagggcatcaagctggtgatcctggacagcgtggccagcgtggtgagaaaggagttcgacgcccagctgcagggcaacctgaaggagagaaacaagttcctggccagagaggccagcagcctgaagtacctggccgaggagttcagcatccccgtgatcctgaccaaccagatcaccacccacctgagcggcgccctggccagccaggccgacctggtgagccccgccgacgacctgagcctgagcgagggcaccagcggcagcagctgcgtgatcgccgccctgggcaacacctggagccacagcgtgaacaccagactgatcctgcagtacctggacagcgagagaagacagatcctgatcgccaagagccccctggcccccttcaccagcttcgtgtacaccatcaaggaggagggcctggtgctgcaggagttctggcacatctgcatcagcggcttcagcatccagaacagactgaaggagaacgagagctag

SEQ ID NO: 12517 - DNA, 1053 bp, Artificial Sequence
  Description of Artificial Sequence: Synthetic coding sequence
atgggcagcaagaagctgaagagagtgggcctgagccaggagctgtgcgacagactgagcagacaccagatcctgacctgccaggacttcctgtgcctgagccccctggagctgatgaaggtgaccggcctgagctacagaggcgtgcacgagctgctgtgcatggtgagcagagcctgcgcccccaagatgcagaccgcctacggcatcaaggcccagagaagcgccgacttcagccccgccttcctgagcaccaccctgagcgccctggacgaggccctgcacggcggcgtggcctgcggcagcctgaccgagatcaccggcccccccggctgcggcaagacccagttctgcatcatgatgagcatcctggccaccctgcccaccaacatgggcggcctggagggcgccgtggtgtacatcgacaccgagagcgccttcagcgccgagagactggtggagatcgccgagagcagattccccagatacttcaacaccgaggagaagctgctgctgaccagcagcaaggtgcacctgtacagagagctgacctgcgacgaggtgctgcagagaatcgagagcctggaggaggagatcatcagcaagggcatcaagctggtgatcctggacagcgtggccagcgtggtgagaaaggagttcgacgcccagctgcagggcaacctgaaggagagaaacaagttcctggccagagaggccagcagcctgaagtacctggccgaggagttcagcatccccgtgatcctgaccaaccagatcaccacccacctgagcggcgccctggccagccaggccgacctggtgagccccgccgacgacctgagcctgagcgagggcaccagcggcagcagctgcgtgatcgccgccctgggcaacacctggagccacagcgtgaacaccagactgatcctgcagtacctggacagcgagagaagacagatcctgatcgccaagagccccctggcccccttcaccagcttcgtgtacaccatcaaggaggagggcctggtgctgcagggccaggagaccccctag

SEQ ID NO: 12518 - DNA, 1053 bp, Artificial Sequence
  Description of Artificial Sequence: Synthetic coding sequence
atgggcagcaagaagctgaagagagtgggcctgagccaggagctgtgcgacagactgagcagacaccagatcctgacctgccaggacttcctgtgcctgagccccctggagctgatgaaggtgaccggcctgagctacagaggcgtgcacgagctgctgtgcatggtgagcagagcctgcgcccccaagatgcagaccgcctacggcatcaaggcccagagaagcgccgacttcagccccgccttcctgagcaccaccctgagcgccctggacgaggccctgcacggcggcgtggcctgcggcagcctgaccgagatcaccggcccccccggctgcggcaagacccagttctgcatcatgatgagcatcctggccaccctgcccaccaacatgggcggcctggagggcgccgtggtgtacatcgacaccgagagcgccttcagcgccgagagactggtggagatcgccgagagcagattccccagatacttcaacaccgaggagaagctgctgctgaccagcagcaaggtgcacctgtacagagagctgacctgcgacgaggtgctgcagagaatcgagagcctggaggaggagatcatcagcaagggcatcaagctggtgatcctggacagcgtggccagcgtggtgagaaaggagttcgacgcccagctgcagggcaacctgaaggagagaaacaagttcctggccagagaggccagcagcctgaagtacctggccgaggagttcagcatccccgtgatcctgaccaaccagatcaccacccacctgagcggcgccctggccagccaggccgacctggtgagccccgccgacgacctgagcctgagcgagggcaccagcggcagcagctgcgtgatcgccgccctgggcaacacctggagccacagcgtgaacaccagactgatcctgcagtacctggacagcgagagaagacagatcctgatcgccaagagccccctggcccccttcaccagcttcgtgtacaccatcaaggaggagggcctggtgctgcagggccaggagaagccctag

SEQ ID NO: 12519 - DNA, 402 bp, Artificial Sequence
  Description of Artificial Sequence: Synthetic coding sequence
atgggcagcaagaagctgaagagagtgggcctgagccaggagctgtgcgacagactgagcagacaccagatcctgacctgccaggacttcctgtgcctgagccccctggagctgatgaaggtgaccggcctgagctacagaggcgtgcacgagctgctgtgcatggtgagcagagcctgcgcccccaagatgcagaccgcctacggcatcaaggcccagagaagcgccgacttcagccccgccttcctgagcaccaccctgagcgccctggacgaggccctgcacggcggcgtggcctgcggcagcctgaccgagatcaccggcccccccggctgcggcaagacccagttctgcatcatgatgagcatcctggccaccctgcccaccaacatgggcggctag

SEQ ID NO: 12520 - DNA, 1155 bp, Artificial Sequence
  Description of Artificial Sequence: Synthetic coding sequence
atgggcagcaagaagctgaagagagtgggcctgagccaggagctgtgcgacagactgagcagacaccagatcctgacctgccaggacttcctgtgcctgagccccctggagctgatgaaggtgaccggcctgagctacagaggcgtgcacgagctgctgtgcatggtgagcagagcctgcgcccccaagatgcagaccgcctacggcatcaaggcccagagaagcgccgacttcagccccgccttcctgagcaccaccctgagcgccctggacgaggccctgcacggcggcgtggcctgcggcagcctgaccgagatcaccggcccccccggctgcggcaagacccagttctgcatcatgatgagcatcctggccaccctgcccaccaacatgggcggcctggagggcgccgtggtgtacatcgacaccgagagcgccttcagcgccgagagactggtggagatcgccgagagcagattccccagatacttcaacaccgaggagaagctgctgctgaccagcagcaaggtgcacctgtacagagagctgacctgcgacgaggtgctgcagagaatcgagagcctggaggaggagatcatcagcaagggcatcaagctggtgatcctggacagcgtggccagcgtggtgagaaaggagttcgacgcccagctgcagggcaacctgaaggagagaaacaagttcctggccagagaggccagcagcctgaagtacctggccgaggagttcagcatccccgtgatcctgaccaaccagatcaccacccacctgagcggcgccctggccagccaggccgacctggtgagccccgccgacgacctgagcctgagcgagggcaccagcggcagcagctgcgtgatcgccgccctgggcaacacctggagccacagcgtgaacaccagactgatcctgcagtacctggacagcgagagaagacagatcctgatcgccaagagccccctggcccccttcaccagcttcgtgtacaccatcaaggaggagggcctggtgctgcaggagaccaccttctgcagcgtgacccaggccgagctgaactgggcccccgagatcctgcccccccagccccccgagcagctgggcctgcagatgtgccaccacacccagctgatcttctag

SEQ ID NO: 12521 - DNA, 1101 bp, Artificial Sequence; identical to SEQ ID NO: 12516
  Description of Artificial Sequence: Synthetic coding sequence

SEQ ID NO: 12522 - DNA, 228 bp, Artificial Sequence
  Description of Artificial Sequence: Synthetic coding sequence
atgggcagcaagaagctgaagagagtgggcctgagccaggagctgtgcgacagactgagcagacaccagatcctgacctgccaggacttcctgtgcctgagccccctggagctgatgaaggtgaccggcctgagctacagaggcgtgcacgagctgctgtgcatggtgagcagagcctgcgcccccaagatgcagaccgcctacggcatcaaggcccagagaagctag

SEQ ID NO: 12523 - DNA, 1131 bp, Artificial Sequence
  Description of Artificial Sequence: Synthetic coding sequence
atgagaggcaagaccttcagattcgagatgcagagagacctggtgagcttccccctgagccccgccgtgagagtgaagctggtgagcgccggcttccagaccgccgaggagctgctggaggtgaagcccagcgagctgagcaaggaggtgggcatcagcaaggccgaggccctggagaccctgcagatcatcagaagagagtgcctgaccaacaagcccagatacgccggcaccagcgagagccacaagaagtgcaccgccctggagctgctggagcaggagcacacccagggcttcatcatcaccttctgcagcgccctggacgacatcctgggcggcggcgtgcccctgatgaagaccaccgagatctgcggcgcccccggcgtgggcaagacccagctgtgcatgcagctggccgtggacgtgcagatccccgagtgcttcggcggcgtggccggcgaggccgtgttcatcgacaccgagggcagcttcatggtggacagagtggtggacctggccaccgcctgcatccagcacctgcagctgatcgccgagaagcacaagggcgaggagcacagaaaggccctggaggacttcaccctggacaacatcctgagccacatctactacttcagatgcagagactacaccgagctgctggcccaggtgtacctgctgcccgacttcctgagcgagcacagcaaggtgagactggtgatcgtggacggcatcgccttccccttcagacacgacctggacgacctgagcctgagaaccagactgctgaacggcctggcccagcagatgatcagcctggccaacaaccacagactggccgtgatcctgaccaaccagatgaccaccaagatcgacagaaaccaggccctgctggtgcccgccctgggcgagagctggggccacgccgccaccatcagactgatcttccactgggacagaaagcagagactggccaccctgtacaagagccccagccagaaggagtgcaccgtgctgttccagatcaagccccagggcttcagagacaccgtggtgaccagcgcctgcagcctgcagaccgagggcagcctgagcaccagaaagagaagcagagaccccgaggaggagctgtag

SEQ ID NO: 12524 - DNA, 987 bp, Artificial Sequence
  Description of Artificial Sequence: Synthetic coding sequence
atgggcgtgctgagagtgggcctgtgccccggcctgaccgaggagatgatccagctgctgagaagccacagaatcaagaccgtggtggacctggtgagcgccgacctggaggaggtggcccagaagtgcggcctgagctacaaggccctggtggccctgagaagagtgctgctggcccagttcagcgccttccccgtgaacggcgccgacctgtacgaggagctgaagaccagcaccgccatcctgagcaccggcatcggcagaatcagactgagcggcaacgccagatggctgatgcccaaggtgaccgagatcgtgggcggccccggcagcggcaagacccaggtgtgcctgtgcatggccgccaacgtggcccacggcctgcagcagaacgtgctgtacgtggacagcaacggcggcctgaccgccagcagactgctgcagctgctgcaggccaagacccaggacgaggaggagcaggccgaggccctgagaagaatccaggtggtgcacgccttcgacatcttccagatgctggacgtgctgcaggagctgagaggcaccgtggcccagcaggtgaccggcagcagcggcaccgtgaaggtggtggtggtggacagcgtgaccgccgtggtgagccccctgctgggcggccagcagagagagggcctggccctgatgatgcagctggccagagagctgaagaccctggccagagacctgggcatggccgtggtggtgaccaaccacatcaccagagacagagacagcggcagactgaagcccgccctgggcagaagctggagcttcgtgcccagcaccagaatcctgctggacaccatcgagggcgccggcgccagcggcggcagaagaatggcctgcctggccaagagcagcagacagcccaccggcttccaggagatggtggacatcggcacctggggcaccagcgagcagagcgccaccctgcagggcgaccagacctag

SEQ ID NO: 12525 - DNA, 987 bp, Artificial Sequence
  Description of Artificial Sequence: Synthetic coding sequence
atgggcgtgctgagagtgggcctgtgccccggcctgaccgaggagatgatccagctgctgagaagccacagaatcaagaccgtggtggacctggtgagcgccgacctggaggaggtggcccagaagtgcggcctgagctacaaggccctggtggccctgagaagagtgctgctggcccagttcagcgccttccccgtgaacggcgccgacctgtacgaggagctgaagaccagcaccgccatcctgagcaccggcatcggcagcctggacaagctgctggacgccggcctgtacaccggcgaggtgaccgagatcgtgggcggccccggcagcggcaagacccaggtgtgcctgtgcatggccgccaacgtggcccacggcctgcagcagaacgtgctgtacgtggacagcaacggcggcctgaccgccagcagactgctgcagctgctgcaggccaagacccaggacgaggaggagcaggccgaggccctgagaagaatccaggtggtgcacgccttcgacatcttccagatgctggacgtgctgcaggagctgagaggcaccgtggcccagcaggtgaccggcagcagcggcaccgtgaaggtggtggtggtggacagcgtgaccgccgtggtgagccccctgctgggcggccagcagagagagggcctggccctgatgatgcagctggccagagagctgaagaccctggccagagacctgggcatggccgtggtggtgaccaaccacatcaccagagacagagacagcggcagactgaagcccgccctgggcagaagctggagcttcgtgcccagcaccagaatcctgctggacaccatcgagggcgccggcgccagcggcggcagaagaatggcctgcctggccaagagcagcagacagcccaccggcttccaggagatggtggacatcggcacctggggcaccagcgagcagagcgccaccctgcagggcgaccagacctag

SEQ ID NO: 12526 - DNA, 651 bp, Artificial Sequence
  Description of Artificial Sequence: Synthetic coding sequence
atgggcgtgctgagagtgggcctgtgccccggcctgaccgaggagatgatccagctgctgagaagccacagaatcaagaccgtggtggacctggtgagcgccgacctggaggaggtggcccagaagtgcggcctgagctacaaggccgaggccctgagaagaatccaggtggtgcacgccttcgacatcttccagatgctggacgtgctgcaggagctgagaggcaccgtggcccagcaggtgaccggcagcagcggcaccgtgaaggtggtggtggtggacagcgtgaccgccgtggtgagccccctgctgggcggccagcagagagagggcctggccctgatgatgcagctggccagagagctgaagaccctggccagagacctgggcatggccgtggtggtgaccaaccacatcaccagagacagagacagcggcagactgaagcccgccctgggcagaagctggagcttcgtgcccagcaccagaatcctgctggacaccatcgagggcgccggcgccagcggcggcagaagaatggcctgcctggccaagagcagcagacagcccaccggcttccaggagatggtggacatcggcacctggggcaccagcgagcagagcgccaccctgcagggcgaccagacctag

SEQ ID NO: 12527 - DNA, 357 bp, Artificial Sequence
  Description of Artificial Sequence: Synthetic coding sequence
atgggcgtgctgagagtgggcctgtgccccggcctgaccgaggagatgatccagctgctgagaagccacagaatcaagaccgtggtggacctggtgagcgccgacctggaggaggtggcccagaagtgcggcctgagctacaaggccctggtggccctgagaagagtgctgctggcccagttcagcgccttccccgtgaacggcgccgacctgtacgaggagctgaagaccagcaccgccatcctgagcaccggcatcggcagacacggcggcagaacccaggtgggcacctgggaggactgcagctgcctgagaagcccccagggcgacagaggcgtgggcagcggcatgctgtag

SEQ ID NO: 12528 - DNA, 852 bp, Artificial Sequence
  Description of Artificial Sequence: Synthetic coding sequence
atgggcgtgctgagagtgggcctgtgccccggcctgaccgaggagatgatccagctgctgagaagccacagaatcaagaccgtggtggacctggtgagcgccgacctggaggaggtggcccagaagtgcggcctgagctacaaggccctggtggccctgagaagagtgctgctggcccagttcagcgccttccccgtgaacggcgccgacctgtacgaggagctgaagaccagcaccgccatcctgagcaccggcatcggcagcctggacaagctgctggacgccggcctgtacaccggcgaggtgaccgagatcgtgggcggccccggcagcggcaagacccaggccgaggccctgagaagaatccaggtggtgcacgccttcgacatcttccagatgctggacgtgctgcaggagctgagaggcaccgtggcccagcaggtgaccggcagcagcggcaccgtgaaggtggtggtggtggacagcgtgaccgccgtggtgagccccctgctgggcggccagcagagagagggcctggccctgatgatgcagctggccagagagctgaagaccctggccagagacctgggcatggccgtggtggtgaccaaccacatcaccagagacagagacagcggcagactgaagcccgccctgggcagaagctggagcttcgtgcccagcaccagaatcctgctggacaccatcgagggcgccggcgccagcggcggcagaagaatggcctgcctggccaagagcagcagacagcccaccggcttccaggagatggtggacatcggcacctggggcaccagcgagcagagcgccaccctgcagggcgaccagacctag

SEQ ID NO: 12529 - DNA, 1047 bp, Artificial Sequence
  Description of Artificial Sequence: Synthetic coding sequence
atgggcgtgctgagagtgggcctgtgccccggcctgaccgaggagatgatccagctgctgagaagccacagaatcaagaccgtggtggacctggtgagcgccgacctggaggaggtggcccagaagtgcggcctgagctacaagacctggagagcccacagcagcggcaacctgggcggcctgcagctgccccaggtgcccgccggcagaagctggagcggcgtgagaaacgccctgaagaaggccggcctgggccacggcggcaccgacggcctgagcctgaacgccttcgacgagagaggcaccgccgtgagcaccagcagactggacaagctgctggacgccggcctgtacaccggcgaggtgaccgagatcgtgggcggccccggcagcggcaagacccaggtgtgcctgtgcatggccgccaacgtggcccacggcctgcagcagaacgtgctgtacgtggacagcaacggcggcctgaccgccagcagactgctgcagctgctgcaggccaagacccaggacgaggaggagcaggccgaggccctgagaagaatccaggtggtgcacgccttcgacatcttccagatgctggacgtgctgcaggagctgagaggcaccgtggcccagcaggtgaccggcagcagcggcaccgtgaaggtggtggtggtggacagcgtgaccgccgtggtgagccccctgctgggcggccagcagagagagggcctggccctgatgatgcagctggccagagagctgaagaccctggccagagacctgggcatggccgtggtggtgaccaaccacatcaccagagacagagacagcggcagactgaagcccgccctgggcagaagctggagcttcgtgcccagcaccagaatcctgctggacaccatcgagggcgccggcgccagcggcggcagaagaatggcctgcctggccaagagcagcagacagcccaccggcttccaggagatggtggacatcggcacctggggcaccagcgagcagagcgccaccctgcagggcgaccagacctag

SEQ ID NO: 12530 - DNA, 648 bp, Artificial Sequence
  Description of Artificial Sequence: Synthetic coding sequence
atggtgatggccgccctgcccttcagcgaggacctgaagatgcccgacacctgcgtgctgccccactgccccggcaaggagaacaaggacgtggtggacctggtgagcgccgacctggaggaggtggcccagaagtgcggcctgagctacaaggccctggtggccctgagaagagtgctgctggcccagttcagcgccttccccgtgaacggcgccgacctgtacgaggagctgaagaccagcaccgccatcctgagcaccggcatcggcagcctggacaagctgctggacgccggcctgtacaccggcgaggtgaccgagatcgtgggcggccccggcagcggcaagacccaggtgtgcctgtgcatggccgccaacgtggcccacggcctgcagcagaacgtgctgtacgtggacagcaacggcggcctgaccgccagcagactgctgcagctgctgcaggccaagacccaggacgaggaggagcaggccgaggccctgagaagaatccaggtggtgcacgccttcgacatcttccagatgctggacgtgctgcaggagctgagaggcaccgtggcccagcaggacggcatccccgagcacctgaaccacatcccccactgcctgcacgtgcacctgccctgctag

SEQ ID NO: 12531 - DNA, 711 bp, Artificial Sequence
  Description of Artificial Sequence: Synthetic coding sequence
atgggcgtgctgagagtgggcctgtgccccggcctgaccgaggagatgatccagctgctgagaagccacagaatcaagaccgtggtggacctggtgagcgccgacctggaggaggtggcccagaagtgcggcctgagctacaaggccctggtggccctgagaagagtgctgctggcccagttcagcgccttccccgtgaacggcgccgacctgtacgaggagctgaagaccagcaccgccatcctgagcaccggcatcggcagcctggacaagctgctggacgccggcctgtacaccggcgaggtgaccgagatcgtgggcggccccggcagcggcaagacccaggtgtgcctgtgcatggccgccaacgtggcccacggcctgcagcagaacgtgctgtacgtggacagcaacggcggcctgaccgccagcagactgctgcagctgctgcaggccaagacccaggacgaggaggagcaggccgaggccctgagaagaatccaggtggtgcacgccttcgacatcttccagatgctggacgtgctgcaggagctgagaggcaccgtggcccagcaggtgaccggcagcagcggcaccgtgaaggtggtggtggtggacagcgtgaccgccgtggtgagccccctgctgggcggccagcagagagagggcctggccctgatgatgcagctggccagagagctgaagacctag

SEQ ID NO: 12532 - DNA, 1047 bp, Artificial Sequence; identical to SEQ ID NO: 12529
  Description of Artificial Sequence: Synthetic coding sequence

SEQ ID NO: 12533 - DNA, 1257 bp, Artificial Sequence
  Description of Artificial Sequence: Synthetic coding sequence
atgagcggcaccgaggaggccatcctgggcggcagagacagccaccccgccgccggcggcggcagcgtgctgtgcttcggccagtgccagtacaccgccgaggagtaccaggccatccagaaggccctgagacagagactgggccccgagtacatcagcagcagaatggccggcggcggccagaaggtgtgctacatcgagggccacagagtgatcaacctggccaacgagatgttcggctacaacggctgggcccacagcatcacccagcagaacgtggacttcgtggacctgaacaacggcaagttctacgtgggcgtgtgcgccttcgtgagagtgcagctgaaggacggcagctaccacgaggacgtgggctacggcgtgagcgagggcctgaagagcaaggccctgagcctggagaaggccagaaaggaggccgtgaccgacggcctgaagagagccctgagaagcttcggcaacgccctgggcaactgcatcctggacaaggactacctgagaagcctgaacaagctgcccagacagctgcccctggaggtggacctgaccaaggccaagagacaggacctggagcccagcgtggaggaggccagatacaacagctgcagacccaacatggccctgggccacccccagctgcagcaggtgaccagccccagcagacccagccacgccgtgatccccgccgaccaggactgcagcagcagaagcctgagcagcagcgccgtggagagcgaggccacccaccagagaaagctgagacagaagcagctgcagcagcagttcagagagagaatggagaagcagcaggtgagagtgagcacccccagcgccgagaagagcgaggccgccccccccgccccccccgtgacccacagcacccccgtgaccgtgagcgagcccctgctggagaaggacttcctggccggcgtgacccaggagctgatcaagaccctggaggacaacagcgagaagtgggccgtgacccccgacgccggcgacggcgtggtgaagcccagcagcagagccgaccccgcccagaccagcgacaccctggccctgaacaaccagatggtgacccagaacagaaccccccacagcgtgtgccaccagaagccccaggccaagagcggcagctgggacctgcagacctacagcgccgaccagagaaccaccggcaactgggagagccacagaaagagccaggacatgaagaagagaaagtacgaccccagctag

SEQ ID NO: 12534 - DNA, 1257 bp, Artificial Sequence; identical to SEQ ID NO: 12533
  Description of Artificial Sequence: Synthetic coding sequence

SEQ ID NO: 12535 - DNA, 1026 bp, Artificial Sequence
  Description of Artificial Sequence: Synthetic coding sequence
atgttcggctacaacggctgggcccacagcatcacccagcagaacgtggacttcgtggacctgaacaacggcaagttctacgtgggcgtgtgcgccttcgtgagagtgcagctgaaggacggcagctaccacgaggacgtgggctacggcgtgagcgagggcctgaagagcaaggccctgagcctggagaaggccagaaaggaggccgtgaccgacggcctgaagagagccctgagaagcttcggcaacgccctgggcaactgcatcctggacaaggactacctgagaagcctgaacaagctgcccagacagctgcccctggaggtggacctgaccaaggccaagagacaggacctggagcccagcgtggaggaggccagatacaacagctgcagacccaacatggccctgggccacccccagctgcagcaggtgaccagccccagcagacccagccacgccgtgatccccgccgaccaggactgcagcagcagaagcctgagcagcagcgccgtggagagcgaggccacccaccagagaaagctgagacagaagcagctgcagcagcagttcagagagagaatggagaagcagcaggtgagagtgagcacccccagcgccgagaagagcgaggccgccccccccgccccccccgtgacccacagcacccccgtgaccgtgagcgagcccctgctggagaaggacttcctggccggcgtgacccaggagctgatcaagaccctggaggacaacagcgagaagtgggccgtgacccccgacgccggcgacggcgtggtgaagcccagcagcagagccgaccccgcccagaccagcgacaccctggccctgaacaaccagatggtgacccagaacagaaccccccacagcgtgtgccaccagaagccccaggccaagagcggcagctgggacctgcagacctacagcgccgaccagagaaccaccggcaactgggagagccacagaaagagccaggacatgaagaagagaaagtacgaccccagctag

SEQ ID NO: 12536 - DNA, 681 bp, Artificial Sequence
  Description of Artificial Sequence: Synthetic coding sequence
atgagcggcaccgaggaggccatcctgggcggcagagacagccaccccgccgccggcggcggcagcgtgctgtgcttcggccagtgccagtacaccgccgaggagtaccaggccatccagaaggccctgagacagagactgggccccgagtacatcagcagcagaatggccggcggcggccagaaggtgtgctacatcgagggccacagagtgatcaacctggccaacgagatgttcggctacaacggctgggcccacagcatcacccagcagaacgtggacttcgtggacctgaacaacggcaagttctacgtgggcgtgtgcgccttcgtgagagtgcagctgaaggacggcagctaccacgaggacgtgggctacggcgtgagcgagggcctgaagagcaaggccctgagcctggagaaggccagaaaggaggccgtgaccgacggcctgaagagagccctgagactgcccctgctgggcgtgagcggcagaatcctgtacagcctgttcagcgtgcacagcgtgatgtgcgccggcggcctgcccacccccaccgccagcgcccagaccgcccccagcagcccctgcagcagcgccgtgctgagatacgcccaggagttctgggagtgcacctggaagctgtacagcggccagagactgcccgagatcaccaagtag

SEQ ID NO: 12537 - DNA, 2244 bp, Artificial Sequence
  Description of Artificial Sequence: Synthetic coding sequence
atgagaagaagcctggcccccagccagctggccaagagaaagcccgagggcagaagctgcgacgacgaggactggcagcccggcctggtgacccccagaaagagaaagagcagcagcgagacccagatccaggagtgcttcctgagccccttcagaaagcccctgagccagctgaccaaccagcccccctgcctggacagcagccagcacgaggccttcatcagaagcatcctgagcaagcccttcaaggtgcccatccccaactaccagggccccctgggcagcagagccctgggcctgaagagagccggcgtgagaagagccctgcacgaccccctggagaaggacgccctggtgctgtacgagcccccccccctgagcgcccacgaccagctgaagctggacaaggagaagctgcccgtgcacgtggtggtggaccccatcctgagcaaggtgctgagaccccaccagagagagggcgtgaagttcctgtgggagtgcgtgaccagcagaagaatccccggcagccacggctgcatcatggccgacgagatgggcctgggcaagaccctgcagtgcatcaccctgatgtggaccctgctgagacagagccccgagtgcaagcccgagatcgacaaggccgtggtggtgagccccagcagcctggtgaagaactggtacaacgaggtgggcaagtggctgggcggcagaatccagcccctggccatcgacggcggcagcaaggacgagatcgaccagaagctggagggcttcatgaaccagagaggcgccagagtgagcagccccatcctgatcatcagctacgagaccttcagactgcacgtgggcgtgctgcagaagggcagcgtgggcctggtgatctgcgacgagggccacagactgaagaacagcgagaaccagacctaccaggccctggacagcctgaacaccagcagaagagtgctgatcagcggcacccccatccagaacgacctgctggagtacttcagcctggtgcacttcgtgaacagcggcatcctgggcaccgcccacgagttcaagaagcacttcgagctgcccatcctgaagggcagagacgccgccgccagcgaggccgacagacagctgggcgaggagagactgagagagctgaccagcatcgtgaacagatgcctgatcagaagaaccagcgacatcctgagcaagtacctgcccgtgaagatcgagcaggtggtgtgctgcagactgacccccctgcagaccgagctgtacaagagattcctgagacaggccaagcccgccgaggagctgctggagggcaagatgagcgtgagcagcctgagcagcatcaccagcctgaagaagctgtgcaaccaccccgccctgatctacgacaagtgcgtggaggaggaggacggcttcgtgggcgccctggacctgttcccccccggctacagcagcaaggccctggagccccagctgagcggcaagatgctggtgctggactacatcctggccgtgaccagaagcagaagcagcgacaaggtggtgctggtgagcaactacacccagaccctggacctgttcgagaagctgtgcagagccagaagatacctgtacgtgagactggacggcaccatgagcatcaagaagagagccaaggtggtggagagattcaacagccccagcagccccgacttcgtgttcatgctgagcagcaaggccggcggctgcggcctgaacctgatcggcgccaacagactggtgatgttcgaccccgactggaaccccgccaacgacgagcaggccatggccagagtgtggagagacggccagaagaagacctgctacatctacagactgctgagcgccggcaccatcgaggagaagatcttccagagacagagccacaagaaggccctgagcagctgcgtggtggacgaggagcaggacgtggagagacacttcagcctgggcgagctgaaggagctgttcatcctggacgaggccagcctgagcgacacccacgacagactgcactgcagaagatgcgtgaacagcagacagatcagacccccccccgacggcagcgactgcaccagcgacctggccggctggaaccactgcaccgacaagtggggcctgagagacgaggtgctgcaggccgcctgggacgccgccagcaccgccatcaccttcgtgttccaccagagaagccacgaggagcagagaggcctgagatag

SEQ ID NO: 12538 - DNA, 2244 bp, Artificial Sequence; identical to SEQ ID NO: 12537
  Description of Artificial Sequence: Synthetic coding sequence

SEQ ID NO: 12539 - DNA, 1704 bp, Artificial Sequence
  Description of Artificial Sequence: Synthetic coding sequence
atggccgacgagatgggcctgggcaagaccctgcagtgcatcaccctgatgtggaccctgctgagacagagccccgagtgcaagcccgagatcgacaaggccgtggtggtgagccccagcagcctggtgaagaactggtacaacgaggtgggcaagtggctgggcggcagaatccagcccctggccatcgacggcggcagcaaggacgagatcgaccagaagctggagggcttcatgaaccagagaggcgccagagtgagcagccccatcctgatcatcagctacgagaccttcagactgcacgtgggcgtgctgcagaagggcagcgtgggcctggtgatctgcgacgagggccacagactgaagaacagcgagaaccagacctaccaggccctggacagcctgaacaccagcagaagagtgctgatcagcggcacccccatccagaacgacctgctggagtacttcagcctggtgcacttcgtgaacagcggcatcctgggcaccgcccacgagttcaagaagcacttcgagctgcccatcctgaagggcagagacgccgccgccagcgaggccgacagacagctgggcgaggagagactgagagagctgaccagcatcgtgaacagatgcctgatcagaagaaccagcgacatcctgagcaagtacctgcccgtgaagatcgagcaggtggtgtgctgcagactgacccccctgcagaccgagctgtacaagagattcctgagacaggccaagcccgccgaggagctgctggagggcaagatgagcgtgagcagcctgagcagcatcaccagcctgaagaagctgtgcaaccaccccgccctgatctacgacaagtgcgtggaggaggaggacggcttcgtgggcgccctggacctgttcccccccggctacagcagcaaggccctggagccccagctgagcggcaagatgctggtgctggactacatcctggccgtgaccagaagcagaagcagcgacaaggtggtgctggtgagcaactacacccagaccctggacctgttcgagaagctgtgcagagccagaagatacctgtacgtgagactggacggcaccatgagcatcaagaagagagccaaggtggtggagagattcaacagccccagcagccccgacttcgtgttcatgctgagcagcaaggccggcggctgcggcctgaacctgatcggcgccaacagactggtgatgttcgaccccgactggaaccccgccaacgacgagcaggccatggccagagtgtggagagacggccagaagaagacctgctacatctacagactgctgagcgccggcaccatcgaggagaagatcttccagagacagagccacaagaaggccctgagcagctgcgtggtggacgaggagcaggacgtggagagacacttcagcctgggcgagctgaaggagctgttcatcctggacgaggccagcctgagcgacacccacgacagactgcactgcagaagatgcgtgaacagcagacagatcagacccccccccgacggcagcgactgcaccagcgacctggccggctggaaccactgcaccgacaagtggggcctgagagacgaggtgctgcaggccgcctgggacgccgccagcaccgccatcaccttcgtgttccaccagagaagccacgaggagcagagaggcctgagatag

SEQ ID NO: 12540 - DNA, 1176 bp, Artificial Sequence
  Description of Artificial Sequence: Synthetic coding sequence
atgaagtgcctggtgaccggcggcaacgtgaaggtgctgggcaaggccgtgcacagcctgagcagaatcggcgacgagctgtacctggagcccctggaggacggcctgagcctgagaaccgtgaacagcagcagaagcgcctacgcctgcttcctgttcgcccccctgttcttccagcagtaccaggccgccacccccggccaggacctgctgagatgcaagatcctgatgaagagcttcctgagcgtgttcagaagcctggccatgctggagaagaccgtggagaagtgctgcatcagcctgaacggcagaagcagcagactggtggtgcagctgcactgcaagttcggcgtgagaaagacccacaacctgagcttccaggactgcgagagcctgcaggccgtgttcgaccccgccagctgcccccacatgctgagagcccccgccagagtgctgggcgaggccgtgctgcccttcagccccgccctggccgaggtgaccctgggcatcggcagaggcagaagagtgatcctgagaagctaccacgaggaggaggccgacagcaccgccaaggccatggtgaccgagatgtgcctgggcgaggaggacttccagcagctgcaggcccaggagggcgtggccatcaccttctgcctgaaggagttcagaggcctgctgagcttcgccgagagcgccaacctgaacctgagcatccacttcgacgcccccggcagacccgccatcttcaccatcaaggacagcctgctggacggccacttcgtgctggccaccctgagcgacaccgacagccacagccaggacctgggcagccccgagagacaccagcccgtgccccagctgcaggcccacagcaccccccaccccgacgacttcgccaacgacgacatcgacagctacatgatcgccatggagaccaccatcggcaacgagggcagcagagtgctgcccagcatcagcctgagccccggcccccagccccccaagagccccggcccccacagcgaggaggaggacgaggccgagcccagcaccgtgcccggcacccccccccccaagaagttcagaagcctgttcttcggcagcatcctggcccccgtgagaagcccccagggccccagccccgtgctggccgaggacagcgagggcgagggctag

SEQ ID NO: 12541 - DNA, 1752 bp, Artificial Sequence
  Description of Artificial Sequence: Synthetic coding sequence
atgcccaagcccatcaacgtgagagtgaccaccatggacgccgagctggagttcgccatccagcccaacaccaccggcaagcagctgttcgaccaggtggtgaagaccgtgggcctgagagaggtgtggttcttcggcctgcagtacgtggacagcaagggctacagcacctggctgaagctgaacaagaaggtgacccagcaggacgtgaagaaggagaaccccctgcagttcaagttcagagccaagttcttccccgaggacgtgagcgaggagctgatccaggagatcacccagagactgttcttcctgcaggtgaaggaggccatcctgaacgacgagatctactgcccccccgagaccgccgtgctgctggccagctacgccgtgcaggccaagtacggcgactacaacaaggagatccacaagcccggctacctggccaacgacagactgctgccccagagagtgctggagcagcacaagctgaccaaggagcagtgggaggagagaatccagaactggcacgaggagcacagaggcatgctgagagaggacagcatgatggagtacctgaagatcgcccaggacctggagatgtacggcgtgaactacttcgagatcaagaacaagaagggcaccgagctgtggctgggcgtggacgccctgggcctgaacatctacgagcacgacgacaagctgacccccaagatcggcttcccctggagcgagatcagaaacatcagcttcaacgacaagaagttcgtgatcaagcccatcgacaagaaggcccccgacttcgtgttctacgcccccagactgagaatcaacaagagaatcctggccctgtgcatgggcaaccacgagctgtacatgagaagaagaaagcccgacaccatcgaggtgcagcagatgaaggcccaggccagagaggagaagcaccagaagcagctggagagagcccagctggagaacgagaagaagaagagagagatcgccgagaaggagaaggagagaatcgagagagagaaggaggagctgatggagagactgaagcagatcgaggagcagaccatcaaggcccagaaggagctggaggagcagaccagaaaggccctggagctggaccaggagagaaagagagccaaggaggaggccgagagactggagaaggagagaagagccgccgaggaggccaagagcgccatcgccaagcaggccgccgaccagatgaagaaccaggagcagctggccgccgagctggccgagttcaccgccaagatcgccctgctggaggaggccaagaagaagaaggaggaggaggccaccgagtggcagcacaaggccttcgccgcccaggaggacctggagaagaccaaggaggagctgaagaccgtgatgagcgccccccccccccccccccccccccccgtgatcccccccaccgagaacgagcacgacgagcacgacgagaacaacgccgaggccagcgccgagctgagcaacgagggcgtgatgaaccacagaagcgaggaggagagagtgaccgagacccagaagaacgagagagtgaagaagcagctgcaggccctgagcagcgagctggcccaggccagagacgagaccaagaagacccagaacgacgtgctgcacgccgagaacgtgaaggccggcagagacaagtacaagaccctgagacagatcagacagggcaacaccaagcagagaatcgacgagttcgaggccatgtag

SEQ ID NO: 12542 - DNA, 1815 bp, Artificial Sequence
  Description of Artificial Sequence: Synthetic coding sequence
atgcccaagcccatcaacgtgagagtgaccaccatggacgccgagctggagttcgccatccagcccaacaccaccggcaagcagctgttcgaccaggtggtgaagaccgtgggcctgagagaggtgtggttcttcggcctgcagtacgtggacagcaagggctacagcacctggctgaagctgaacaagaaggtgacccagcaggacgtgaagaaggagaaccccctgcagttcaagttcagagccaagttcttccccgaggacgtgagcgaggagctgatccaggagatcacccagagactgttcttcctgcaggtgaaggaggccatcctgaacgacgagatctactgcccccccgagaccgccgtgctgctggccagctacgccgtgcaggccaagtacggcgactacaacaaggagatccacaagcccggctacctggccaacgacagactgctgccccagagagtgctggagcagcacaagctgaccaaggagcagtgggaggagagaatccagaactggcacgaggagcacagaggcatgctgagagaggacagcatgatggagtacctgaagatcgcccaggacctggagatgtacggcgtgaactacttcgagatcaagaacaagaagggcaccgagctgtggctgggcgtggacgccctgggcctgaacatctacgagcacgacgacaagctgacccccaagatcggcttcccctggagcgagatcagaaacatcagcttcaacgacaagaagttcgtgatcaagcccatcgacaagaaggcccccgacttcgtgttctacgcccccagactgagaatcaacaagagaatcctggccctgtgcatgggcaaccacgagctgtacatgagaagaagaaagcccgacaccatcgaggtgcagcagatgaaggcccaggccagagaggagaagcaccagaagcagctggagagagcccagctggagaacgagaagaagaagagagagatcgccgagaaggagaaggagagaatcgagagagagaaggaggagctgatggagagactgaagcagatcgaggagcagaccatcaaggcccagaaggagctggaggagcagaccagaaaggccctggagctggaccaggagagaaagagagccaaggaggaggccgagagactggagaaggagagaagagccgccgaggaggccaagagcgccatcgccaagcaggccgccgaccagatgaagaaccaggagcagctggccgccgagctggccgagttcaccgccaagatcgccctgctggaggaggccaagaagaagaaggaggaggaggccaccgagtggcagcacaaggccttcgccgcccaggaggacctggagaagaccaaggaggagctgaagaccgtgatgagcgccccccccccccccccccccccccccgtgatcccccccaccgagaacgagcacgacgagcacgacgagaacaacgccgaggccagcgccgagctgagcaacgagggcgtgatgaaccacagaagcgaggaggagagagtgaccgagacccagaagaacgagagagtgaagaagcagctgcaggccctgagcagcgagctggcccaggccagagacgagaccaagaagacccagaacgacgtgctgcacgccgagaacgtgaaggccggcagagacaagtacaagaccctgagacagatcagacagggcaacaccaagcagagaatcgacgagttcgaggccatgtggggccccaagctgtacgccctgttccagatgagaagctgccagagcagcatcaagcagatgtag

SEQ ID NO: 12543 - DNA, 1020 bp, Artificial Sequence
  Description of Artificial Sequence: Synthetic coding sequence
ccccaccccaagatcaacgtgagagtgaccaccatggacgccgagctggagttcgccatccagcccaacaccaccggcaagcagctgttcgaccaggtggtgaagaccgtgggcctgagagaggtgtggttcttcggcctgcagtacgtggacagcaagggctacagcacctggctgaagctgaacaagaaggtgacccagcaggacgtgaagaaggagaaccccctgcagttcaagttcagagccaagttcttccccgaggacgtgagcgaggagctgatccaggagatcacccagagactgttcttcctgcaggtgaaggaggccatcctgaacgacgagatctactgcccccccgagaccgccgtgctgctggccagctacgccgtgcaggccaagtacggcgactacaacaaggagatccacaagcccggctacctggccaacgacagactgctgccccagagagtgctggagcagcacaagctgaccaaggagcagtgggaggagagaatccagaactggcacgaggagcacagaggcatgctgagagaggacagcatgatggagtacctgaagatcgcccaggacctggagatgtacggcgtgaactacttcgagatcaagaacaagaagggcaccgagctgtggctgggcgtggacgccctgggcctgaacatctacgagcacgacgacaagctgacccccaagatcggcttcccctggagcgagatcagaaacatcagcttcaacgacaagaagttcgtgatcaagcccatcgacaagaaggcccccgacttcgtgttctacgcccccagactgagaatcaacaagagaatcctggccctgtgcatgggcaaccacgagctgtacatgagaagaagaaagcccgacaccatcgaggtgcagcagatgaaggcccaggccagagaggagaagcaccagaagcagctggagagaagcagactgagcaagatcaagaagaagaagagaaagaagaagaagaagaagaagaagtag

SEQ ID NO: 12544 - DNA, 1815 bp, Artificial Sequence; identical to SEQ ID NO: 12542
  Description of Artificial Sequence: Synthetic coding sequence

SEQ ID NO: 12545 - DNA, 774 bp, Artificial Sequence
  Description of Artificial Sequence: Synthetic coding sequence
atggagagactgaagcagatcgaggagcagaccatcaaggcccagaaggagctggaggagcagaccagaaaggccctggagctggaccaggagagaaagagagccaaggaggaggccgagagactggagaaggagagaagagccgccgaggaggccaagagcgccatcgccaagcaggccgccgaccagatgaagaaccaggagcagctggccgccgagctggccgagttcaccgccaagatcgccctgctggaggaggccaagaagaagaaggaggaggaggccaccgagtggcagcacaaggccttcgccgcccaggaggacctggagaagaccaaggaggagctgaagaccgtgatgagcgccccccccccccccccccccccccccgtgatcccccccaccgagaacgagcacgacgagcacgacgagaacaacgccgaggccagcgccgagctgagcaacgagggcgtgatgaaccacagaagcgaggaggagagagtgaccgagacccagaagaacgagagagtgaagaagcagctgcaggccctgagcagcgagctggcccaggccagagacgagaccaagaagacccagaacgacgtgctgcacgccgagaacgtgaaggccggcagagacaagtacaagaccctgagacagatcagacagggcaacaccaagcagagaatcgacgagttcgaggccatgtggggccccaagctgtacgccctgttccagatgagaagctgccagagcagcatcaagcagatgtag

SEQ ID NO: 12546 - DNA, 762 bp, Artificial Sequence
  Description of Artificial Sequence: Synthetic coding sequence
ggcggcagaatcgccagagcccacgagttcgaggccgccgtgagcttctgcaccagcgcctgggccaccgagagagaccccgtgagcagaaagcagagagagctggaggagcagaccagaaaggccctggagctggaccaggagagaaagagagccaaggaggaggccgagagactggagaaggagagaagagccgccgaggaggccaagagcgccatcgccaagcaggccgccgaccagatgaagaaccaggagcagctggccgccgagctggccgagttcaccgccaagatcgccctgctggaggaggccaagaagaagaaggaggaggaggccaccgagtggcagcacaaggccttcgccgcccaggaggacctggagaagaccaaggaggagctgaagaccgtgatgagcgccccccccccccccccccccccccccgtgatcccccccaccgagaacgagcacgacgagcacgacgagaacaacgccgaggccagcgccgagctgagcaacgagggcgtgatgaaccacagaagcgaggaggagagagtgaccgagacccagaagaacgagagagtgaagaagcagctgcaggccctgagcagcgagctggcccaggccagagacgagaccaagaagacccagaacgacgtgctgcacgccgagaacgtgaaggccggcagagacaagtacaagaccctgagacagatcagacagggcaacaccaagcagagaatcgacgagttcgaggccatgtag

SEQ ID NO: 12547 - DNA, 603 bp, Artificial Sequence
  Description of Artificial Sequence: Synthetic coding sequence
atgcccaagcccatcaacgtgagagtgaccaccatggacgccgagctggagttcgccatccagcccaacaccaccggcaagcagctgttcgaccaggtgacccagcaggacgtgaagaaggagaaccccctgcagttcaagttcagagccaagttcttccccgaggacgtgagcgaggagctgatccaggagatcacccagagactgttcttcctgcaggtgaaggaggccatcctgaacgacgagatctactgcccccccgagaccgccgtgctgctggccagctacgccgtgcaggccaagtacggcgactacaacaaggagatccacaagcccggctacctggccaacgacagactgctgccccagagagtgctggagcagcacaagctgaccaaggagcaggacgagaccaagaagacccagaacgacgtgctgcacgccgagaacgtgaaggccggcagagacaagtacaagaccctgagacagatcagacagggcaacaccaagcagagaatcgacgagttcgaggccatgtggggccccaagctgtacgccctgttccagatgagaagctgccagagcagcatcaagcagatgtag

SEQ ID NO: 12548 - DNA, 1815 bp, Artificial Sequence; identical to SEQ ID NO: 12542
  Description of Artificial Sequence: Synthetic coding sequence

SEQ ID NO: 12549 - DNA, 1344 bp, Artificial Sequence
  Description of Artificial Sequence: Synthetic coding sequence
atgctgagctggaacctgcccttcagccccatccagctggccaacaacttcctgaccagcgtgctggagcagcacaagctgaccaaggagcagtgggaggagagaatccagaactggcacgaggagcacagaggcatgctgagagaggacagcatgatggagtacctgaagatcgcccaggacctggagatgtacggcgtgaactacttcgagatcaagaacaagaagggcaccgagctgtggctgggcgtggacgccctgggcctgaacatctacgagcacgacgacaagctgacccccaagatcggcttcccctggagcgagatcagaaacatcagcttcaacgacaagaagttcgtgatcaagcccatcgacaagaaggcccccgacttcgtgttctacgcccccagactgagaatcaacaagagaatcctggccctgtgcatgggcaaccacgagctgtacatgagaagaagaaagcccgacaccatcgaggtgcagcagatgaaggcccaggccagagaggagaagcaccagaagcagctggagagagcccagctggagaacgagaagaagaagagagagatcgccgagaaggagaaggagagaatcgagagagagaaggaggagctgatggagagactgaagcagatcgaggagcagaccatcaaggcccagaaggagctggaggagcagaccagaaaggccctggagctggaccaggagagaaagagagccaaggaggaggccgagagactggagaaggagagaagagccgccgaggaggccaagagcgccatcgccaagcaggccgccgaccagatgaagaaccaggagcagctggccgccgagctggccgagttcaccgccaagatcgccctgctggaggaggccaagaagaagaaggaggaggaggccaccgagtggcagcacaaggccttcgccgcccaggaggacctggagaagaccaaggaggagctgaagaccgtgatgagcgccccccccccccccccccccccccccgtgatcccccccaccgagaacgagcacgacgagcacgacgagaacaacgccgaggccagcgccgagctgagcaacgagggcgtgatgaaccacagaagcgaggaggagagagtgaccgagacccagaagaacgagagagtgaagaagcagctgcaggccctgagcagcgagctggcccaggccagagacgagaccaagaagacccagaacgacgtgctgcacgccgagaacgtgaaggccggcagagacaagtacaagaccctgagacagatcagacagggcaacaccaagcagagaatcgacgagttcgaggccatgtag

SEQ ID NO: 12550 - DNA, 3234 bp, Artificial Sequence
  Description of Artificial Sequence: Synthetic coding sequence
atggacaccgacagccagagaagccacctgagcagcttcaccatgaagctgatggacaagttccacagccccaagatcaagagaacccccagcaagaagggcaagcccgccgaggtgagcgtgaagatccccgagaagcccgtgaacaaggaggccaccgacagattcctgcccgagggctaccccctgcccctggacctggagcagcaggccgtggagttcatgagcaccagcgccgtggccagcagaagccagagacagaagaacctgagctggctggaggagaaggagaaggaggtggtgagcgccctgagatacttcaagaccatcgtggacaagatggccatcgacaagaaggtgctggagatgctgcccggcagcgccagcaaggtgctggaggccatcctgcccctggtgcagaacgaccccagaatccagcacagcagcgccctgagcagctgctacagcagagtgtaccagagcctggccaacctgatcagatggagcgaccaggtgatgctggagggcgtgaacagcgaggacaaggagatggtgaccaccgtgaagggcgtgatcaaggccgtgctggacggcgtgaaggagctggtgagactgaccatcgagaagcagggcagacccagccccaccagccccgtgaagcccagcagccccgccagcaagcccgacggccccgccgagctgcccctgaccgacagagaggtggagatcctgaacaagaccaccggcatgagccagagcaccgagctgctgcccgacgccaccgacgaggaggtggccccccccaagccccccctgcccggcatcagagtggtggacaacagccccccccccgccctgccccccaagaagagacagagcgcccccagccccaccagagtggccgtggtggcccccatgagcagagccaccagcggcagcagcctgcccgtgggcatcaacagacaggacttcgacgtggactgctacgcccagagaagactgagcggcggcagccacagctacggcggcgagagccccagactgagcccctgcagcagcatcggcaagctgagcaagagcgacgagcagctgagcagcctggacagagacagcggccagtgcagcagaaacaccagctgcgagaccctggaccactacgaccccgactacgagttcctgcagcaggacctgagcaacgccgaccagatcccccagcagaccgcctggaacctgagccccctgcccgagagcctgggcgagagcggcagccccttcctgggcccccccttccagctgcccctgggcggccacccccagcccgacggccccctggcccccggccagcagaccgacaccccccccgccctgcccgagaagaagagaagaagcgccgccagccagaccgccgacggcagcggctgcagagtgagctacgagagacaccccagccagtacgacaacatcagcggcgaggacctgcagagcaccgcccccatccccagcgtgccctacgcccccttcgccgccatcctgcccttccagcacggcggcagcagcgcccccgtggagttcgtgggcgacttcaccgcccccgagagcaccggcgaccccgagaagcccccccccctgcccgagaagaagaacaagcacatgctggcctacatgcagctgctggaggactacagcgagccccagcccagcatgttctaccagaccccccagaacgagcacatctaccagcagaagaacaagctgctgatggaggtgtacggcttcagcgacagcttcagcggcgtggacagcgtgcaggagctggcccccccccccgccctgccccccaagcagagacagctggagccccccgccggcaaggacggccaccccagagaccccagcgccgtgagcggcgtgcccggcaaggacagcagagacggcagcgagagagcccccaagagccccgacgccctggagagcgcccagagcgaggaggaggtggacgagctgagcctgatcgaccacaacgagatcatgagcagactgaccctgaagcaggagggcgacgacggccccgacgtgagaggcggcagcggcgacatcctgctggtgcacgccaccgagaccgacagaaaggacctggtgctgtactgcgaggccttcctgaccacctacagaaccttcatcagccccgaggagctgatcaagaagctgcagtacagatacgagaagttcagccccttcgccgacaccttcaagaagagagtgagcaagaacaccttcttcgtgctggtgagagtggtggacgagctgtgcctggtggagctgaccgaggagatcctgaagctgctgatggagctggtgttcagactggtgtgcaacggcgagctgagcctggccagagtgctgagaaagaacatcctggacaaggtggaccagaagaagctgctgagatgcgccaccagcagccagcccctggccgccagaggcgtggccgccagacccggcaccctgcacgacttccacagccacgagatcgccgagcagctgaccctgctggacgccgagctgttctacaagatcgagatccccgaggtgctgctgtgggccaaggagcagaacgaggagaagagccccaacctgacccagttcaccgagcacttcaacaacatgagctactgggtgagaagcatcatcatgctgcaggagaaggcccaggacagagagagactgctgctgaagttcatcaagatcatgaagcacctgagaaagctgaacaacttcaacagctacctggccatcctgagcgccctggacagcgcccccatcagaagactggagtggcagaagcagaccagcgagggcctggccgagtactgcaccctgatcgacagcagcagcagcttcagagcctacagagccgccctgagcgaggtggagcccccctgcatcccctacctgggcctgatcctgcaggacctgaccttcgtgcacctgggcaaccccgactacatcgacggcaaggtgaacttcagcaagagatggcagcagttcaacatcctggacagcatgagatgcttccagcaggcccactacgacatgagaagaaacgacgacatcatcaacttcttcaacgacttcagcgaccacctggccgaggaggccctgtgggagctgagcctgaagatcaagcccagaaacatcaccagaagaaagaccgacagagaggagaagacctag

SEQ ID NO: 12551 - DNA, 3168 bp, Artificial Sequence
  Description of Artificial Sequence: Synthetic coding sequence
atgagcaccagcgccgtggccagcagaagccagagacagaagaacctgagctggctggaggagaaggagaaggaggtggtgagcgccctgagatacttcaagaccatcgtggacaagatggccatcgacaagaaggtgctggagatgctgcccggcagcgccagcaaggtgctggaggccatcctgcccctggtgcagaacgaccccagaatccagcacagcagcgccctgagcagctgctacagcagagtgtaccagagcctggccaacctgatcagatggagcgaccaggtgatgctggagggcgtgaacagcgaggacaaggagatggtgaccaccgtgaagggcgtgatcaaggccgtgctggacggcgtgaaggagctggtgagactgaccatcgagaagcagggcagacccagccccaccagccccgtgaagcccagcagccccgccagcaagcccgacggccccgccgagctgcccctgaccgacagagaggtggagatcctgaacaagaccaccggcatgagccagagcaccgagctgctgcccgacgccaccgacgaggaggtggccccccccaagccccccctgcccggcatcagagtggtggacaacagccccccccccgccctgccccccaagaagagacagagcgcccccagccccaccagagtggccgtggtggcccccatgagcagagccaccagcggcagcagcctgcccgtgggcatcaacagacaggacttcgacgtggactgctacgcccagagaagactgagcggcggcagccacagctacggcggcgagagccccagactgagcccctgcagcagcatcggcaagctgagcaagagcgacgagcagctgagcagcctggacagagacagcggccagtgcagcagaaacaccagctgcgagaccctggaccactacgaccccgactacgagttcctgcagcaggacctgagcaacgccgaccagatcccccagcagaccgcctggaacctgagccccctgcccgagagcctgggcgagagcggcagccccttcctgggcccccccttccagctgcccctgggcggccacccccagcccgacggccccctggcccccggccagcagaccgacaccccccccgccctgcccgagaagaagagaagaagcgccgccagccagaccgccgacggcagcggctgcagagtgagctacgagagacaccccagccagtacgacaacatcagcggcgaggacctgcagagcaccgcccccatccccagcgtgccctacgcccccttcgccgccatcctgcccttccagcacggcggcagcagcgcccccgtggagttcgtgggcgacttcaccgcccccgagagcaccggcgaccccgagaagcccccccccctgcccgagaagaagaacaagcacatgctggcctacatgcagctgctggaggactacagcgagccccagcccagcatgttctaccagaccccccagaacgagcacatctaccagcagaagaacaagctgctgatggaggtgtacggcttcagcgacagcttcagcggcgtggacagcgtgcaggagctggcccccccccccgccctgccccccaagcagagacagctggccagctgcgccgccagcagcttcagcagcgtgagccactgcgtgcagcagaccaaggtggccttcacccccgaggacggcagcgccgcccagggcctgagcgtgagcgtgagcaacagcttcctgagcagacacggcagcctgcccgtgcccagcgagccccccgccggcaaggacggccaccccagagaccccagcgccgtgagcggcgtgcccggcaaggacagcagagacggcagcgagagagcccccaagagccccgacgccctggagagcgcccagagcgaggaggaggtggacgagctgagcctgatcgaccacaacgagatcatgagcagactgaccctgaagcaggagggcgacgacggccccgacgtgagaggcggcagcggcgacatcctgctggtgcacgccaccgagaccgacagaaaggacctggtgctgtactgcgaggccttcctgaccacctacagaaccttcatcagccccgaggagctgatcaagaagctgcagtacagatacgagaagttcagccccttcgccgacaccttcaagaagagagtgagcaagaacaccttcttcgtgctggtgagagtggtggacgagctgtgcctggtggagctgaccgaggagatcctgaagctgctgatggagctggtgttcagactggtgtgcaacggcgagctgagcctggccagagtgctgagaaagaacatcctggacaaggtggaccagaagaagctgctgagatgcgccaccagcagccagcccctggccgccagaggcgtggccgccagacccggcaccctgcacgacttccacagccacgagatcgccgagcagctgaccctgctggacgccgagctgttctacaagatcgagatccccgaggtgctgctgtgggccaaggagcagaacgaggagaagagccccaacctgacccagttcaccgagcacttcaacaacatgagctactgggtgagaagcatcatcatgctgcaggagaaggcccaggacagagagagactgctgctgaagttcatcaagatcatgaagcacctgagaaagctgaacaacttcaacagctacctggccatcctgagcgccctggacagcgcccccatcagaagactggagtggcagaagcagaccagcgagggcctggccgagtactgcaccctgatcgacagcagcagcagcttcagagcctacagagccgccctgagcgaggtggagcccccctgcatcccctacctgggcctgatcctgcaggacctgaccttcgtgcacctgggcaaccccgactacatcgacggcaaggtgaacttcagcaagagatggcagcagttcaacatcctggacagcatgagatgcttccagcaggcccactacgacatgagaagaaacgacgacatcatcaacttcttcaacgacttcagcgaccacctggccgaggaggccctgtgggagctgagcctgaagatcaagcccagaaacatcaccagaagaaagaccgacagagaggagaagacctag

SEQ ID NO: 12552 - DNA, 3285 bp, Artificial Sequence
  Description of Artificial Sequence: Synthetic coding sequence
atgagcggcggcctgggcctgagaagaagccccgagatgagcggcaagatcgagaaggccgacagccagagaagccacctgagcagcttcaccatgaagctgatggacaagttccacagccccaagatcaagagaacccccagcaagaagggcaagcccgccgaggtgagcgtgaagatccccgagaagcccgtgaacaaggaggccaccgacagattcctgcccgagggctaccccctgcccctggacctggagcagcaggccgtggagttcatgagcaccagcgccgtggccagcagaagccagagacagaagaacctgagctggctggaggagaaggagaaggaggtggtgagcgccctgagatacttcaagaccatcgtggacaagatggccatcgacaagaaggtgctggagatgctgcccggcagcgccagcaaggtgctggaggccatcctgcccctggtgcagaacgaccccagaatccagcacagcagcgccctgagcagctgctacagcagagtgtaccagagcctggccaacctgatcagatggagcgaccaggtgatgctggagggcgtgaacagcgaggacaaggagatggtgaccaccgtgaagggcgtgatcaaggccgtgctggacggcgtgaaggagctggtgagactgaccatcgagaagcagggcagacccagccccaccagccccgtgaagcccagcagccccgccagcaagcccgacggccccgccgagctgcccctgaccgacagagaggtggagatcctgaacaagaccaccggcatgagccagagcaccgagctgctgcccgacgccaccgacgaggaggtggccccccccaagccccccctgcccggcatcagagtggtggacaacagccccccccccgccctgccccccaagaagagacagagcgcccccagccccaccagagtggccgtggtggcccccatgagcagagccaccagcggcagcagcctgcccgtgggcatcaacagacaggacttcgacgtggactgctacgcccagagaagactgagcggcggcagccacagctacggcggcgagagccccagactgagcccctgcagcagcatcggcaagctgagcaagagcgacgagcagctgagcagcctggacagagacagcggccagtgcagcagaaacaccagctgcgagaccctggaccactacgaccccgactacgagttcctgcagcaggacctgagcaacgccgaccagatcccccagcagaccgcctggaacctgagccccctgcccgagagcctgggcgagagcggcagccccttcctgggcccccccttccagctgcccctgggcggccacccccagcccgacggccccctggcccccggccagcagaccgacaccccccccgccctgcccgagaagaagagaagaagcgccgccagccagaccgccgacggcagcggctgcagagtgagctacgagagacaccccagccagtacgacaacatcagcggcgaggacctgcagagcaccgcccccatccccagcgtgccctacgcccccttcgccgccatcctgcccttccagcacggcggcagcagcgcccccgtggagttcgtgggcgacttcaccgcccccgagagcaccggcgaccccgagaagcccccccccctgcccgagaagaagaacaagcacatgctggcctacatgcagctgctggaggactacagcgagccccagcccagcatgttctaccagaccccccagaacgagcacatctaccagcagaagaacaagctgctgatggaggtgtacggcttcagcgacagcttcagcggcgtggacagcgtgcaggagctggcccccccccccgccctgccccccaagcagagacagctggagccccccgccggcaaggacggccaccccagagaccccagcgccgtgagcggcgtgcccggcaaggacagcagagacggcagcgagagagcccccaagagccccgacgccctggagagcgcccagagcgaggaggaggtggacgagctgagcctgatcgaccacaacgagatcatgagcagactgaccctgaagcaggagggcgacgacggccccgacgtgagaggcggcagcggcgacatcctgctggtgcacgccaccgagaccgacagaaaggacctggtgctgtactgcgaggccttcctgaccacctacagaaccttcatcagccccgaggagctgatcaagaagctgcagtacagatacgagaagttcagccccttcgccgacaccttcaagaagagagtgagcaagaacaccttcttcgtgctggtgagagtggtggacgagctgtgcctggtggagctgaccgaggagatcctgaagctgctgatggagctggtgttcagactggtgtgcaacggcgagctgagcctggccagagtgctgagaaagaacatcctggacaaggtggaccagaagaagctgctgagatgcgccaccagcagccagcccctggccgccagaggcgtggccgccagacccggcaccctgcacgacttccacagccacgagatcgccgagcagctgaccctgctggacgccgagctgttctacaagatcgagatccccgaggtgctgctgtgggccaaggagcagaacgaggagaagagccccaacctgacccagttcaccgagcacttcaacaacatgagctactgggtgagaagcatcatcatgctgcaggagaaggcccaggacagagagagactgctgctgaagttcatcaagatcatgaagcacctgagaaagctgaacaacttcaacagctacctggccatcctgagcgccctggacagcgcccccatcagaagactggagtggcagaagcagaccagcgagggcctggccgagtactgcaccctgatcgacagcagcagcagcttcagagcctacagagccgccctgagcgaggtggagcccccctgcatcccctacctgggcctgatcctgcaggacctgaccttcgtgcacctgggcaaccccgactacatcgacggcaaggtgaacttcagcaagagatggcagcagttcaacatcctggacagcatgagatgcttccagcaggcccactacgacatgagaagaaacgacgacatcatcaacttcttcaacgacttcagcgaccacctggccgaggaggccctgtgggagctgagcctgaagatcaagcccagaaacatcaccagaagaaagaccgacagagaggagaagacctag

SEQ ID NO: 12553 - DNA, 3234 bp, Artificial Sequence; identical to SEQ ID NO: 12550
  Description of Artificial Sequence: Synthetic coding sequence

SEQ ID NO: 12554 - DNA, 3288 bp, Artificial Sequence
  Description of Artificial Sequence: Synthetic coding sequence
atgggcaacgccatcgagaagcagaagcccctgaagagaagccacctgtacccctggaagcaggacagccagagaagccacctgagcagcttcaccatgaagctgatggacaagttccacagccccaagatcaagagaacccccagcaagaagggcaagcccgccgaggtgagcgtgaagatccccgagaagcccgtgaacaaggaggccaccgacagattcctgcccgagggctaccccctgcccctggacctggagcagcaggccgtggagttcatgagcaccagcgccgtggccagcagaagccagagacagaagaacctgagctggctggaggagaaggagaaggaggtggtgagcgccctgagatacttcaagaccatcgtggacaagatggccatcgacaagaaggtgctggagatgctgcccggcagcgccagcaaggtgctggaggccatcctgcccctggtgcagaacgaccccagaatccagcacagcagcgccctgagcagctgctacagcagagtgtaccagagcctggccaacctgatcagatggagcgaccaggtgatgctggagggcgtgaacagcgaggacaaggagatggtgaccaccgtgaagggcgtgatcaaggccgtgctggacggcgtgaaggagctggtgagactgaccatcgagaagcagggcagacccagccccaccagccccgtgaagcccagcagccccgccagcaagcccgacggccccgccgagctgcccctgaccgacagagaggtggagatcctgaacaagaccaccggcatgagccagagcaccgagctgctgcccgacgccaccgacgaggaggtggccccccccaagccccccctgcccggcatcagagtggtggacaacagccccccccccgccctgccccccaagaagagacagagcgcccccagccccaccagagtggccgtggtggcccccatgagcagagccaccagcggcagcagcctgcccgtgggcatcaacagacaggacttcgacgtggactgctacgcccagagaagactgagcggcggcagccacagctacggcggcgagagccccagactgagcccctgcagcagcatcggcaagctgagcaagagcgacgagcagctgagcagcctggacagagacagcggccagtgcagcagaaacaccagctgcgagaccctggaccactacgaccccgactacgagttcctgcagcaggacctgagcaacgccgaccagatcccccagcagaccgcctggaacctgagccccctgcccgagagcctgggcgagagcggcagccccttcctgggcccccccttccagctgcccctgggcggccacccccagcccgacggccccctggcccccggccagcagaccgacaccccccccgccctgcccgagaagaagagaagaagcgccgccagccagaccgccgacggcagcggctgcagagtgagctacgagagacaccccagccagtacgacaacatcagcggcgaggacctgcagagcaccgcccccatccccagcgtgccctacgcccccttcgccgccatcctgcccttccagcacggcggcagcagcgcccccgtggagttcgtgggcgacttcaccgcccccgagagcaccggcgaccccgagaagcccccccccctgcccgagaagaagaacaagcacatgctggcctacatgcagctgctggaggactacagcgagccccagcccagcatgttctaccagaccccccagaacgagcacatctaccagcagaagaacaagctgctgatggaggtgtacggcttcagcgacagcttcagcggcgtggacagcgtgcaggagctggcccccccccccgccctgccccccaagcagagacagctggagccccccgccggcaaggacggccaccccagagaccccagcgccgtgagcggcgtgcccggcaaggacagcagagacggcagcgagagagcccccaagagccccgacgccctggagagcgcccagagcgaggaggaggtggacgagctgagcctgatcgaccacaacgagatcatgagcagactgaccctgaagcaggagggcgacgacggccccgacgtgagaggcggcagcggcgacatcctgctggtgcacgccaccgagaccgacagaaaggacctggtgctgtactgcgaggccttcctgaccacctacagaaccttcatcagccccgaggagctgatcaagaagctgcagtacagatacgagaagttcagccccttcgccgacaccttcaagaagagagtgagcaagaacaccttcttcgtgctggtgagagtggtggacgagctgtgcctggtggagctgaccgaggagatcctgaagctgctgatggagctggtgttcagactggtgtgcaacggcgagctgagcctggccagagtgctgagaaagaacatcctggacaaggtggaccagaagaagctgctgagatgcgccaccagcagccagcccctggccgccagaggcgtggccgccagacccggcaccctgcacgacttccacagccacgagatcgccgagcagctgaccctgctggacgccgagctgttctacaagatcgagatccccgaggtgctgctgtgggccaaggagcagaacgaggagaagagccccaacctgacccagttcaccgagcacttcaacaacatgagctactgggtgagaagcatcatcatgctgcaggagaaggcccaggacagagagagactgctgctgaagttcatcaagatcatgaagcacctgagaaagctgaacaacttcaacagctacctggccatcctgagcgccctggacagcgcccccatcagaagactggagtggcagaagcagaccagcgagggcctggccgagtactgcaccctgatcgacagcagcagcagcttcagagcctacagagccgccctgagcgaggtggagcccccctgcatcccctacctgggcctgatcctgcaggacctgaccttcgtgcacctgggcaaccccgactacatcgacggcaaggtgaacttcagcaagagatggcagcagttcaacatcctggacagcatgagatgcttccagcaggcccactacgacatgagaagaaacgacgacatcatcaacttcttcaacgacttcagcgaccacctggccgaggaggccctgtgggagctgagcctgaagatcaagcccagaaacatcaccagaagaaagaccgacagagaggagaagacctag

SEQ ID NO: 12555 - DNA, 1395 bp, Artificial Sequence
  Description of Artificial Sequence: Synthetic coding sequence
atgagcagagccaccagcggcagcagcctgcccgtgggcatcaacagacaggacttcgacgtggactgctacgcccagagaagactgagcggcggcagccacagctacggcggcgagagccccagactgagcccctgcagcagcatcggcaagctgagcaagagcgacgagcagctgagcagcctggacagagacagcggccagtgcagcagaaacaccagctgcgagaccctggaccactacgaccccgactacgagttcctgcagcaggacctgagcaacgccgaccagatcccccagcagaccgcctggaacctgagccccctgcccgagagcctgggcgagagcggcagccccttcctgggcccccccttccagctgcccctgggcggccacccccagcccgacggccccctggcccccggccagcagaccgacaccccccccgccctgcccgagaagaagagaagaagcgccgccagccagaccgccgacggcagcggctgcagagtgagctacgagagacaccccagccagtacgacaacatcagcggcgaggacctgcagagcaccgcccccatccccagcgtgccctacgcccccttcgccgccatcctgcccttccagcacggcggcagcagcgcccccgtggagttcgtgggcgacttcaccgcccccgagagcaccggcgaccccgagaagcccccccccctgcccgagaagaagaacaagcacatgctggcctacatgcagctgctggaggactacagcgagccccagcccagcatgttctaccagaccccccagaacgagcacatctaccagcagaagaacaagctgctgatggaggtgtacggcttcagcgacagcttcagcggcgtggacagcgtgcaggagctggcccccccccccgccctgccccccaagcagagacagctgcaggccagctgcgccgccagcagcttcagcagcgtgagccactgcgtgcagcagaccaaggtggccttcacccccgaggacggcagcgccgcccagggcctgagcgtgagcgtgagcaacagcttcctgagcagacacggcagcctgcccgtgcccagctacaagagcgtgttcagaagctacagccaggacttcgtgccccaccaccaggccagcgtgccccccttcctgccccccaccagcagcagcagcccccacttcccccccgcccaccagagccagagcagcgacctggccgtgcccaccatggccggccccccccccagcaccgtggacggccccctgagcgccagccaggagagcagcttccacggcaacaccgtgtgcctgcccagcgagaccagcttcaccgacagcgagccccccgccggcaaggacggccaccccagagactag

SEQ ID NO: 12556 - DNA, 3285 bp, Artificial Sequence; identical to SEQ ID NO: 12552
  Description of Artificial Sequence: Synthetic coding sequence

SEQ ID NO: 12557 - DNA, 1011 bp, Artificial Sequence
  Description of Artificial Sequence: Synthetic coding sequence
atggaggtgtacggcttcagcgacagcttcagcggcgtggacagcgtgcaggagctggcccccccccccgccctgccccccaagcagagacagctgagcgagaacgccagcgaggaggccggcgagggcgagtacgtgaacctgtacagcagcggccagagcagcgaggagctggcccccagcagaggcgagccccccgccggcaaggacggccaccccagagaccccagcgccgtgagcggcgtgcccggcaaggacagcagagacggcagcgagagagcccccaagagccccgacgccctggagagcgcccagagcgaggaggaggtggacgagctgagcctgatcgaccacaacgagatcatgagcagactgaccctgaagcaggagggcgacgacggccccgacgtgagaggcggcagcggcgacatcctgctggtgcacgccaccgagaccgacagaaaggacctggtgctgtactgcgaggccttcctgaccacctacagaaccttcatcagccccgaggagctgatcaagaagctgcagtacagatacgagaagttcagccccttcgccgacaccttcaagaagagagtgagcaagaacaccttcttcgtgctggtgagagtggtggacgagctgtgcctggtggagctgaccgaggagatcctgaagctgctgatggagctggtgttcagactggtgtgcaacggcgagctgagcctggccagagtgctgagaaagaacatcctggacaaggtggaccagaagaagctgctgagatgcgccaccagcagccagcccctggccgccagaggcgtggccgccagacccggcaccctgcacgacttccacagccacgagatcgccgagcagctgaccctgctggacgccgagctgttctacaagatcgagatccccgaggtgctgctgtgggccaaggagcagaacgaggagaagagccccaacctgacccagttcaccgagcacttcaacaacatgagctactag

SEQ ID NO: 12558 - DNA, 3174 bp, Artificial Sequence
  Description of Artificial Sequence: Synthetic coding sequence
atgggcaacgccatcgagaagcagaagcccctgaagagaagccacctgtacccctggaagcaggacagccagagaagccacctgagcagcttcaccatgaagctgatggacaagttccacagccccaagatcaagagaacccccagcaagaagggcaagcccgccgaggtgagcgtgaagatccccgagaagcccgtgaacaagaacctgagctggctggaggagaaggagaaggaggtggtgagcgccctgagatacttcaagaccatcgtggacaagatggccatcgacaagaaggtgctggagatgctgcccggcagcgccagcaaggtgctggaggccatcctgcccctggtgcagaacgaccccagaatccagcacagcagcgccctgagcagctgctacagcagagtgtaccagagcctggccaacctgatcagatggagcgaccaggtgatgctggagggcgtgaacagcgaggacaaggagatggtgaccaccgtgaagggcgtgatcaaggccgtgctggacggcgtgaaggagctggtgagactgaccatcgagaagcagggcagacccagccccaccagccccgtgaagcccagcagccccgccagcaagcccgacggccccgccgagctgcccctgaccgacagagaggtggagatcctgaacaagaccaccggcatgagccagagcaccgagctgctgcccgacgccaccgacgaggaggtggccccccccaagccccccctgcccggcatcagagtggtggacaacagccccccccccgccctgccccccaagaagagacagagcgcccccagccccaccagagtggccgtggtggcccccatgagcagagccaccagcggcagcagcctgcccgtgggcatcaacagacaggacttcgacgtggactgctacgcccagagaagactgagcggcggcagccacagctacggcggcgagagccccagactgagcccctgcagcagcatcggcaagctgagcaagagcgacgagcagctgagcagcctggacagagacagcggccagtgcagcagaaacaccagctgcgagaccctggaccactacgaccccgactacgagttcctgcagcaggacctgagcaacgccgaccagatcccccagcagaccgcctggaacctgagccccctgcccgagagcctgggcgagagcggcagccccttcctgggcccccccttccagctgcccctgggcggccacccccagcccgacggccccctggcccccggccagcagaccgacaccccccccgccctgcccgagaagaagagaagaagcgccgccagccagaccgccgacggcagcggctgcagagtgagctacgagagacaccccagccagtacgacaacatcagcggcgaggacctgcagagcaccgcccccatccccagcgtgccctacgcccccttcgccgccatcctgcccttccagcacggcggcagcagcgcccccgtggagttcgtgggcgacttcaccgcccccgagagcaccggcgaccccgagaagcccccccccctgcccgagaagaagaacaagcacatgctggcctacatgcagctgctggaggactacagcgagccccagcccagcatgttctaccagaccccccagaacgagcacatctaccagcagaagaacaagctgctgatggaggtgtacggcttcagcgacagcttcagcggcgtggacagcgtgcaggagctggcccccccccccgccctgccccccaagcagagacagctggagccccccgccggcaaggacggccaccccagagaccccagcgccgtgagcggcgtgcccggcaaggacagcagagacggcagcgagagagcccccaagagccccgacgccctggagagcgcccagagcgaggaggaggtggacgagctgagcctgatcgaccacaacgagatcatgagcagactgaccctgaagcaggagggcgacgacggccccgacgtgagaggcggcagcggcgacatcctgctggtgcacgccaccgagaccgacagaaaggacctggtgctgtactgcgaggccttcctgaccacctacagaaccttcatcagccccgaggagctgatcaagaagctgcagtacagatacgagaagttcagccccttcgccgacaccttcaagaagagagtgagcaagaacaccttcttcgtgctggtgagagtggtggacgagctgtgcctggtggagctgaccgaggagatcctgaagctgctgatggagctggtgttcagactggtgtgcaacggcgagctgagcctggccagagtgctgagaaagaacatcctggacaaggtggaccagaagaagctgctgagatgcgccaccagcagccagcccctggccgccagaggcgtggccgccagacccggcaccctgcacgacttccacagccacgagatcgccgagcagctgaccctgctggacgccgagctgttctacaagatcgagatccccgaggtgctgctgtgggccaaggagcagaacgaggagaagagccccaacctgacccagttcaccgagcacttcaacaacatgagctactgggtgagaagcatcatcatgctgcaggagaaggcccaggacagagagagactgctgctgaagttcatcaagatcatgaagcacctgagaaagctgaacaacttcaacagctacctggccatcctgagcgccctggacagcgcccccatcagaagactggagtggcagaagcagaccagcgagggcctggccgagtactgcaccctgatcgacagcagcagcagcttcagagcctacagagccgccctgagcgaggtggagcccccctgcatcccctacctgggcctgatcctgcaggacctgaccttcgtgcacctgggcaaccccgactacatcgacggcaaggtgaacttcagcaagagatggcagcagttcaacatcctggacagcatgagatgcttccagcaggcccactacgacatgagaagaaacgacgacatcatcaacttcttcaacgacttcagcgaccacctggccgaggaggccctgtgggagctgagcctgaagatcaagcccagaaacatcaccagaagaaagaccgacagagaggagaagacctag

SEQ ID NO: 12559 - DNA, 960 bp, Artificial Sequence
  Description of Artificial Sequence: Synthetic coding sequence
tgactggcccccccccccgccctgccccccaagcagagacagctgagcgagaacgccagcgaggaggccggcgagggcgagtacgtgaacctgtacagcagcggccagagcagcgaggagctggcccccagcagaggcgagccccccgccggcaaggacggccaccccagagaccccagcgccgtgagcggcgtgcccggcaaggacagcagagacggcagcgagagagcccccaagagccccgacgccctggagagcgcccagagcgaggaggaggtggacgagctgagcctgatcgaccacaacgagatcatgagcagactgaccctgaagcaggagggcgacgacggccccgacgtgagaggcggcagcggcgacatcctgctggtgcacgccaccgagaccgacagaaaggacctggtgctgtactgcgaggccttcctgaccacctacagaaccttcatcagccccgaggagctgatcaagaagctgcagtacagatacgagaagttcagccccttcgccgacaccttcaagaagagagtgagcaagaacaccttcttcgtgctggtgagagtggtggacgagctgtgcctggtggagctgaccgaggagatcctgaagctgctgatggagctggtgttcagactggtgtgcaacggcgagctgagcctggccagagtgctgagaaagaacatcctggacaaggtggaccagaagaagctgctgagatgcgccaccagcagccagcccctggccgccagaggcgtggccgccagacccggcaccctgcacgacttccacagccacgagatcgccgagcagctgaccctgctggacgccgagctgttctacaagatcgagatccccgaggtgctgctgtgggccaaggagcagaacgaggagaagagccccaacctgacccagttcaccgagcacttcaacaacatgagctactag

SEQ ID NO: 12560 - DNA, 687 bp, Artificial Sequence
  Description of Artificial Sequence: Synthetic coding sequence
tgactgcccgagaagaagaacaagcacatgctggcctacatgcagctgctggaggactacagcgagccccagcccagcatgttctaccagaccccccagaacgagcacatctaccagcagaagaacaagctgctgatggaggtgtacggcttcagcgacagcttcagcggcgtggacagcgtgcaggagctggcccccccccccgccctgccccccaagcagagacagctgcaggccagctgcgccgccagcagcttcagcagcgtgagccactgcgtgcagcagaccaaggtggccttcacccccgaggacggcagcgccgcccagggcctgagcgtgagcgtgagcaacagcttcctgagcagacacggcagcctgcccgtgcccagctacaagagcgtgttcagaagctacagccaggacttcgtgccccaccaccaggccagcgtgccccccttcctgccccccaccagcagcagcagcccccacttcccccccgcccaccagagccagagcagcgacctggccgtgcccaccatggccggccccccccccagcaccgtggacggccccctgagcgccagccaggagagcagcttccacggcaacaccgtgtgcctgcccagcgagaccagcttcaccgacagcgagccccccgccggcaaggacggccaccccagagactag

SEQ ID NO: 12561 - DNA, 582 bp, Artificial Sequence
  Description of Artificial Sequence: Synthetic coding sequence
atgggcaacgccatcgagaagcagaagcccctgaagagaagccacctgtacccctggaagcaggacagccagagaagccacctgagcagcttcaccatgaagctgatggacaagttccacagccccaagatcaagagaacccccagcaagaagggcaagcccgccgaggtgagcgtgaagatccccgagaagcccgtgaacaaggaggccaccgacagattcctgcccgagggctaccccctgcccctggacctggagcagcaggccgtggagttcatgagcaccagcgccgtggccagcagaagccagagacagaagaacctgagctggctggaggagaaggagaaggaggtggtgagcgccctgagatacttcaagaccatcgtggacaagatggccatcgacaagaaggtgctggagatgctgcccggcagcgccagcaaggtgctggaggccatcctgcccctggtgcagaacgaccccagaatccagcacagcagcgccctgagcagctgctacagcagagtgtaccagagcctggccaacctgatcagatggagcgaccaggtgatgctggagtag

SEQ ID NO: 12562 - DNA, 3072 bp, Artificial Sequence
  Description of Artificial Sequence: Synthetic coding sequence
ttcaagaccatcgtggacaagatggccatcgacaagaaggtgctggagatgctgcccggcagcgccagcaaggtgctggaggccatcctgcccctggtgcagaacgaccccagaatccagcacagcagcgccctgagcagctgctacagcagagtgtaccagagcctggccaacctgatcagatggagcgaccaggtgatgctggagggcgtgaacagcgaggacaaggagatggtgaccaccgtgaagggcgtgatcaaggccgtgctggacggcgtgaaggagctggtgagactgaccatcgagaagcagggcagacccagccccaccagccccgtgaagcccagcagccccgccagcaagcccgacggccccgccgagctgcccctgaccgacagagaggtggagatcctgaacaagaccaccggcatgagccagagcaccgagctgctgcccgacgccaccgacgaggaggtggccccccccaagccccccctgcccggcatcagagtggtggacaacagccccccccccgccctgccccccaagaagagacagagcgcccccagccccaccagagtggccgtggtggcccccatgagcagagccaccagcggcagcagcctgcccgtgggcatcaacagacaggacttcgacgtggactgctacgcccagagaagactgagcggcggcagccacagctacggcggcgagagccccagactgagcccctgcagcagcatcggcaagctgagcaagagcgacgagcagctgagcagcctggacagagacagcggccagtgcagcagaaacaccagctgcgagaccctggaccactacgaccccgactacgagttcctgcagcaggacctgagcaacgccgaccagatcccccagcagaccgcctggaacctgagccccctgcccgagagcctgggcgagagcggcagccccttcctgggcccccccttccagctgcccctgggcggccacccccagcccgacggccccctggcccccggccagcagaccgacaccccccccgccctgcccgagaagaagagaagaagcgccgccagccagaccgccgacggcagcggctgcagagtgagctacgagagacaccccagccagtacgacaacatcagcggcgaggacctgcagagcaccgcccccatccccagcgtgccctacgcccccttcgccgccatcctgcccttccagcacggcggcagcagcgcccccgtggagttcgtgggcgacttcaccgcccccgagagcaccggcgaccccgagaagcccccccccctgcccgagaagaagaacaagcacatgctggcctacatgcagctgctggaggactacagcgagccccagcccagcatgttctaccagaccccccagaacgagcacatctaccagcagaagaacaagctgctgatggaggtgtacggcttcagcgacagcttcagcggcgtggacagcgtgcaggagctggcccccccccccgccctgccccccaagcagagacagctggccagctgcgccgccagcagcttcagcagcgtgagccactgcgtgcagcagaccaaggtggccttcacccccgaggacggcagcgccgcccagggcctgagcgtgagcgtgagcaacagcttcctgagcagacacggcagcctgcccgtgcccagcgagccccccgccggcaaggacggccaccccagagaccccagcgccgtgagcggcgtgcccggcaaggacagcagagacggcagcgagagagcccccaagagccccgacgccctggagagcgcccagagcgaggaggaggtggacgagctgagcctgatcgaccacaacgagatcatgagcagactgaccctgaagcaggagggcgacgacggccccgacgtgagaggcggcagcggcgacatcctgctggtgcacgccaccgagaccgacagaaaggacctggtgctgtactgcgaggccttcctgaccacctacagaaccttcatcagccccgaggagctgatcaagaagctgcagtacagatacgagaagttcagccccttcgccgacaccttcaagaagagagtgagcaagaacaccttcttcgtgctggtgagagtggtggacgagctgtgcctggtggagctgaccgaggagatcctgaagctgctgatggagctggtgttcagactggtgtgcaacggcgagctgagcctggccagagtgctgagaaagaacatcctggacaaggtggaccagaagaagctgctgagatgcgccaccagcagccagcccctggccgccagaggcgtggccgccagacccggcaccctgcacgacttccacagccacgagatcgccgagcagctgaccctgctggacgccgagctgttctacaagatcgagatccccgaggtgctgctgtgggccaaggagcagaacgaggagaagagccccaacctgacccagttcaccgagcacttcaacaacatgagctactgggtgagaagcatcatcatgctgcaggagaaggcccaggacagagagagactgctgctgaagttcatcaagatcatgaagcacctgagaaagctgaacaacttcaacagctacctggccatcctgagcgccctggacagcgcccccatcagaagactggagtggcagaagcagaccagcgagggcctggccgagtactgcaccctgatcgacagcagcagcagcttcagagcctacagagccgccctgagcgaggtggagcccccctgcatcccctacctgggcctgatcctgcaggacctgaccttcgtgcacctgggcaaccccgactacatcgacggcaaggtgaacttcagcaagagatggcagcagttcaacatcctggacagcatgagatgcttccagcaggcccactacgacatgagaagaaacgacgacatcatcaacttcttcaacgacttcagcgaccacctggccgaggaggccctgtgggagctgagcctgaagatcaagcccagaaacatcaccagaagaaagaccgacagagaggagaagacctag

SEQ ID NO: 12563 - DNA, 480 bp, Artificial Sequence
  Description of Artificial Sequence: Synthetic coding sequence
atggaggtgtacggcttcagcgacagcttcagcggcgtggacagcgtgcaggagctggcccccccccccgccctgccccccaagcagagacagctgtacaagagcgtgttcagaagctacagccaggacttcgtgccccaccaccaggccagcgtgccccccttcctgccccccaccagcagcagcagcccccacttcccccccgcccaccagagccagagcagcgacctggccgtgcccaccatggccggccccccccccagcaccgtggacggccccctgagcgccagccaggagagcagcttccacggcaacaccgtgtgcctgcccagcgagaccagcttcaccgacagcgagccccccgccggcaaggacggccaccccagagaccccagcgccgtgagcggcgtgcccggcaaggacagcagagacggcagcgagagagcccccaagagccccgacgccctggagagcgcctag

SEQ ID NO: 12564 - DNA, 696 bp, Artificial Sequence
  Description of Artificial Sequence: Synthetic coding sequence
atggaggtgtacggcttcagcgacagcttcagcggcgtggacagcgtgcaggagctggcccccccccccgccctgccccccaagcagagacagctgcaggccagctgcgccgccagcagcttcagcagcgtgagccactgcgtgcagcagaccaaggtggccttcacccccgaggacggcagcgccgcccagggcctgagcgtgagcgtgagcaacagcttcctgagcagacacggcagcctgcccgtgcccagctacaagagcgtgttcagaagctacagccaggacttcgtgccccaccaccaggccagcgtgccccccttcctgccccccaccagcagcagcagcccccacttcccccccgcccaccagagccagagcagcgacctggccgtgcccaccatggccggccccccccccagcaccgtggacggccccctgagcgccagccaggagagcagcttccacggcaacaccgtgtgcctgcccagcgagaccagcttcaccgacagcagcgagaacgccagcgaggaggccggcgagggcgagtacgtgaacctgtacagcagcggccagagcagcgaggagctggcccccagcagaggcgagccccccgccggcaaggacggccaccccagagaccccagcgccgtgagcggcgtgcccggcaaggacagcagagacggcagcgagtag

SEQ ID NO: 12565 - DNA, 477 bp, Artificial Sequence
  Description of Artificial Sequence: Synthetic coding sequence
atgagcggcggcctgggcctgagaagaagccccgagatgagcggcaagatcgagaaggccgacagccagagaagccacctgagcagcttcaccatgaagctgatggacaagttccacagccccaagatcaagagaacccccagcaagaagggcaagcccgccgaggtgagcgtgaagatccccgagaagcccgtgaacaagaacctgagctggctggaggagaaggagaaggaggtggtgagcgccctgagatacttcaagaccatcgtggacaagatggccatcgacaagaaggtgctggagatgctgcccggcagcgccagcaaggtgctggaggccatcctgcccctggtgcagaacgaccccagaatccagcacagcagcgccctgagcagctgctacagcagagtgtaccagagcctggccaacctgatcagatggagcgaccaggtgatgctggagggcgtgaacagctag

SEQ ID NO: 12566 - DNA, 261 bp, Artificial Sequence
  Description of Artificial Sequence: Synthetic coding sequence
atggaggtgtacggcttcagcgacagcttcagcggcgtggacagcgtgcaggagctggcccccccccccgccctgccccccaagcagagacagctggagccccccgccggcaaggacggccaccccagagaccccagcgccgtgagcggcgtgcccggcaaggacagcagagacggcagcgagagcggcatcaccagcgtgtacagatggaacatccagagacagcagagactgagctacggccacaccgccagccagtag

SEQ ID NO: 12567 - DNA, 7419 bp, Artificial Sequence
  Description of Artificial Sequence: Synthetic coding sequence
atgaccgccagaggccagagccccctggcccccctgctggagaccctggaggaccccagcgccagccacggcggccagaccgacgcctacctgaccctgaccagcagaatgaccggcgaggagggcaaggaggtgatcaccgagatcgagaagaagctgcccagactgtacaaggtgctgaagacccacatcagcagccagaacagcgagctgagcagcgccgccctgcaggccctgggcttctgcctgtacaaccccaagatcaccagcgagctgagcgaggccaacgccctggagctgctgagcaagctgaacgacaccatcaagaacagcgacaagaacgtgagaaccagagccctgtgggtgatcagcaagcagaccttccccagcgaggtggtgggcaagatggtgagcagcatcatcgacagcctggagatcctgttcaacaagggcgagacccacagcgccgtggtggacttcgaggccctgaacgtgatcgtgagactgatcgagcaggcccccatccagatgggcgaggaggccgtgagatgggccaagctggtgatccccctggtggtgcacagcgcccagaaggtgcacctgagaggcgccaccgccctggagatgggcatgcccctgctgctgcagaagcagcaggagatcgccagcatcaccgagcagctgatgaccaccaagctgatcagcgagctgcagaagctgttcatgagcaagaacgagacctacgtgctgaagctgtggcccctgttcgtgaagctgctgggcagaaccctgcacagaagcggcagcttcatcaacagcctgctgcagctggaggagctgggcttcagaagcggcgcccccatgatcaagaagatcgccttcatcgcctggaagagcctgatcgacaacttcgccctgaaccccgacatcctgtgcagcgccaagagactgaagctgctgatgcagcccctgagcagcatccacgtgagaaccgagaccctggccctgaccaagctggaggtgtggtggtacctgctgatgagactgggcccccacctgcccgccaacttcgagcaggtgtgcgtgcccctgatccagagcaccatcagcatcgacagcaacgccagcccccagggcaacagctgccacgtggccaccagccccggcctgaaccccatgacccccgtgcacaagggcgccagcagcccctacggcgcccccggcacccccagaatgaacctgagcagcaacctgggcggcatggccaccatccccagcatccagctgctgggcctggagatgctgctgcacttcctgctgggccccgaggccctgagcttcgccaagcagaacaagctggtgctgagcctggagcccctggagcaccccctgatcagcagccccagcttcttcagcaagcacgccaacaccctgatcaccgccgtgcacgacagcttcgtggccgtgggcaaggacgcccccgacgtggtggtgagcgccatctggaaggagctgatcagcctggtgaagagcgtgaccgagagcggcaacaagaaggagaagcccggcagcgaggtgctgaccctgctgctgaagagcctggagagcatcgtgaagagcgaggtgttccccgtgagcaagaccctggtgctgatggagatcaccatcaagggcctgccccagaaggtgctgggcagccccgcctaccaggtggccaacatggacatcctgaacggcacccccgccctgttcctgatccagctgatcttcaacaacttcctggagtgcggcgtgagcgacgagagattcttcctgagcctggagagcctggtgggctgcgtgctgagcggccccaccagccccctggccttcagcgacagcgtgctgaacgtgatcaaccagaacgccaagcagctggagaacaaggagcacctgtggaagatgtggagcgtgatcgtgacccccctgaccgagctgatcaaccagaccaacgaggtgaaccagggcgacgccctggagcacaacttcagcgccatctacggcgccctgaccctgcccgtgaaccacatcttcagcgagcagagattccccgtggccaccatgaagaccctgctgagaacctggagcgagctgtacagagccttcgccagatgcgccgccctggtggccaccgccgaggagaacctgtgctgcgaggagctgagcagcaagatcatgagcagcctggaggacgagggcttcagcaacctgctgttcgtggacagaatcatctacatcatcaccgtgatggtggactgcatcgacttcagcccctacaacatcaagtaccagcccaaggtgaagagcccccagagacccagcgactggagcaagaagaagaacgagcccctgggcaagctgaccagcctgttcaagctgatcgtgaaggtgatctacagcttccacaccctgagcttcaaggaggcccacagcgacaccctgttcaccatcggcaacagcatcaccggcatcatcagcagcgtgctgggccacatcagcctgcccagcatgatcagaaagatcttcgccaccctgaccagacccctggccctgttctacgagaacagcaagctggacgaggtgcccaaggtgtacagctgcctgaacaacaagctggagaagctgctgggcgagatcatcgcctgcctgcagttcagctacaccggcacctacgacagcgagctgctggagcagctgagccccctgctgtgcatcatcttcctgcacaagaacaagcagatcagaaagcagagcgcccagttctggaacgccaccttcgccaaggtgatgatgctggtgtaccccgaggagctgaagcccgtgctgacccaggccaagcagaagttcctgctgctgctgcccggcctggagaccgtggagatgatggaggagagcagcggcccctacagcgacggcaccgagaacagccagctgaacgtgaagatcagcggcatggagagaaagagcaacggcaagagagacagcttcctggcccagaccaagaacaagaaggagaacatgaagcccgccgccaagctgaagctggagagcagcagcctgaaggtgaagggcgagatcctgctggaggaggagaagagcaccgacttcgtgttcatcccccccgagggcaaggacgccaaggagagaatcctgaccgaccaccagaaggaggtgctgaagaccaagagatgcgacatccccgccatgtacaacaacctggacgtgagccaggacaccctgttcacccagtacagccaggaggagcccatggagatccccaccctgaccagaaagcccaaggaggacagcaagatgatgatcaccgaggagcagatggacagcgacatcgtgatcccccaggacgtgaccgaggactgcggcatggccgagcacctggagaagagcagcctgagcaacaacgagtgcggcagcctggacaagaccagccccgagatgagcaacagcaacaacgacgagagaaagaaggccctgatcagcagcagaaagaccagcaccgagtgcgccagcagcaccgagaacagcttcgtggtgagcagcagcagcgtgagcaacaccaccgtggccggcacccccccctaccccaccagcagaagacagaccttcatcaccctggagaagttcgacggcagcgagaacagacccttcagccccagccccctgaacaacatcagcagcaccgtgaccgtgaagaacaaccaggagaccatgatcaagaccgacttcctgcccaaggccaagcagagagagggcaccttcagcaagagcgacagcgagaagatcgtgaacggcaccaagagaagcagcagaagagccggcaaggccgagcagaccggcaacaagagaagcaagcccctgatgagaagcgagcccgagaagaacaccgaggagagcgtggagggcatcgtggtgctggagaacaacccccccggcctgctgaaccagaccgagtgcgtgagcgacaaccaggtgcacctgagcgagagcaccatggagcacgacaacaccaagctgaaggccgccaccgtggagaacgccgtgctgctggagaccaacaccgtggaggagaagaacgtggagatcaacctggagagcaaggagaacaccccccccgtggtgatcagcgccgaccagatggtgaacgaggacagccaggtgcagatcacccccaaccagaagaccctgagaagaagcagcagaagaagaagcgaggtggtggagagcaccaccgagagccaggacaaggagaacagccaccagaagaaggagagaagaaaggaggaggagaagcccctgcagaagagccccctgcacatcaaggacgacgtgctgcccaagcagaagctgatcgccgagcagaccctgcaggagaacctgatcgagaagggcagcaacctgcacgagaagaccctgggcgagaccagcgccaacgccgagaccgagcagaacaagaagaaggccgaccccgagaacatcaagagcgagggcgacggcacccaggacatcgtggacaagagcagcgagaagctggtgagaggcagaaccagataccagaccagaagagccagccagggcctgctgagcagcatcgagaacagcgagagcgacagcagcgaggccaaggaggagggcagcagaaagaagagaagcggcaagtggaagaacaagagcaacgagagcgtggacatccaggaccaggaggagaaggtggtgaagcaggagtgcatcaaggccgagaaccagagccacgactacaaggccaccagcgaggaggacgtgagcatcaagagccccatctgcgagaagcaggacgagagcaacaccgtgatctgccaggacagcaccgtgaccagcgacctgctgcaggtgcccgacgacctgcccaacgtgtgcgaggagaagaacgagaccagcaagtacgccgagtacagcttcaccagcctgcccgtgcccgagagcaacctgagaaccagaaacgccatcaagagactgcacaagagagacagcttcgacaactgcagcctgggcgagagcagcaagatcggcatcagcgacatcagcagcctgagcgagaagaccttccagaccctggagtgccagcacaagagaagcagaagagtgagaagaagcaagggctgcgactgctgcggcgagaagagccagccccaggagaagagcctgatcggcctgaagaacaccgagaacaacgacgtggagatcagcgagaccaagaaggccgacgtgcaggcccccgtgagccccagcgagaccagccaggccaacccctacagcgagggccagttcctggacgagcaccacagcgtgaacttccacctgggcctgaaggaggacaacgacaccatcaacgacagcctgatcgtgagcgagaccaagagcaaggagaacaccatgcaggagagcctgcccagcggcatcgtgaacttcagagaggagatctgcgacatggacagcagcgaggccatgagcctggagagccaggagagccccaacgagaacttcaagaccgtgggcccctgcctgggcgacagcaagaacgtgagccaggagagcctggagaccaaggaggagaagcccgaggagacccccaagatggagctgagcctggagaacgtgaccgtggagggcaacgcctgcaaggtgaccgagagcaacctggagaaggccaagaccatggagctgaacgtgggcaacgaggccagcttccacggccaggagagaaccaagaccggcatcagcgaggaggccgccatcgaggagaacaagagaaacgacgacagcgaggccgacaccgccaagctgaacgccaaggaggtggccaccgaggagttcaacagcgacatcagcctgagcgacaacaccacccccgtgaagctgaacgcccagaccgagatcagcgagcagaccgccgccggcgagctggacggcggcaacgacgtgagcgacctgcacagcagcgaggagaccaacaccaagatgaagaacaacgaggagatgatgatcggcgaggccatggccgagaccggccacgacggcgagaccgagaacgagggcatcaccaccaagaccagcaagcccgacgaggccgagaccaacatgctgaccgccgagatggacaacttcgtgtgcgacaccgtggagatgagcaccgaggagggcatcatcgacgccaacaagaccgagaccaacaccgagtacagcaagagcgaggagaagctggacaacaaccagatggtgatggagagcgacatcctgcaggaggaccaccacaccagccagaaggtggaggagcccagccagtgcctggccagcggcaccgccatcagcgagctgatcatcgaggacaacaacgccagcccccagaagctgagagagctggaccccagcctggtgagcgccaacgacagccccagcggcatgcagaccagatgcgtgtggagccccctggccagccccagcaccagcatcctgaagagaggcctgaagagaagccaggaggacgagatcagcagccccgtgaacaaggtgagaagagtgagcttcgccgaccccatctaccaggccggcctggccgacgacatcgacagaagatgcagcatcgtgagaagccacagcagcaacagcagccccatcggcaagagcgtgaagaccagccccaccacccagagcaagcacaacaccaccagcgccaagggcttcctgagccccggcagcagaagccccaagttcaagagcagcaagaagtgcctgatcagcgagatggccaaggagagcatcccctgccccaccgagagcgtgtacccccccctggtgaactgcgtggcccccgtggacatcatcctgccccagatcaccagcaacatgtgggccagaggcctgggccagctgatcagagccaagaacatcaagaccatcggcgacctgagcaccctgaccgccagcgagatcaagaccctgcccatcagaagccccaaggtgagcaacgtgaagaaggccctgagaatctaccacgagcagcaggtgaagaccagaggcctggaggagatccccgtgttcgacatcagcgagaagaccgtgaacggcatcgagaacaagagcctgagccccgacgaggagagactggtgagcgacatcatcgaccccgtggccctggagatccccctgagcaagaacctgctggcccagatcagcgccctggccctgcagctggacagcgaggacctgcacaactacagcggcagccagctgttcgagatgcacgagaagctgagctgcatggccaacagcgtgatcaagaacctgcagagcagatggagaagccccagccacgagaacagcatctag

SEQ ID NO: 12568 - DNA, 264 bp, Artificial Sequence
  Description of Artificial Sequence: Synthetic coding sequence
atgaccgccagaggccagagccccctggcccccctgctggagaccctggaggaccccagcgccagccacggcggccagaccgacgcctacctgaccctgaccagcagaatgaccggcgaggagggcaaggaggtgatcaccgagatcgagaagaagctgcccagactgtacaaggtgctgaagacccacatcagcagccagaacagcgagctgagcagcgccgccctgcaggccctgggcttctgcctgtacaaccccaagtag

SEQ ID NO: 12569 - DNA, 7341 bp, Artificial Sequence
  Description of Artificial Sequence: Synthetic coding sequence
atgaccgccagaggccagagccccctggcccccctgctggagaccctggaggaccccagcgccagccacggcggccagaccgacgcctacctgaccctgaccagcagaatgaccggcgaggagggcaaggaggtgatcaccgagatcgagaagaagctgcccagactgtacaaggtgctgaagacccacatcagcagccagaacagcgagctgagcagcgccgccctgcaggccctgggcttctgcctgtacaaccccaagatcaccagcgagctgagcgaggccaacgccctggagctgctgagcaagctgaacgacaccatcaagaacagcgacaagaacgtgagaaccagagccctgtgggtgatcagcaagcagaccttccccagcgaggtggtgggcaagatggtgagcagcatcatcgacagcctggagatcctgttcaacaagggcgagacccacagcgccgtggtggacttcgaggccctgaacgtgatcgtgagactgatcgagcaggcccccatccagatgggcgaggaggccgtgagatgggccaagctggtgatccccctggtggtgcacagcgcccagaaggtgcacctgagaggcgccaccgccctggagatgggcatgcccctgctgctgcagaagcagcaggagatcgccagcatcaccgagcagctgatgaccaccaagctgatcagcgagctgcagaagctgttcatgagcaagaacgagacctacgtgctgaagctgtggcccctgttcgtgaagctgctgggcagaaccctgcacagaagcggcagcttcatcaacagcctgctgcagctggaggagctgggcttcagaagcggcgcccccatgatcaagaagatcgccttcatcgcctggaagagcctgatcgacaacttcgccctgaaccccgacatcctgtgcagcgccaagagactgaagctgctgatgcagcccctgagcagcatccacgtgagaaccgagaccctggccctgaccaagctggaggtgtggtggtacctgctgatgagactgggcccccacctgcccgccaacttcgagcaggtgtgcgtgcccctgatccagagcaccatcagcatcgacagcaacgccagcccccagggcaacagctgccacgtggccaccagccccggcctgaaccccatgacccccgtgcacaagggcgccagcagcccctacggcgcccccggcacccccagaatgaacctgagcagcaacctgggcggcatggccaccatccccagcatccagctgctgggcctggagatgctgctgcacttcctgctgggccccgaggccctgagcttcgccaagcagaacaagctggtgctgagcctggagcccctggagcaccccctgatcagcagccccagcttcttcagcaagcacgccaacaccctgatcaccgccgtgcacgacagcttcgtggccgtgggcaaggacgcccccgacgtggtggtgagcgccatctggaaggagctgatcagcctggtgaagagcgtgaccgagagcggcaacaagaaggagaagcccggcagcgaggtgctgaccctgctgctgaagagcctggagagcatcgtgaagagcgaggtgttccccgtgagcaagaccctggtgctgatggagatcaccatcaagggcctgccccagaaggtgctgggcagccccgcctaccaggtggccaacatggacatcctgaacggcacccccgccctgttcctgatccagctgatcttcaacaacttcctggagtgcggcgtgagcgacgagagattcttcctgagcctggagagcctggtgggctgcgtgctgagcggccccaccagccccctggccttcagcgacagcgtgctgaacgtgatcaaccagaacgccaagcagctggagaacaaggagcacctgtggaagatgtggagcgtgatcgtgacccccctgaccgagctgatcaaccagaccaacgaggtgaaccagggcgacgccctggagcacaacttcagcgccatctacggcgccctgaccctgcccgtgaaccacatcttcagcgagcagagattccccgtggccaccatgaagaccctgctgagaacctggagcgagctgtacagagccttcgccagatgcgccgccctggtggccaccgccgaggagaacctgtgctgcgaggagctgagcagcaagatcatgagcagcctggaggacgagggcttcagcaacctgctgttcgtggacagaatcatctacatcatcaccgtgatggtggactgcatcgacttcagcccctacaacatcaagtaccagcccaaggtgaagagcccccagagacccagcgactggagcaagaagaagaacgagcccctgggcaagctgaccagcctgttcaagctgatcgtgaaggtgatctacagcttccacaccctgagcttcaaggaggcccacagcgacaccctgttcaccatcggcaacagcatcaccggcatcatcagcagcgtgctgggccacatcagcctgcccagcatgatcagaaagatcttcgccaccctgaccagacccctggccctgttctacgagaacagcaagctggacgaggtgcccaaggtgtacagctgcctgaacaacaagctggagaagctgctgggcgagatcatcgcctgcctgcagttcagctacaccggcacctacgacagcgagctgctggagcagctgagccccctgctgtgcatcatcttcctgcacaagaacaagcagatcagaaagcagagcgcccagttctggaacgccaccttcgccaaggtgatgatgctggtgtaccccgaggagctgaagcccgtgctgacccaggccaagcagaagttcctgctgctgctgcccggcctggagaccgtggagatgatggaggagagcagcggcccctacagcgacggcaccgagaacagccagctgaacgtgaagatcagcggcatggagagaaagagcaacggcaagagagacagcttcctggcccagaccaagaacaagaaggagaacatgaagcccgccgccaagctgaagctggagagcagcagcctgaaggtgaagggcgagatcctgctggaggaggagaagagcaccgacttcgtgttcatcccccccgagggcaaggacgccaaggagagaatcctgaccgaccaccagaaggaggtgctgaagaccaagagatgcgacatccccgccatgtacaacaacctggacgtgagccaggacaccctgttcacccagtacagccaggaggagcccatggagatccccaccctgaccagaaagcccaaggaggacagcaagatgatgatcaccgaggagcagatggacagcgacatcgtgatcccccaggacgtgaccgaggactgcggcatggccgagcacctggagaagagcagcctgagcaacaacgagtgcggcagcctggacaagaccagccccgagatgagcaacagcaacaacgacgagagaaagaaggccctgatcagcagcagaaagaccagcaccgagtgcgccagcagcaccgagaacagcttcgtggtgagcagcagcagcgtgagcaacaccaccgtggccggcacccccccctaccccaccagcagaagacagaccttcatcaccctggagaagttcgacggcagcgagaacagacccttcagccccagccccctgaacaacatcagcagcaccgtgaccgtgaagaacaaccaggagaccatgatcaagaccgacttcctgcccaaggccaagcagagagagggcaccttcagcaagagcgacagcgagaagatcgtgaacggcaccaagagaagcagcagaagagccggcaaggccgagcagaccggcaacaagagaagcaagcccctgatgagaagcgagcccgagaagaacaccgaggagagcgtggagggcatcgtggtgctggagaacaacccccccggcctgctgaaccagaccgagtgcgtgagcgacaaccaggtgcacctgagcgagagcaccatggagcacgacaacaccaagctgaaggccgccaccgtggagaacgccgtgctgctggagaccaacaccgtggaggagaagaacgtggagatcaacctggagagcaaggagaacaccccccccgtggtgatcagcgccgaccagatggtgaacgaggacagccaggtgcagatcacccccaaccagaagaccctgagaagaagcagcagaagaagaagcgaggtggtggagagcaccaccgagagccaggacaaggagaacagccaccagaagaaggagagaagaaaggaggaggagaagcccctgcagaagagccccctgcacatcaaggacgacgtgctgcccaagcagaagctgatcgccgagcagaccctgcaggagaacctgatcgagaagggcagcaacctgcacgagaagaccctgggcgagaccagcgccaacgccgagaccgagcagaacaagaagaaggccgaccccgagaacatcaagagcgagggcgacggcacccaggacatcgtggacaagagcagcgagaagctggtgagaggcagaaccagataccagaccagaagagccagccagggcctgctgagcagcatcgagaacagcgagagcgacagcagcgaggccaaggaggagggcagcagaaagaagagaagcggcaagtggaagaacaagagcaacgagagcgtggacatccaggaccaggaggagaaggtggtgaagcaggagtgcatcaaggccgagaaccagagccacgactacaaggccaccagcgaggaggacgtgagcatcaagagccccatctgcgagaagcaggacgagagcaacaccgtgatctgccaggacagcaccgtgaccagcgacctgctgcaggtgcccgacgacctgcccaacgtgtgcgaggagaagaacgagaccagcaagtacgccgagtacagcttcaccagcctgcccgtgcccgagagcaacctgagaaccagaaacgccatcaagagactgcacaagagagacagcttcgacaactgcagcctgggcgagagcagcaagatcggcatcagcgacatcagcagcctgagcgagaagaccttccagaccctggagtgccagcacaagagaagcagaagagtgagaagaagcaagggctgcgactgctgcggcgagaagagccagccccaggagaagagcctgatcggcctgaagaacaccgagaacaacgacgtggagatcagcgagaccaagaaggccgacgtgcaggcccccgtgagccccagcgagaccagccaggccaacccctacagcgagggccagttcctggacgagcaccacagcgtgaacttccacctgggcctgaaggaggacaacgacaccatcaacgacagcctgatcgtgagcgagaccaagagcaaggagaacaccatgcaggagagcctgcccagcggcatcgtgaacttcagagaggagatctgcgacatggacagcagcgaggccatgagcctggagagccaggagagccccaacgagaacttcaagaccgtgggcccctgcctgggcgacagcaagaacgtgagccaggagagcctggagaccaaggaggagaagcccgaggagacccccaagatggagctgagcctggagaacgtgaccgtggagggcaacgcctgcaaggtgaccgagagcaacctggagaaggccaagaccatggagctgaacgtgggcaacgaggccagcttccacggccaggagagaaccaagaccggcatcagcgaggaggccgccatcgaggagaacaagagaaacgacgacagcgaggccgacaccgccaagctgaacgccaaggaggtggccaccgaggagttcaacagcgacatcagcctgagcgacaacaccacccccgtgaagctgaacgcccagaccgagatcagcgagcagaccgccgccggcgagctggacggcggcaacgacgtgagcgacctgcacagcagcgaggagaccaacaccaagatgaagaacaacgaggagatgatgatcggcgaggccatggccgagaccggccacgacggcgagaccgagaacgagggcatcaccaccaagaccagcaagcccgacgaggccgagaccaacatgctgaccgccgagatggacaacttcgtgtgcgacaccgtggagatgagcaccgaggagggcatcatcgacgccaacaagaccgagaccaacaccgagtacagcaagagcgaggagaagctggacaacaaccagatggtgatggagagcgacatcctgcaggaggaccaccacaccagccagaaggtggaggagcccagccagtgcctggccagcggcaccgccatcagcgagctgatcatcgaggacaacaacgccagcccccagaagctgagagagctggaccccagcctggtgagcgccaacgacagccccagcggcatgcagaccagatgcgtgtggagccccctggccagccccagcaccagcatcctgaagagaggcctgaagagaagccaggaggacgagatcagcagccccgtgaacaaggtgagaagagtgagcttcgccgaccccatctaccaggccggcctggccgacgacatcgacagaagatgcagcatcgtgagaagccacagcagcaacagcagccccatcggcaagagcgtgaagaccagccccaccacccagagcaagatcagcgagatggccaaggagagcatcccctgccccaccgagagcgtgtacccccccctggtgaactgcgtggcccccgtggacatcatcctgccccagatcaccagcaacatgtgggccagaggcctgggccagctgatcagagccaagaacatcaagaccatcggcgacctgagcaccctgaccgccagcgagatcaagaccctgcccatcagaagccccaaggtgagcaacgtgaagaaggccctgagaatctaccacgagcagcaggtgaagaccagaggcctggaggagatccccgtgttcgacatcagcgagaagaccgtgaacggcatcgagaacaagagcctgagccccgacgaggagagactggtgagcgacatcatcgaccccgtggccctggagatccccctgagcaagaacctgctggcccagatcagcgccctggccctgcagctggacagcgaggacctgcacaactacagcggcagccagctgttcgagatgcacgagaagctgagctgcatggccaacagcgtgatcaagaacctgcagagcagatggagaagccccagccacgagaacagcatctag

SEQ ID NO: 12570 - DNA, 7341 bp, Artificial Sequence; identical to SEQ ID NO: 12569
  Description of Artificial Sequence: Synthetic coding sequence

SEQ ID NO: 12571 - DNA, 1026 bp, Artificial Sequence
  Description of Artificial Sequence: Synthetic coding sequence
atgaccgccagaggccagagccccctggcccccctgctggagaccctggaggaccccagcgccagccacggcggccagaccgacgcctacctgaccctgaccagcagaatgaccggcgaggagggcaaggaggtgatcaccgagatcgagaagaagctgcccagactgtacaaggtgctgaagacccacatcagcagccagaacagcgagctgagcagcgccgccctgcaggccctgggcttctgcctgtacaaccccaagatcaccagcgagctgagcgaggccaacgccctggagctgctgagcaagctgaacgacaccatcaagaacagcgacaagaacgtgagaaccagagccctgtgggtgatcagcaagcagaccttccccagcgaggtggtgggcaagatggtgagcagcatcatcgacagcctggagatcctgttcaacaagggcgagacccacagcgccgtggtggacttcgaggccctgaacgtgatcgtgagactgatcgagcaggcccccatccagatgggcgaggaggccgtgagatgggccaagctggtgatccccctggtggtgcacagcgcccagaaggtgcacctgagaggcgccaccgccctggagatgggcatgcccctgctgctgcagaagcagcaggagatcgccagcatcaccgagcagctgatgaccaccaccctgcacagaagcggcagcttcatcaacagcctgctgcagctggaggagctgggcttcagaagcggcgcccccatgatcaagaagatcgccttcatcgcctggaagagcctgatcgacaacttcgccctgaaccccgacatcctgtgcagcgccaagagactgaagctgctgatgcagcccctgagcagcatccacgtgagaaccgagaccctggccctgaccaagctggaggtgtggtggtacctgctgatgagactgggcccccacctgcccgccaacttcgagcaggtgctgccccccagaaccgagcccagagagctgcccgagtag

SEQ ID NO: 12572 - DNA, 7419 bp, Artificial Sequence; identical to SEQ ID NO: 12567
  Description of Artificial Sequence: Synthetic coding sequence

SEQ ID NO: 12573 - DNA, 7341 bp, Artificial Sequence; identical to SEQ ID NO: 12569
  Description of Artificial Sequence: Synthetic coding sequence

SEQ ID NO: 12574 - DNA, 555 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggactgccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagcagatcctgagagtgaaggacaccgaggacgtgcccatgatcctggtgggcaacaagtgcgacctggaggacgagagagtggtgggcaaggagcagggccagaacctggccagacagtggtgcaactgcgccttcctggagagcagcgccaagagcaagatcaacgtgaacgagatcttctacgacctggtgagacagatcaacagaaagacccccgtggagaagaagaagcccaagaagaagagctgcctgctgctgtag

SEQ ID NO: 12575 - DNA, 555 bp, Artificial Sequence; identical to SEQ ID NO: 12574
  Description of Artificial Sequence: Synthetic coding sequence

SEQ ID NO: 12576 - DNA, 390 bp, Artificial Sequence
  Description of Artificial Sequence: Synthetic coding sequence
atgagagagtacaagctggtggtgctgggcagcggcggcgtgggcaagagcgccctgaccgtgcagttcgtgcagggcatcttcgtggagaagtacgaccccaccatcgaggacagctacagaaagcaggtggaggtggactgccagcagtgcatgctggagatcctggacaccgccggcaccgagcagttcaccgccatgagagacctgtacatgaagaacggccagggcttcgccctggtgtacagcatcaccgcccagagcaccttcaacgacctgcaggacctgagagagcagatcctgagagtgaaggacaccgaggacgtgcccatgatcctggtgggcaacaagtgcgacctggaggacgagagagtggtgggcaaggagtag

SEQ ID NO: 12577 - DNA, 555 bp, Artificial Sequence; identical to SEQ ID NO: 12574
  Description of Artificial Sequence: Synthetic coding sequence

SEQ ID NO: 12578 - DNA, 555 bp, Artificial Sequence; identical to SEQ ID NO: 12574
  Description of Artificial Sequence: Synthetic coding sequence

SEQ ID NO: 12579 - DNA, 1380 bp, Artificial Sequence
  Description of Artificial Sequence: Synthetic coding sequence
atgagagcccagatcgaggtgatcccctgcaagatctgcggcgacaagagcagcggcatccactacggcgtgatcacctgcgagggctgcaagggcttcttcagaagaagccagcagaacaacgccagctacagctgccccagacagagaaactgcctgatcgacagaaccaacagaaacagatgccagcactgcagactgcagaagtgcctggccctgggcatgagcagagacgccgtgaagttcggcagaatgagcaagaagcagagagacagcctgtacgccgaggtgcagaagcaccagcagagactgcaggagcagagacagcagcagagcggcgaggccgaggccctggccagagtgtacagcagcagcatcagcaacggcctgagcaacctgaacaacgagaccagcggcacctacgccaacggccacgtgatcgacctgcccaagagcgagggctactacaacgtggacagcggccagcccagccccgaccagagcggcctggacatgaccggcatcaagcagatcaagcaggagcccatctacgacctgaccagcgtgcccaacctgttcacctacagcagcttcaacaacggccagctggcccccggcatcaccatgaccgagatcgacagaatcgcccagaacatcatcaagagccacctggagacctgccagtacaccatggaggagctgcaccagctggcctggcagacccacacctacgaggagatcaaggcctaccagagcaagagcagagaggccctgtggcagcagtgcgccatccagatcacccacgccatccagtacgtggtggagttcgccaagagaatcaccggcttcatggagctgtgccagaacgaccagatcctgctgctgaagagcggctgcctggaggtggtgctggtgagaatgtgcagagccttcaaccccctgaacaacaccgtgctgttcgagggcaagtacggcggcatgcagatgttcaaggccctgggcagcgacgacctggtgaacgaggccttcgacttcgccaagaacctgtgcagcctgcagctgaccgaggaggagatcgccctgttcagcagcgccgtgctgatcagccccgacagagcctggctgatcgagcccagaaaggtgcagaagctgcaggagaagatctacttcgccctgcagcacgtgatccagaagaaccacctggacgacgagaccctggccaagctgatcgccaagatccccaccatcaccgccgtgtgcaacctgcacggcgagaagctgcaggtgttcaagcagagccaccccgagatcgtgaacaccctgttcccccccctgtacaaggagctgttcaaccccgactgcgccaccggctgcaagtag

SEQ ID NO: 12580 - DNA, 1413 bp, Artificial Sequence
  Description of Artificial Sequence: Synthetic coding sequence
atgtgcgagaaccagctgaagaccaaggccgacgccaccgcccagatcgaggtgatcccctgcaagatctgcggcgacaagagcagcggcatccactacggcgtgatcacctgcgagggctgcaagggcttcttcagaagaagccagcagaacaacgccagctacagctgccccagacagagaaactgcctgatcgacagaaccaacagaaacagatgccagcactgcagactgcagaagtgcctggccctgggcatgagcagagacgccgtgaagttcggcagaatgagcaagaagcagagagacagcctgtacgccgaggtgcagaagcaccagcagagactgcaggagcagagacagcagcagagcggcgaggccgaggccctggccagagtgtacagcagcagcatcagcaacggcctgagcaacctgaacaacgagaccagcggcacctacgccaacggccacgtgatcgacctgcccaagagcgagggctactacaacgtggacagcggccagcccagccccgaccagagcggcctggacatgaccggcatcaagcagatcaagcaggagcccatctacgacctgaccagcgtgcccaacctgttcacctacagcagcttcaacaacggccagctggcccccggcatcaccatgaccgagatcgacagaatcgcccagaacatcatcaagagccacctggagacctgccagtacaccatggaggagctgcaccagctggcctggcagacccacacctacgaggagatcaaggcctaccagagcaagagcagagaggccctgtggcagcagtgcgccatccagatcacccacgccatccagtacgtggtggagttcgccaagagaatcaccggcttcatggagctgtgccagaacgaccagatcctgctgctgaagagcggctgcctggaggtggtgctggtgagaatgtgcagagccttcaaccccctgaacaacaccgtgctgttcgagggcaagtacggcggcatgcagatgttcaaggccctgggcagcgacgacctggtgaacgaggccttcgacttcgccaagaacctgtgcagcctgcagctgaccgaggaggagatcgccctgttcagcagcgccgtgctgatcagccccgacagagcctggctgatcgagcccagaaaggtgcagaagctgcaggagaagatctacttcgccctgcagcacgtgatccagaagaaccacctggacgacgagaccctggccaagctgatcgccaagatccccaccatcaccgccgtgtgcaacctgcacggcgagaagctgcaggtgttcaagcagagccaccccgagatcgtgaacaccctgttcccccccctgtacaaggagctgttcaaccccgactgcgccaccggctgcaagtag

SEQ ID NO: 12581 - DNA, 813 bp, Artificial Sequence
  Description of Artificial Sequence: Synthetic coding sequence
atgggcgaggccgaggcccccagcttcgagatgacctggagcagcaccaccagcagcggctactgcagccaggaggacagcgacagcgagctggagcagtacttcaccgccagaaccagcctggccagaagacccagaagagaccaggacgagcccgtggagtgggagacccccgacctgagccaggccgagatcgagcagaagatcaaggagtacaacgcccagatcaacagcaacctgttcatgagcctgaacaaggacggcagctacaccggcttcatcaaggtgcagctgaagctggtgagacccgtgagcgtgcccagcagcaagaagccccccagcctgcaggacgccagaagaggccccggcagaggcaccagcgtgagaagaagaaccagcttctacctgcccaaggacgccgtgaagcacctgcacgtgctgagcagaaccagagccagagaggtgatcgaggccctgctgagaaagttcctggtggtggacgaccccagaaagttcgccctgttcgagagagccgagagacacggccaggtgtacctgagaaagctgctggacgacgagcagcccctgagactgagactgctggccggccccagcgacaaggccctgagcttcgtgctgaaggagaacgacagcggcgaggtgaactgggacgccttcagcatgcccgagctgcacaacttcctgagaatcctgcagagagaggaggaggagcacctgagacagatcctgcagaagtacagctactgcagacagaagatccaggaggccctgcacgcctgccccctgggctag

SEQ ID NO: 12582 - DNA, 1035 bp, Artificial Sequence
  Description of Artificial Sequence: Synthetic coding sequence
atgagcggcgagcccgagctgatcgagctgagagagctggcccccgccggcagagccggcaagggcagaaccagactggagagagccaacgccctgagaatcgccagaggcaccgcctgcaaccccaccagacagctggtgcccggcagaggccacagattccagcccgccggccccgccacccacacctggtgcgacctgtgcggcgacttcatctggggcgtggtgagaaagggcctgcagtgcgccagactgagcgccgactgcaagttcacctgccactacagatgcagagccctggtgtgcctggactgctgcggccccagagacctgggctgggagcccgccgtggagagagacaccaacgtggacgagcccgtggagtgggagacccccgacctgagccaggccgagatcgagcagaagatcaaggagtacaacgcccagatcaacagcaacctgttcatgagcctgaacaaggacggcagctacaccggcttcatcaaggtgcagctgaagctggtgagacccgtgagcgtgcccagcagcaagaagccccccagcctgcaggacgccagaagaggccccggcagaggcaccagcgtgagaagaagaaccagcttctacctgcccaaggacgccgtgaagcacctgcacgtgctgagcagaaccagagccagagaggtgatcgaggccctgctgagaaagttcctggtggtggacgaccccagaaagttcgccctgttcgagagagccgagagacacggccaggtgtacctgagaaagctgctggacgacgagcagcccctgagactgagactgctggccggccccagcgacaaggccctgagcttcgtgctgaaggagaacgacagcggcgaggtgaactgggacgccttcagcatgcccgagctgcacaacttcctgagaatcctgcagagagaggaggaggagcacctgagacagatcctgcagaagtacagctactgcagacagaagatccaggaggccctgcacgcctgccccctgggctag

SEQ ID NO: 12583 - DNA, 1023 bp, Artificial Sequence
  Description of Artificial Sequence: Synthetic coding sequence
atgagcggcgagcccgagctgatcgagctgagagagctggcccccgccggcagagccggcaagggcagaaccagactggagagagccaacgccctgagaatcgccagaggcaccgcctgcaaccccaccagacagctggtgcccggcagaggccacagattccagcccgccggccccgccacccacacctggtgcgacctgtgcggcgacttcatctggggcgtggtgagaaagggcctgcagtgcgcccactgcaagttcacctgccactacagatgcagagccctggtgtgcctggactgctgcggccccagagacctgggctgggagcccgccgtggagagagacaccaacgtggacgagcccgtggagtgggagacccccgacctgagccaggccgagatcgagcagaagatcaaggagtacaacgcccagatcaacagcaacctgttcatgagcctgaacaaggacggcagctacaccggcttcatcaaggtgcagctgaagctggtgagacccgtgagcgtgcccagcagcaagaagccccccagcctgcaggacgccagaagaggccccggcagaggcaccagcgtgagaagaagaaccagcttctacctgcccaaggacgccgtgaagcacctgcacgtgctgagcagaaccagagccagagaggtgatcgaggccctgctgagaaagttcctggtggtggacgaccccagaaagttcgccctgttcgagagagccgagagacacggccaggtgtacctgagaaagctgctggacgacgagcagcccctgagactgagactgctggccggccccagcgacaaggccctgagcttcgtgctgaaggagaacgacagcggcgaggtgaactgggacgccttcagcatgcccgagctgcacaacttcctgagaatcctgcagagagaggaggaggagcacctgagacagatcctgcagaagtacagctactgcagacagaagatccaggaggccctgcacgcctgccccctgggctag

SEQ ID NO: 12584 - DNA, 570 bp, Artificial Sequence
  Description of Artificial Sequence: Synthetic coding sequence
atgagcctgaacaaggacggcagctacaccggcttcatcaaggtgcagctgaagctggtgagacccgtgagcgtgcccagcagcaagaagccccccagcctgcaggacgccagaagaggccccggcagaggcaccagcgtgagaagaagaaccagcttctacctgcccaaggacgccgtgaagcacctgcacgtgctgagcagaaccagagccagagaggtgatcgaggccctgctgagaaagttcctggtggtggacgaccccagaaagttcgccctgttcgagagagccgagagacacggccaggtgtacctgagaaagctgctggacgacgagcagcccctgagactgagactgctggccggccccagcgacaaggccctgagcttcgtgctgaaggagaacgacagcggcgaggtgaactgggacgccttcagcatgcccgagctgcacaacttcctgagaatcctgcagagagaggaggaggagcacctgagacagatcctgcagaagtacagctactgcagacagaagatccaggaggccctgcacgcctgccccctgggctag

SEQ ID NO: 12585 - DNA, 981 bp, Artificial Sequence
  Description of Artificial Sequence: Synthetic coding sequence
atggactacagccaccagaccagcctggtgccctgcggccaggacaagtacatcagcaagaacgagctgctgctgcacctgaagacctacaacctgtactacgagggccagaacctgcagctgagacacagagaggaggaggacgagttcatcgtggagggcctgctgaacatcagctggggcctgagaagacccatcagactgcagatgcaggacgacaacgagagaatcagacccccccccagcagcagcagctggcacagcggctgcaacctgggcgcccagggcaccaccctgaagcccctgaccgtgcccaaggtgcagatcagcgaggtggacgccccccccgagggcgaccagatgcccagcagcaccgacagcagaggcctgaagcccctgcaggaggacaccccccagctgatgagaaccagaagcgacgtgggcgtgagaagaagaggcaacgtgagaacccccagcgaccagagaagaatcagaagacacagattcagcatcaacggccacttctacaaccacaagaccagcgtgttcacccccgcctacggcagcgtgaccaacgtgagaatcaacagcaccatgaccaccccccaggtgctgaagctgctgctgaacaagttcaagatcgagaacagcgccgaggagttcgccctgtacgtggtgcacaccagcggcgagaagcagaagctgaaggccaccgactaccccctgatcgccagaatcctgcagggcccctgcgagcagatcagcaaggtgttcctgatggagaaggaccaggtggaggaggtgacctacgacgtggcccagtacatcaagttcgagatgcccgtgctgaagagcttcatccagaagctgcaggaggaggaggacagagaggtgaagaagctgatgagaaagtacaccgtgctgagactgatgatcagacagagactggaggagatcgccgagacccccgccaccatctag

SEQ ID NO: 12586 - DNA, 981 bp, Artificial Sequence; identical to SEQ ID NO: 12585
  Description of Artificial Sequence: Synthetic coding sequence

SEQ ID NO: 12587 - DNA, 993 bp, Artificial Sequence
  Description of Artificial Sequence: Synthetic coding sequence
atgaaggaggactgcctgcccagcagccacgtgcccatcagcgacagcaagagcatccagaagagagacgtgcagggcctgagcgaggagggcaccctgatcatcgagggcctgctgaacatcgcctggggcctgagaagacccatcagactgcagatgcaggacgacagagagcaggtgcacctgcccagcaccagctggatgcccagaagacccagctgccccctgggctgctggagcctgctgctgggcctgagcagcctgagcctgcccgccgccatcagcgccctgcagctgagcgtgttcagaaaggagcccagcccccagaacggcaacatcaccgcccagggccccagcatccagcccgtgcacaaggccgagagcagcaccgacagcagcggccccctggaggaggccgaggaggccccccagctgatgagaaccaagagcgacgccagctgcatgagccagagaagacccaagtgcagagcccccggcgaggcccagagaatcagaagacacagattcagcatcaacggccacttctacaaccacaagaccagcgtgttcacccccgcctacggcagcgtgaccaacgtgagagtgaacagcaccatgaccaccctgcaggtgctgaccctgctgctgaacaagttcagagtggaggacggccccagcgagttcgccctgtacatcgtgcacgagagcggcgagagaaccaagctgaaggactgcgagtaccccctgatcagcagaatcctgcacggcccctgcgagaagatcgccagaatcttcctgatggaggccgacctgggcgtggaggtgccccacgaggtggcccagtacatcaagttcgagatgcccgtgctggacagcttcgtggagaagctgaaggaggaggaggagagagagatcatcaagctgaccatgaagttccaggccctgagactgaccatgctgcagagactggagcagctggtggaggccaagtag

SEQ ID NO: 12588 - DNA, 966 bp, Artificial Sequence
  Description of Artificial Sequence: Synthetic coding sequence
atgaaggaggactgcctgcccagcagccacgtgcccatcagcgacagcaagagcatccagaagagcgagctgctgggcctgctgaagacctacaactgctaccacgagggcaagagcttccagctgagacacagagaggaggagggcaccctgatcatcgagggcctgctgaacatcgcctggggcctgagaagacccatcagactgcagatgcaggacgacagagagcaggtgcacctgcccagcaccagctggatgcccagaagacccagctgccccctgaaggagcccagcccccagaacggcaacatcaccgcccagggccccagcatccagcccgtgcacaaggccgagagcagcaccgacagcagcggccccctggaggaggccgaggaggccccccagctgatgagaaccaagagcgacgccagctgcatgagccagagaagacccaagtgcagagcccccggcgaggcccagagaatcagaagacacagattcagcatcaacggccacttctacaaccacaagaccagcgtgttcacccccgcctacggcagcgtgaccaacgtgagagtgaacagcaccatgaccaccctgcaggtgctgaccctgctgctgaacaagttcagagtggaggacggccccagcgagttcgccctgtacatcgtgcacgagagcggcgagagaaccaagctgaaggactgcgagtaccccctgatcagcagaatcctgcacggcccctgcgagaagatcgccagaatcttcctgatggaggccgacctgggcgtggaggtgccccacgaggtggcccagtacatcaagttcgagatgcccgtgctggacagcttcgtggagaagctgaaggaggaggaggagagagagatcatcaagctgaccatgaagttccaggccctgagactgaccatgctgcagagactggagcagctggtggaggccaagtag

SEQ ID NO: 12589 - DNA, 1239 bp, Artificial Sequence
  Description of Artificial Sequence: Synthetic coding sequence
ggcagcaacgccggcggcggccagggcggctgccagggcctgacctgcgacagcgagagcgtgggcaccctggacatcctggaccagacccaggcctgccccgtgagcctggccagcagcagcgccagacccccctgccccccccccggcccctgcgccgagcccagcggctgcatcgccatggccgtgtggagccccctggtgatgcccggcagaagagagggctgctgccacacccccgtgaccaacgaggagaccgaggccagagaggccaagggccagaagctgagaccctgccacaccctgggcgtgcacgtgtgcctgagcctgttcagaagcgagctgctgggcctgctgaagacctacaactgctaccacgagggcaagagcttccagctgagacacagagaggaggagggcaccctgatcatcgagggcctgctgaacatcgcctggggcctgagaagacccatcagactgcagatgcaggacgacagagagcaggtgcacctgcccagcaccagctggatgcccagaagacccagctgccccctgaaggagcccagcccccagaacggcaacatcaccgcccagggccccagcatccagcccgtgcacaaggccgagagcagcaccgacagcagcggccccctggaggaggccgaggaggccccccagctgatgagaaccaagagcgacgccagctgcatgagccagagaagacccaagtgcagagcccccggcgaggcccagagaatcagaagacacagattcagcatcaacggccacttctacaaccacaagaccagcgtgttcacccccgcctacggcagcgtgaccaacgtgagagtgaacagcaccatgaccaccctgcaggtgctgaccctgctgctgaacaagttcagagtggaggacggccccagcgagttcgccctgtacatcgtgcacgagagcggcgagagaaccaagctgaaggactgcgagtaccccctgatcagcagaatcctgcacggcccctgcgagaagatcgccagaatcttcctgatggaggccgacctgggcgtggaggtgccccacgaggtggcccagtacatcaagttcgagatgcccgtgctggacagcttcgtggagaagctgaaggaggaggaggagagagagatcatcaagctgaccatgaagttccaggccctgagactgaccatgctgcagagactggagcagctggtggaggccaagtag

SEQ ID NO: 12590 - DNA, 393 bp, Artificial Sequence
  Description of Artificial Sequence: Synthetic coding sequence
atgaaggaggactgcctgcccagcagccacgtgcccatcagcgacagcaagagcatccagaagagcgagctgctgggcctgctgaagacctacaactgctaccacgagggcaagagcttccagctgagacacagagaggaggagggcaccctgatcatcgagggcctgctgaacatcgcctggggcctgagaagacccatcagactgcagatgcaggacgacagagagcaggtgcacctgcccagcaccagctggatgcccagaagacccagctgccccctgcacctggccggcaagaagggcagactgcagcccggcggcctgcccacccccatgcaggccgagcacgtgagccccagcctggtgctgagcctgaagttcaccagaatctag

SEQ ID NO: 12591 - DNA, 381 bp, Artificial Sequence
  Description of Artificial Sequence: Synthetic coding sequence
atgaaggaggactgcctgcccagcagccacgtgcccatcagcgacagcaagagcatccagaagagcgagctgctgggcctgctgaagacctacaactgctaccacgagggcaagagcttccagctgagacacagagaggaggagggcaccctgatcatcgagggcctgctgaacatcgcctggggcctgagaagacccatcagactgcagatgcaggacgacagagagcaggtgcacctgcccagcaccagctggatgcccagaagacccagctgccccctggcccccggcggcggcagaggcggcccccccgccgacgccgaccaggagagaagacagctgcacgagcccgaggaggcccaggtgcccagacccagatag

SEQ ID NO: 12592 - DNA, 456 bp, Artificial Sequence
  Description of Artificial Sequence: Synthetic coding sequence
atgaaggaggactgcctgcccagcagccacgtgcccatcagcgacagcaagagcatccagaagagcgagctgctgggcctgctgaagacctacaactgctaccacgagggcaagagcttccagctgagacacagagaggaggagggcaccctgatcatcgagggcctgctgaacatcgcctggggcctgagaagacccatcagactgcagatgcaggacgacagagagcaggtgcacctgcccagcaccagctggatgcccagaagacccagctgccccctgggctgctggagcctgctgctgggcctgagcagcctgagcctgcccgccgccatcagcgccctgcagctgagcgtgttcagaaaggagcccagcccccagaacggcaacatcaccgcccagggccccagcatccagcccgtgcacaaggccgagagcagcaccgacagcagctag

SEQ ID NO: 12593 - DNA, 372 bp, Artificial Sequence
  Description of Artificial Sequence: Synthetic coding sequence
agcagccacgtgcccatcagcgacagcaagagcatccagaagagcgagctgctgggcctgctgaagacctacaactgctaccacgagggcaagagcttccagctgagacacagagaggaggagggcaccctgatcatcgagggcctgctgaacatcgcctggggcctgagaagacccatcagactgcagatgcaggacgacagagagcaggtgcacctgcccagcaccagctggatgcccagaagacccagctgccccctgcacctggccggcaagaagggcagactgcagcccggcggcctgcccacccccatgcaggccgagcacgtgagccccagcctggtgctgagcctgaagttcaccagaatctag

SEQ ID NO: 12594 - DNA, 798 bp, Artificial Sequence
  Description of Artificial Sequence: Synthetic coding sequence
atgaccgtggacagcagcatgagcagcggctactgcagcctggacgaggagctggaggactgcttcttcaccgccaagaccaccttcttcagaaacgcccagagcaagcacctgagcaagaacgtgtgcaagcccgtggaggagacccagagaccccccaccctgcaggagatcaagcagaagatcgacagctacaacaccagagagaagaactgcctgggcatgaagctgagcgaggacggcacctacaccggcttcatcaaggtgcacctgaagctgagaagacccgtgaccgtgcccgccggcatcagaccccagagcatctacgacgccatcaaggaggtgaacctggccgccaccaccgacaagagaaccagcttctacctgcccctggacgccatcaagcagctgcacatcagcagcaccaccaccgtgagcgaggtgatccagggcctgctgaagaagttcatggtggtggacaacccccagaagttcgccctgttcaagagaatccacaaggacggccaggtgctgttccagaagctgagcatcgccgacagacccctgtacctgagactgctggccggccccgacaccgaggtgctgagcttcgtgctgaaggagaacgagaccggcgaggtggagtgggacgccttcagcatccccgagctgcagaacttcctgaccatcctggagaaggaggagcaggacaagatccagcaggtgcagaagaagtacgacaagttcagacagaagctggaggaggccctgagagagagccagggcaagcccggctag

SEQ ID NO: 12595 - DNA, 1179 bp, Artificial Sequence
  Description of Artificial Sequence: Synthetic coding sequence
atggccatggccagccccgccatcggccagagaccctaccccctgctgctggaccccgagccccccagatacctgcagagcctgagcggccccgagctgcccccccccccccccgacagaagcagcagactgtgcgtgcccgcccccctgagcaccgcccccggcgccagagagggcagaagcgccagaagagccgccagaggcaacctggagcccccccccagagccagcagacccgccagacccctgagacccggcctgcagcagagactgagaagaagacccggcgcccccagacccagagacgtgagaagcatcttcgagcagccccaggaccccagagtgcccgccgagagaggcgagggccactgcttcgccgagctggtgctgcccggcggccccggctggtgcgacctgtgcggcagagaggtgctgagacaggccctgagatgcaccaactgcaagttcacctgccaccccgagtgcagaagcctgatccagctggactgcagccagcaggagggcctgagcagagacagacccagccccgagagcaccctgaccgtgaccttcagccagaacgtgtgcaagcccgtggaggagacccagagaccccccaccctgcaggagatcaagcagaagatcgacagctacaacaccagagagaagaactgcctgggcatgaagctgagcgaggacggcacctacaccggcttcatcaaggtgcacctgaagctgagaagacccgtgaccgtgcccgccggcatcagaccccagagcatctacgacgccatcaaggaggtgaacctggccgccaccaccgacaagagaaccagcttctacctgcccctggacgccatcaagcagctgcacatcagcagcaccaccaccgtgagcgaggtgatccagggcctgctgaagaagttcatggtggtggacaacccccagaagttcgccctgttcaagagaatccacaaggacggccaggtgctgttccagaagctgagcatcgccgacagacccctgtacctgagactgctggccggccccgacaccgaggtgctgagcttcgtgctgaaggagaacgagaccggcgaggtggagtgggacgccttcagcatccccgagctgcagaacttcctgagcagctggtgcatccagatctacctgtactactag

SEQ ID NO: 12596 - DNA, 1257 bp, Artificial Sequence
  Description of Artificial Sequence: Synthetic coding sequence
atggccatggccagccccgccatcggccagagaccctaccccctgctgctggaccccgagccccccagatacctgcagagcctgagcggccccgagctgcccccccccccccccgacagaagcagcagactgtgcgtgcccgcccccctgagcaccgcccccggcgccagagagggcagaagcgccagaagagccgccagaggcaacctggagcccccccccagagccagcagacccgccagacccctgagacccggcctgcagcagagactgagaagaagacccggcgcccccagacccagagacgtgagaagcatcttcgagcagccccaggaccccagagtgcccgccgagagaggcgagggccactgcttcgccgagctggtgctgcccggcggccccggctggtgcgacctgtgcggcagagaggtgctgagacaggccctgagatgcaccaactgcaagttcacctgccaccccgagtgcagaagcctgatccagctggactgcagccagcaggagggcctgagcagagacagacccagccccgagagcaccctgaccgtgaccttcagccagaacgtgtgcaagcccgtggaggagacccagagaccccccaccctgcaggagatcaagcagaagatcgacagctacaacaccagagagaagaactgcctgggcatgaagctgagcgaggacggcacctacaccggcttcatcaaggtgcacctgaagctgagaagacccgtgaccgtgcccgccggcatcagaccccagagcatctacgacgccatcaaggaggtgaacctggccgccaccaccgacaagagaaccagcttctacctgcccctggacgccatcaagcagctgcacatcagcagcaccaccaccgtgagcgaggtgatccagggcctgctgaagaagttcatggtggtggacaacccccagaagttcgccctgttcaagagaatccacaaggacggccaggtgctgttccagaagctgagcatcgccgacagacccctgtacctgagactgctggccggccccgacaccgaggtgctgagcttcgtgctgaaggagaacgagaccggcgaggtggagtgggacgccttcagcatccccgagctgcagaacttcctgaccatcctggagaaggaggagcaggacaagatccagcaggtgcagaagaagtacgacaagttcagacagaagctggaggaggccctgagagagagccagggcaagcccggctag

SEQ ID NO: 12597 - DNA, 1011 bp, Artificial Sequence
  Description of Artificial Sequence: Synthetic coding sequence
atggccatggccagccccgccatcggccagagaccctaccccctgctgctggaccccgagccccccagatacctgcagagcctgagcggccccgagctgcccccccccccccccgacagaagcagcagactgtgcgtgcccgcccccctgagcaccgcccccggcgccagagagggcagaagcgccagaagagccgccagaggcaacctggagcccccccccagagccagcagacccgccagacccctgagacccggcctgcagcagagactgagaagaagacccggcgcccccagacccagagacgtgagaagcatcttcgagcagccccaggaccccagagtgcccgccgagagaggcgagggccactgcttcgccgagctggtgctgcccggcggccccggctggtgcgacctgtgcggcagagaggtgctgagacaggccctgagatgcaccaactgcaagttcacctgccaccccgagtgcagaagcctgatccagctggactgcagccagcaggagggcctgagcagagacagacccagccccgagagcaccctgaccgtgaccttcagccagaacgtgtgcaagcccgtggaggagacccagagaccccccaccctgcaggagatcaagcagaagatcgacagctacaacaccagagagaagaactgcctgggcatgaagctgagcgaggacggcacctacaccggcttcatcaaggtgcacctgaagctgagaagacccgtgaccgtgcccgccggcatcagaccccagagcatctacgacgccatcaaggaggtgaacctggccgccaccaccgacaagagaaccagcttctacctgcccctggacgccatcaagcagctgcacatcagcagcaccaccaccgtgagcgaggtgatccagggcctgctgaagaagttcatggtggtggacaacccccagaagttcgccctgttcaagagaatccacaaggacggccaggtgggctgcctgctgcacccctag

SEQ ID NO: 12598 - DNA, 1182 bp, Artificial Sequence
  Description of Artificial Sequence: Synthetic coding sequence
atggccatggccagccccgccatcggccagagaccctaccccctgctgctggaccccgagccccccagatacctgcagagcctgagcggccccgagctgcccccccccccccccgacagaagcagcagactgtgcgtgcccgcccccctgagcaccgcccccggcgccagagagggcagaagcgccagaagagccgccagaggcaacctggagcccccccccagagccagcagacccgccagacccctgagacccggcctgcagcagagactgagaagaagacccggcgcccccagacccagagacgtgagaagcatcttcgagcagccccaggaccccagagtgcccgccgagagaggcgagggccactgcttcgccgagctggtgctgcccggcggccccggctggtgcgacctgtgcggcagagaggtgctgagacaggccctgagatgcaccaactgcaagttcacctgccaccccgagtgcagaagcctgatccagctggactgcagccagcaggagggcctgagcagagacagacccagccccgagagcaccctgaccgtgaccttcagccagaacgtgtgcaagcccgtggaggagacccagagaccccccaccctgcaggagatcaagcagaagatcgacagctacaacaccagagagaagaactgcctgggcatgaagctgagcgaggacggcacctacaccggcttcatcaaggtgcacctgaagctgagaagacccgtgaccgtgcccgccggcatcagaccccagagcatctacgacgccatcaaggaggtgaacctggccgccaccaccgacaagagaaccagcttctacctgcccctggacgccatcaagcagctgcacatcagcagcaccaccaccgtgagcgaggtgatccagggcctgctgaagaagttcatggtggtggacaacccccagaagttcgccctgttcaagagaatccacaaggacggccaggtgctgttccagaagctgagcatcgccgacagacccctgtacctgagactgctggccggccccgacaccgaggtgctgagcttcgtgctgaaggagaacgagaccggcgaggtggagtgggacgccttcagcatccccgagctgcagaacttcttcctgagcagctggtgcatccagatctacctgtactactag

SEQ ID NO: 12599 - DNA, 555 bp, Artificial Sequence
  Description of Artificial Sequence: Synthetic coding sequence
atgccccagagcaagagcagaaagatcgccatcctgggctacagaagcgtgggcaagagcagcctgaccatccagttcgtggagggccagttcgtggacagctacgaccccaccatcgagaacaccttcaccaagctgatcaccgtgaacggccaggagtaccacctgcagctggtggacaccgccggccaggacgagtacagcatcttcccccagacctacagcatcgacatcaacggctacatcctggtgtacagcgtgaccagcatcaagagcttcgaggtgatcaaggtgatccacggcaagctgctggacatggtgggcaaggtgcagatccccatcatgctggtgggcaacaagaaggacctgcacatggagagagtgatcagctacgaggagggcaaggccctggccgagagctggaacgccgccttcctggagagcagcgccaaggagaaccagaccgccgtggacgtgttcagaagaatcatcctggaggccgagaagatggacggcgccgccagccagggcaagagcagctgcagcgtgatgtag

SEQ ID NO: 12600 - DNA, 582 bp, Artificial Sequence
  Description of Artificial Sequence: Synthetic coding sequence
atggccgccatcagaaagaagctggtgatcgtgggcgacggcgcctgcggcaagacctgcctgctgatcgtgttcagcaaggaccagttccccgaggtgtacgtgcccaccgtgttcgagaactacgtggccgacatcgaggtggacggcaagcaggtggagctggccctgtgggacaccgccggccaggaggactacgacagactgagacccctgagctaccccgacaccgacgtgatcctgatgtgcttcagcatcgacagccccgacagcctggagaacatccccgagaagtggacccccgaggtgaagcacttctgccccaacgtgcccatcatcctggtgggcaacaagaaggacctgagaaacgacgagcacaccagaagagagctggccaagatgaagcaggagcccgtgaagcccgaggagggcagagacatggccaacagaatcggcgccttcggctacatggagtgcagcgccaagaccaaggacggcgtgagagaggtgttcgagatggccaccagagccgccctgcaggccagaagaggcaagaagaagagcggctgcctggtgctgtag

SEQ ID NO: 12601 - DNA, 591 bp, Artificial Sequence
  Description of Artificial Sequence: Synthetic coding sequence
atggccgccatcagaaagaagctggtggtggtgggcgacggcgcctgcggcaagacctgcctgctgatcgtgttcagcaaggacgagttccccgaggtgtacgtgcccaccgtgttcgagaactacgtggccgacatcgaggtggacggcaagcaggtggagctggccctgtgggacaccgccggccaggaggactacgacagactgagacccctgagctaccccgacaccgacgtgatcctgatgtgcttcagcgtggacagccccgacagcctggagaacatccccgagaagtgggtgcccgaggtgaagcacttctgccccaacgtgcccatcatcctggtggccaacaagaaggacctgagaagcgacgagcacgtgagaaccgagctggccagaatgaagcaggagcccgtgagaaccgacgacggcagagccatggccgtgagaatccaggcctacgactacctggagtgcagcgccaagaccaaggagggcgtgagagaggtgttcgagaccgccaccagagccgccctgcagaagagatacggcagccagaacggctgcatcaactgctgcaaggtgctgtag

SEQ ID NO: 12602 - DNA, 582 bp, Artificial Sequence
  Description of Artificial Sequence: Synthetic coding sequence
atggccgccatcagaaagaagctggtgatcgtgggcgacggcgcctgcggcaagacctgcctgctgatcgtgttcagcaaggaccagttccccgaggtgtacgtgcccaccgtgttcgagaactacatcgccgacatcgaggtggacggcaagcaggtggagctggccctgtgggacaccgccggccaggaggactacgacagactgagacccctgagctaccccgacaccgacgtgatcctgatgtgcttcagcatcgacagccccgacagcctggagaacatccccgagaagtggacccccgaggtgaagcacttctgccccaacgtgcccatcatcctggtgggcaacaagaaggacctgagacaggacgagcacaccagaagagagctggccaagatgaagcaggagcccgtgagaagcgaggagggcagagacatggccaacagaatcagcgccttcggctacctggagtgcagcgccaagaccaaggagggcgtgagagaggtgttcgagatggccaccagagccggcctgcaggtgagaaagaacaagagaagaagaggctgccccatcctgtag

SEQ ID NO: 12603 - DNA, 582 bp, Artificial Sequence; identical to SEQ ID NO: 12602
  Description of Artificial Sequence: Synthetic coding sequence

SEQ ID NO: 12604 - DNA, 582 bp, Artificial Sequence; identical to SEQ ID NO: 12602
  Description of Artificial Sequence: Synthetic coding sequence

SEQ ID NO: 12605 - DNA, 582 bp, Artificial Sequence; identical to SEQ ID NO: 12602
  Description of Artificial Sequence: Synthetic coding sequence

SEQ ID NO: 12606 - DNA, 600 bp, Artificial Sequence
  Description of Artificial Sequence: Synthetic coding sequence
atggccgccatcagaaagaagctggtgatcgtgggcgacggcgcctgcggcaagacctgcctgctgatcgtgttcagcaaggaccagttccccgaggtgtacgtgcccaccgtgttcgagaactacatcgccgacatcgaggtggacggcaagcaggtggagctggccctgtgggacaccgccggccaggaggactacgacagactgagacccctgagctaccccgacaccgacgtgatcctgatgtgcttcagcatcgacagccccgacagcctggagaacatccccgagaagtggacccccgaggtgaagcacttctgccccaacgtgcccatcatcctggtgggcaacaagaaggacctgagaaaggccggcacctggagaaccggcagcgtgcccctggccaccctgagcgcccagcccagacccagaagagagtgcggcagatgcctgagatggcccctgggcctggccagcagaagcgccagaaccagcgtgggcggcgccgtgcccttcagcgagatccccaaggccttccccacctgccccctgcccagccagggctacagaaactacccccccaccacccccgccagctag

SEQ ID NO: 12607 - DNA, 582 bp, Artificial Sequence; identical to SEQ ID NO: 12602
  Description of Artificial Sequence: Synthetic coding sequence

SEQ ID NO: 12608 - DNA, 582 bp, Artificial Sequence; identical to SEQ ID NO: 12602
  Description of Artificial Sequence: Synthetic coding sequence

SEQ ID NO: 12609 - DNA, 582 bp, Artificial Sequence; identical to SEQ ID NO: 12602
  Description of Artificial Sequence: Synthetic coding sequence

SEQ ID NO: 12610 - DNA, 279 bp, Artificial Sequence
  Description of Artificial Sequence: Synthetic coding sequence
atggccgccatcagaaagaagctggtgatcgtgggcgacggcgcctgcggcaagacctgcctgctgatcgtgttcagcaaggaccagttccccgaggtgtacgtgcccaccgtgttcgagaactacatcgccgacatcgaggtggacggcaagcaggtggagctggccctgtgggacaccgccggccaggaggactacgacagactgagacccctgagctaccccgacaccgacgtgatcctgatgtgcttcagcatcgacagccccgacagcctgtag

SEQ ID NO: 12611 - DNA, 570 bp, Artificial Sequence
  Description of Artificial Sequence: Synthetic coding sequence
atggccgccatcagaaagaagctggtgatcgtgggcgacggcgcctgcggcaagacctgcctgctgatcgtgttcagcaaggaccagttccccgaggtgtacgtgcccaccgtgttcgagaactacatcgccgacatcgaggtggacggcaagcaggtggagctggccctgtgggacaccgccggccaggaggactacgacagactgagacccctgagctaccccgacaccgacgtgatcctgatgtgcttcagcatcgacagccccgacagcctggagaacatccccgagaagtggacccccgaggtgaagcacttctgccccaacgtgcccatcatcctggtgggcaacaagaaggacctgagacaggacgagcacaccagaagagagctggccaagatgaagcaggagcccgtgagaagcgaggagggcagagacatggccaacagaatcagcgccttcggctacctggagtgcagcgccaagaccaaggagggcgtgagagaggtgttcgagatggccaccagagccggcctgcaggtgagaaagaacaagagaagaagaggctag

SEQ ID NO: 12612 - DNA, 384 bp, Artificial Sequence
  Description of Artificial Sequence: Synthetic coding sequence
atggccgccatcagaaagaagctggtgatcgtgggcgacggcgcctgcggcaagacctgcctgctgatcgtgttcagcaaggaccagttccccgaggtgtacgtgcccaccgtgttcgagaactacatcgccgacatcgaggtggacggcaagcaggtggagctggccctgtgggacaccgccggccaggaggactacgacagactgagacccctgagctaccccgacaccgacgtgatcctgatgtgcttcagcatcgacagccccgacagcctggagaacatccccgagaagtggacccccgaggtgaagcacttctgccccaacgtgcccatcatcctggtgggcaacaagaaggacctgagacaggacgagcacacctag

SEQ ID NO: 12613 - DNA, 690 bp, Artificial Sequence
  Description of Artificial Sequence: Synthetic coding sequence
atggtgagcatcagcggcggcgacctgcccaccggcctggacttcatcagcgcccccgagcccgccctgagcagctgcagcctgggcaccagcgccggctggagccccaccatggccgccatcagaaagaagctggtgatcgtgggcgacggcgcctgcggcaagacctgcctgctgatcgtgttcagcaaggaccagttccccgaggtgtacgtgcccaccgtgttcgagaactacatcgccgacatcgaggtggacggcaagcaggtggagctggccctgtgggacaccgccggccaggaggactacgacagactgagacccctgagctaccccgacaccgacgtgatcctgatgtgcttcagcatcgacagccccgacagcctggagaacatccccgagaagtggacccccgaggtgaagcacttctgccccaacgtgcccatcatcctggtgggcaacaagaaggacctgagacaggacgagcacaccagaagagagctggccaagatgaagcaggagcccgtgagaagcgaggagggcagagacatggccaacagaatcagcgccttcggctacctggagtgcagcgccaagaccaaggagggcgtgagagaggtgttcgagatggccaccagagccggcctgcaggtgagaaagaacaagagaagaagaggctgccccatctag

SEQ ID NO: 12614 - DNA, 510 bp, Artificial Sequence
  Description of Artificial Sequence: Synthetic coding sequence
atggccgccatcagaaagaagctggtgatcgtgggcgacggcgcctgcggcaagacctgcctgctgatcgtgttcagcaaggaccagttccccgaggtgtacgtgcccaccgtgttcgagaactacatcgccgacatcgaggtggacggcaagcaggtggagctggccctgtgggacaccgccggccaggaggactacgacagactgagacccctgagctaccccgacaccgacgtgatcctgatgtgcttcagcatcgacagccccgacagcctggagaacatccccgagaagtggacccccgaggtgaagcacttctgccccaacgtgcccatcatcctggtgggcaacaagaaggacctgagacaggacgagcacaccagaagagagctggccaagatgaagcaggagcccgtgagaagcgaggagggcagagacatggccaacagaatcagcgccttcggctacctggagtgcagcgccaagaccaaggagggcgtgagagagtag

SEQ ID NO: 12615 - DNA, 3144 bp, Artificial Sequence
  Description of Artificial Sequence: Synthetic coding sequence
atgatggccgccgaggccggcagcgaggagggcggccccgtgaccgccggcgccggcggcggcggcgccgccgccggcagcagcgcctaccccgccgtgtgcagagtgaagatccccgccgccctgcccgtggccgccgccccctaccccggcctggtggagaccggcgtggccggcaccctgggcggcggcgccgccctgggcagcgagttcctgggcgccggcagcgtggccggcgccctgggcggcgccggcctgaccggcggcggcaccgccgccggcgtggccggcgccgccgccggcgtggccggcgccgccgtggccggccccagcggcgacatggccctgaccaagctgcccaccagcctgctggccgagaccctgggccccggcggcggcttcccccccctgcccccccccccctacctgccccccctgggcgccggcctgggcaccgtggacgagggcgacagcctggacggccccgagtacgaggaggaggaggtggccatccccctgaccgccccccccaccaaccagtggtaccacggcaagctggacagaaccatcgccgaggagagactgagacaggccggcaagagcggcagctacctgatcagagagagcgacagaagacccggcagcttcgtgctgagcttcctgagccagatgaacgtggtgaaccacttcagaatcatcgccatgtgcggcgactactacatcggcggcagaagattcagcagcctgagcgacctgatcggctactacagccacgtgagctgcctgctgaagggcgagaagctgctgtaccccgtggccccccccgagcccgtggaggacagaagaagagtgagagccatcctgccctacaccaaggtgcccgacaccgacgagatcagcttcctgaagggcgacatgttcatcgtgcacaacgagctggaggacggctggatgtgggtgaccaacctgagaaccgacgagcagggcctgatcgtggaggacctggtggaggaggtgggcagagaggaggacccccacgagggcaagatctggttccacggcaagatcagcaagcaggaggcctacaacctgctgatgaccgtgggccaggtgtgcagcttcctggtgagacccagcgacaacacccccggcgactacagcctgtacttcagaaccaacgagaacatccagagattcaagatctgccccacccccaacaaccagttcatgatgggcggcagatactacaacagcatcggcgacatcatcgaccactacagaaaggagcagatcgtggagggctactacctgaaggagcccgtgcccatgcaggaccaggagcaggtgctgaacgacaccgtggacggcaaggagatctacaacaccatcagaagaaagaccaaggacgccttctacaagaacatcgtgaagaagggctacctgctgaagaagggcaagggcaagagatggaagaacctgtacttcatcctggagggcagcgacgcccagctgatctacttcgagagcgagaagagagccaccaagcccaagggcctgatcgacctgagcgtgtgcagcgtgtacgtggtgcacgacagcctgttcggcagacccaactgcttccagatcgtggtgcagcacttcagcgaggagcactacatcttctacttcgccggcgagacccccgagcaggccgaggactggatgaagggcctgcaggccttctgcaacctgagaaagagcagccccggcaccagcaacaagagactgagacaggtgagcagcctggtgctgcacatcgaggaggcccacaagctgcccgtgaagcacttcaccaacccctactgcaacatctacctgaacagcgtgcaggtggccaagacccacgccagagagggccagaaccccgtgtggagcgaggagttcgtgttcgacgacctgccccccgacatcaacagattcgagatcaccctgagcaacaagaccaagaagagcaaggaccccgacatcctgttcatgagatgccagctgagcagactgcagaagggccacgccaccgacgagtggttcctgctgagcagccacatccccctgaagggcatcgagcccggcagcctgagagtgagagccagatacagcatggagaagatcatgcccgaggaggagtacagcgagttcaaggagctgatcctgcagaaggagctgcacgtggtgtacgccctgagccacgtgtgcggccaggacagaaccctgctggccagcatcctgctgagaatcttcctgcacgagaagctggagagcctgctgctgtgcaccctgaacgacagagagatcagcatggaggacgaggccaccaccctgttcagagccaccaccctggccagcaccctgatggagcagtacatgaaggccaccgccacccagttcgtgcaccacgccctgaaggacagcatcctgaagatcatggagagcaagcagagctgcgagctgagccccagcaagctggagaagaacgaggacgtgaacaccaacctgacccacctgctgaacatcctgagcgagctggtggagaagatcttcatggccagcgagatcctgccccccaccctgagatacatctacggctgcctgcagaagagcgtgcagcacaagtggcccaccaacaccaccatgagaaccagagtggtgagcggcttcgtgttcctgagactgatctgccccgccatcctgaaccccagaatgttcaacatcatcagcgacagccccagccccatcgccgccagaaccctgatcctggtggccaagagcgtgcagaacctggccaacctggtggagttcggcgccaaggagccctacatggagggcgtgaaccccttcatcaagagcaacaagcacagaatgatcatgttcctggacgagctgggcaacgtgcccgagctgcccgacaccaccgagcacagcagaaccgacctgagcagagacctggccgccctgcacgagatctgcgtggcccacagcgacgagctgagaaccctgagcaacgagagaggcgcccagcagcacgtgctgaagaagctgctggccatcaccgagctgctgcagcagaagcagaaccagtacaccaagaccaacgacgtgagatag

SEQ ID NO: 12616 - DNA, 2613 bp, Artificial Sequence
  Description of Artificial Sequence: Synthetic coding sequence
atgaagggctggtaccacggcaagctggacagaaccatcgccgaggagagactgagacaggccggcaagagcggcagctacctgatcagagagagcgacagaagacccggcagcttcgtgctgagcttcctgagccagatgaacgtggtgaaccacttcagaatcatcgccatgtgcggcgactactacatcggcggcagaagattcagcagcctgagcgacctgatcggctactacagccacgtgagctgcctgctgaagggcgagaagctgctgtaccccgtggccccccccgagcccgtggaggacagaagaagagtgagagccatcctgccctacaccaaggtgcccgacaccgacgagatcagcttcctgaagggcgacatgttcatcgtgcacaacgagctggaggacggctggatgtgggtgaccaacctgagaaccgacgagcagggcctgatcgtggaggacctggtggaggaggtgggcagagaggaggacccccacgagggcaagatctggttccacggcaagatcagcaagcaggaggcctacaacctgctgatgaccgtgggccaggtgtgcagcttcctggtgagacccagcgacaacacccccggcgactacagcctgtacttcagaaccaacgagaacatccagagattcaagatctgccccacccccaacaaccagttcatgatgggcggcagatactacaacagcatcggcgacatcatcgaccactacagaaaggagcagatcgtggagggctactacctgaaggagcccgtgcccatgcaggaccaggagcaggtgctgaacgacaccgtggacggcaaggagatctacaacaccatcagaagaaagaccaaggacgccttctacaagaacatcgtgaagaagggctacctgctgaagaagggcaagggcaagagatggaagaacctgtacttcatcctggagggcagcgacgcccagctgatctacttcgagagcgagaagagagccaccaagcccaagggcctgatcgacctgagcgtgtgcagcgtgtacgtggtgcacgacagcctgttcggcagacccaactgcttccagatcgtggtgcagcacttcagcgaggagcactacatcttctacttcgccggcgagacccccgagcaggccgaggactggatgaagggcctgcaggccttctgcaacctgagaaagagcagccccggcaccagcaacaagagactgagacaggtgagcagcctggtgctgcacatcgaggaggcccacaagctgcccgtgaagcacttcaccaacccctactgcaacatctacctgaacagcgtgcaggtggccaagacccacgccagagagggccagaaccccgtgtggagcgaggagttcgtgttcgacgacctgccccccgacatcaacagattcgagatcaccctgagcaacaagaccaagaagagcaaggaccccgacatcctgttcatgagatgccagctgagcagactgcagaagggccacgccaccgacgagtggttcctgctgagcagccacatccccctgaagggcatcgagcccggcagcctgagagtgagagccagatacagcatggagaagatcatgcccgaggaggagtacagcgagttcaaggagctgatcctgcagaaggagctgcacgtggtgtacgccctgagccacgtgtgcggccaggacagaaccctgctggccagcatcctgctgagaatcttcctgcacgagaagctggagagcctgctgctgtgcaccctgaacgacagagagatcagcatggaggacgaggccaccaccctgttcagagccaccaccctggccagcaccctgatggagcagtacatgaaggccaccgccacccagttcgtgcaccacgccctgaaggacagcatcctgaagatcatggagagcaagcagagctgcgagctgagccccagcaagctggagaagaacgaggacgtgaacaccaacctgacccacctgctgaacatcctgagcgagctggtggagaagatcttcatggccagcgagatcctgccccccaccctgagatacatctacggctgcctgcagaagagcgtgcagcacaagtggcccaccaacaccaccatgagaaccagagtggtgagcggcttcgtgttcctgagactgatctgccccgccatcctgaaccccagaatgttcaacatcatcagcgacagccccagccccatcgccgccagaaccctgatcctggtggccaagagcgtgcagaacctggccaacctggtggagttcggcgccaaggagccctacatggagggcgtgaaccccttcatcaagagcaacaagcacagaatgatcatgttcctggacgagctgggcaacgtgcccgagctgcccgacaccaccgagcacagcagaaccgacctgagcagagacctggccgccctgcacgagatctgcgtggcccacagcgacgagctgagaaccctgagcaacgagagaggcgcccagcagcacgtgctgaagaagctgctggccatcaccgagctgctgcagcagaagcagaaccagtacaccaagaccaacgacgtgagatag

SEQ ID NO: 12617 - DNA, 2646 bp, Artificial Sequence
  Description of Artificial Sequence: Synthetic coding sequence
atgtgcctggtgaagagctggttcctgagcatcagaagcagatggtaccacggcaagctggacagaaccatcgccgaggagagactgagacaggccggcaagagcggcagctacctgatcagagagagcgacagaagacccggcagcttcgtgctgagcttcctgagccagatgaacgtggtgaaccacttcagaatcatcgccatgtgcggcgactactacatcggcggcagaagattcagcagcctgagcgacctgatcggctactacagccacgtgagctgcctgctgaagggcgagaagctgctgtaccccgtggccccccccgagcccgtggaggacagaagaagagtgagagccatcctgccctacaccaaggtgcccgacaccgacgagatcagcttcctgaagggcgacatgttcatcgtgcacaacgagctggaggacggctggatgtgggtgaccaacctgagaaccgacgagcagggcctgatcgtggaggacctggtggaggaggtgggcagagaggaggacccccacgagggcaagatctggttccacggcaagatcagcaagcaggaggcctacaacctgctgatgaccgtgggccaggtgtgcagcttcctggtgagacccagcgacaacacccccggcgactacagcctgtacttcagaaccaacgagaacatccagagattcaagatctgccccacccccaacaaccagttcatgatgggcggcagatactacaacagcatcggcgacatcatcgaccactacagaaaggagcagatcgtggagggctactacctgaaggagcccgtgcccatgcaggaccaggagcaggtgctgaacgacaccgtggacggcaaggagatctacaacaccatcagaagaaagaccaaggacgccttctacaagaacatcgtgaagaagggctacctgctgaagaagggcaagggcaagagatggaagaacctgtacttcatcctggagggcagcgacgcccagctgatctacttcgagagcgagaagagagccaccaagcccaagggcctgatcgacctgagcgtgtgcagcgtgtacgtggtgcacgacagcctgttcggcagacccaactgcttccagatcgtggtgcagcacttcagcgaggagcactacatcttctacttcgccggcgagacccccgagcaggccgaggactggatgaagggcctgcaggccttctgcaacctgagaaagagcagccccggcaccagcaacaagagactgagacaggtgagcagcctggtgctgcacatcgaggaggcccacaagctgcccgtgaagcacttcaccaacccctactgcaacatctacctgaacagcgtgcaggtggccaagacccacgccagagagggccagaaccccgtgtggagcgaggagttcgtgttcgacgacctgccccccgacatcaacagattcgagatcaccctgagcaacaagaccaagaagagcaaggaccccgacatcctgttcatgagatgccagctgagcagactgcagaagggccacgccaccgacgagtggttcctgctgagcagccacatccccctgaagggcatcgagcccggcagcctgagagtgagagccagatacagcatggagaagatcatgcccgaggaggagtacagcgagttcaaggagctgatcctgcagaaggagctgcacgtggtgtacgccctgagccacgtgtgcggccaggacagaaccctgctggccagcatcctgctgagaatcttcctgcacgagaagctggagagcctgctgctgtgcaccctgaacgacagagagatcagcatggaggacgaggccaccaccctgttcagagccaccaccctggccagcaccctgatggagcagtacatgaaggccaccgccacccagttcgtgcaccacgccctgaaggacagcatcctgaagatcatggagagcaagcagagctgcgagctgagccccagcaagctggagaagaacgaggacgtgaacaccaacctgacccacctgctgaacatcctgagcgagctggtggagaagatcttcatggccagcgagatcctgccccccaccctgagatacatctacggctgcctgcagaagagcgtgcagcacaagtggcccaccaacaccaccatgagaaccagagtggtgagcggcttcgtgttcctgagactgatctgccccgccatcctgaaccccagaatgttcaacatcatcagcgacagccccagccccatcgccgccagaaccctgatcctggtggccaagagcgtgcagaacctggccaacctggtggagttcggcgccaaggagccctacatggagggcgtgaaccccttcatcaagagcaacaagcacagaatgatcatgttcctggacgagctgggcaacgtgcccgagctgcccgacaccaccgagcacagcagaaccgacctgagcagagacctggccgccctgcacgagatctgcgtggcccacagcgacgagctgagaaccctgagcaacgagagaggcgcccagcagcacgtgctgaagaagctgctggccatcaccgagctgctgcagcagaagcagaaccagtacaccaagaccaacgacgtgagatag

SEQ ID NO: 12618 - DNA, 2643 bp, Artificial Sequence
  Description of Artificial Sequence: Synthetic coding sequence
atgagaaccggctacagcagcgtgcccagcaagctgagatggtaccacggcaagctggacagaaccatcgccgaggagagactgagacaggccggcaagagcggcagctacctgatcagagagagcgacagaagacccggcagcttcgtgctgagcttcctgagccagatgaacgtggtgaaccacttcagaatcatcgccatgtgcggcgactactacatcggcggcagaagattcagcagcctgagcgacctgatcggctactacagccacgtgagctgcctgctgaagggcgagaagctgctgtaccccgtggccccccccgagcccgtggaggacagaagaagagtgagagccatcctgccctacaccaaggtgcccgacaccgacgagatcagcttcctgaagggcgacatgttcatcgtgcacaacgagctggaggacggctggatgtgggtgaccaacctgagaaccgacgagcagggcctgatcgtggaggacctggtggaggaggtgggcagagaggaggacccccacgagggcaagatctggttccacggcaagatcagcaagcaggaggcctacaacctgctgatgaccgtgggccaggtgtgcagcttcctggtgagacccagcgacaacacccccggcgactacagcctgtacttcagaaccaacgagaacatccagagattcaagatctgccccacccccaacaaccagttcatgatgggcggcagatactacaacagcatcggcgacatcatcgaccactacagaaaggagcagatcgtggagggctactacctgaaggagcccgtgcccatgcaggaccaggagcaggtgctgaacgacaccgtggacggcaaggagatctacaacaccatcagaagaaagaccaaggacgccttctacaagaacatcgtgaagaagggctacctgctgaagaagggcaagggcaagagatggaagaacctgtacttcatcctggagggcagcgacgcccagctgatctacttcgagagcgagaagagagccaccaagcccaagggcctgatcgacctgagcgtgtgcagcgtgtacgtggtgcacgacagcctgttcggcagacccaactgcttccagatcgtggtgcagcacttcagcgaggagcactacatcttctacttcgccggcgagacccccgagcaggccgaggactggatgaagggcctgcaggccttctgcaacctgagaaagagcagccccggcaccagcaacaagagactgagacaggtgagcagcctggtgctgcacatcgaggaggcccacaagctgcccgtgaagcacttcaccaacccctactgcaacatctacctgaacagcgtgcaggtggccaagacccacgccagagagggccagaaccccgtgtggagcgaggagttcgtgttcgacgacctgccccccgacatcaacagattcgagatcaccctgagcaacaagaccaagaagagcaaggaccccgacatcctgttcatgagatgccagctgagcagactgcagaagggccacgccaccgacgagtggttcctgctgagcagccacatccccctgaagggcatcgagcccggcagcctgagagtgagagccagatacagcatggagaagatcatgcccgaggaggagtacagcgagttcaaggagctgatcctgcagaaggagctgcacgtggtgtacgccctgagccacgtgtgcggccaggacagaaccctgctggccagcatcctgctgagaatcttcctgcacgagaagctggagagcctgctgctgtgcaccctgaacgacagagagatcagcatggaggacgaggccaccaccctgttcagagccaccaccctggccagcaccctgatggagcagtacatgaaggccaccgccacccagttcgtgcaccacgccctgaaggacagcatcctgaagatcatggagagcaagcagagctgcgagctgagccccagcaagctggagaagaacgaggacgtgaacaccaacctgacccacctgctgaacatcctgagcgagctggtggagaagatcttcatggccagcgagatcctgccccccaccctgagatacatctacggctgcctgcagaagagcgtgcagcacaagtggcccaccaacaccaccatgagaaccagagtggtgagcggcttcgtgttcctgagactgatctgccccgccatcctgaaccccagaatgttcaacatcatcagcgacagccccagccccatcgccgccagaaccctgatcctggtggccaagagcgtgcagaacctggccaacctggtggagttcggcgccaaggagccctacatggagggcgtgaaccccttcatcaagagcaacaagcacagaatgatcatgttcctggacgagctgggcaacgtgcccgagctgcccgacaccaccgagcacagcagaaccgacctgagcagagacctggccgccctgcacgagatctgcgtggcccacagcgacgagctgagaaccctgagcaacgagagaggcgcccagcagcacgtgctgaagaagctgctggccatcaccgagctgctgcagcagaagcagaaccagtacaccaagaccaacgacgtgagatag

SEQ ID NO: 12619 - DNA, 2616 bp, Artificial Sequence
  Description of Artificial Sequence: Synthetic coding sequence
agaggcgacgccagcggctggggctgcagcgagcccggccccggcggcccctggggcagcagagccggcagagtgggccagagcagagccggcttcaacatgatggccgccgaggccggcagcgaggagggcggccccgtgaccgccggcgccggcggcggcggcgccgccgccggcagcagcgcctaccccgccgtgtgcagagtgaagatccccgccgccctgcccgtggccgccgccccctaccccggcctggtggagaccggcgtggccggcaccctgggcggcggcgccgccctgggcagcgagttcctgggcgccggcagcgtggccggcgccctgggcggcgccggcctgaccggcggcggcaccgccgccggcgtggccggcgccgccgccggcgtggccggcgccgccgtggccggccccagcggcgacatggccctgaccaagctgcccaccagcctgctggccgagaccctgggccccggcggcggcttcccccccctgcccccccccccctacctgccccccctgggcgccggcctgggcaccgtggacgagggcgacagcctggacggccccgagtacgaggaggaggaggtggccatccccctgaccgccccccccaccaaccagtggtaccacggcaagctggacagaaccatcgccgaggagagactgagacaggccggcaagagcggcagctacctgatcagagagagcgacagaagacccggcagcttcgtgctgagcttcctgagccagatgaacgtggtgaaccacttcagaatcatcgccatgtgcggcgactactacatcggcggcagaagattcagcagcctgagcgacctgatcggctactacagccacgtgagctgcctgctgaagggcgagaagctgctgtaccccgtggccccccccgagcccgtggaggacagaagaagagtgagagccatcctgccctacaccaaggtgcccgacaccgacgagatcagcttcctgaagggcgacatgttcatcgtgcacaacgagctggaggacggctggatgtgggtgaccaacctgagaaccgacgagcagggcctgatcgtggaggacctggtggaggaggtgggcagagaggaggacccccacgagggcaagatctggttccacggcaagatcagcaagcaggaggcctacaacctgctgatgaccgtgggccaggtgtgcagcttcctggtgagacccagcgacaacacccccggcgactacagcctgtacttcagaaccaacgagaacatccagagattcaagatctgccccacccccaacaaccagttcatgatgggcggcagatactacaacagcatcggcgacatcatcgaccactacagaaaggagcagatcgtggagggctactacctgaaggagcccgtgcccatgcaggaccaggagcaggtgctgaacgacaccgtggacggcaaggagatctacaacaccatcagaagaaagaccaaggacgccttctacaagaacatcgtgaagaagggctacctgctgaagaagggcaagggcaagagatggaagaacctgtacttcatcctggagggcagcgacgcccagctgatctacttcgagagcgagaagagagccaccaagcccaagggcctgatcgacctgagcgtgtgcagcgtgtacgtggtgcacgacagcctgttcggcagacccaactgcttccagatcgtggtgcagcacttcagcgaggagcactacatcttctacttcgccggcgagacccccgagcaggccgaggactggatgaagggcctgcaggccttctgcaacctgagaaagagcagccccggcaccagcaacaagagactgagacaggtgagcagcctggtgctgcacatcgaggaggcccacaagctgcccgtgaagcacttcaccaacccctactgcaacatctacctgaacagcgtgcaggtggccaagacccacgccagagagggccagaaccccgtgtggagcgaggagttcgtgttcgacgacctgccccccgacatcaacagattcgagatcaccctgagcaacaagaccaagaagagcaaggaccccgacatcctgttcatgagatgccagctgagcagactgcagaagggccacgccaccgacgagtggttcctgctgagcagccacatccccctgaagggcatcgagcccggcagcctgagagtgagagccagatacagcatggagaagatcatgcccgaggaggagtacagcgagttcaaggagctgatcctgcagaaggagctgcacgtggtgtacgccctgagccacgtgtgcggccaggacagaaccctgctggccagcatcctgctgagaatcttcctgcacgagaagctggagagcctgctgctgtgcaccctgaacgacagagagatcagcatggaggacgaggccaccaccctgttcagagccaccaccctggccagcaccctgatggagcagtacatgaaggccaccgccacccagttcgtgcaccacgccctgaaggacagcatcctgaagatcatggagagcaagcagagctgcgagctgagcagcagcaagctgcagaaggcctag

SEQ ID NO: 12620 - DNA, 1161 bp, Artificial Sequence
  Description of Artificial Sequence: Synthetic coding sequence
atgaacccccagatcagaaaccccatggagagaatgtacagagacaccttctacgacaacttcgagaacgagcccatcctgtacggcagaagctacacctggctgtgctacgaggtgaagatcaagagaggcagaagcaacctgctgtgggacaccggcgtgttcagaggccccgtgctgcccaagagacagagcaaccacagacaggaggtgtacttcagattcgagaaccacgccgagatgtgcttcctgagctggttctgcggcaacagactgcccgccaacagaagattccagatcacctggttcgtgagctggaacccctgcctgccctgcgtggtgaaggtgaccaagttcctggccgagcaccccaacgtgaccctgaccatcagcgccgccagactgtactactacagagacagagactggagatgggtgctgctgagactgcacaaggccggcgccagagtgaagatcatggactacgaggacttcgcctactgctgggagaacttcgtgtgcaacgagggccagcccttcatgccctggtacaagttcgacgacaactacgccagcctgcacagaaccctgaaggagatcctgagaaaccccatggaggccatgtacccccacatcttctacttccacttcaagaacctgctgaaggcctgcggcagaaacgagagctggctgtgcttcaccatggaggtgaccaagcaccacagcgccgtgttcagaaagagaggcgtgttcagaaaccaggtggaccccgagacccactgccacgccgagagatgcttcctgagctggttctgcgacgacatcctgagccccaacaccaactacgaggtgacctggtacaccagctggagcccctgccccgagtgcgccggcgaggtggccgagttcctggccagacacagcaacgtgaacctgaccatcttcaccgccagactgtgctacttctgggacaccgactaccaggagggcctgtgcagcctgagccaggagggcgccagcgtgaagatcatgggctacaaggacttcgtgagctgctggaagaacttcgtgtacagcgacgacgagcccttcaagccctggaagggcctgcagaccaacttcagactgctgaagagaagactgagagagatcctgcagtag

SEQ ID NO: 12621 - DNA, 348 bp, Artificial Sequence
  Description of Artificial Sequence: Synthetic coding sequence
atgggcggcagcctgagagtggccgtgctgggcgcccccggcgtgggcaagaccgccatcatcagacagttcctgttcggcgactaccccgagagacacagacccaccgacggccccagactgtacagacccgccgtgctgctggacggcgccgtgtacgacctgagcatcagagacggcgacgtggccggccccggcagcagccccggcggccccgaggagtggcccgacgccaaggactggagcctgcaggacaccgacgccttcgtgctggtgtacgacatctgcagccccgacagcttcgactacgtgaaggccctgagacagagaatcgccgagaccagatag

SEQ ID NO: 12622 - DNA, 579 bp, Artificial Sequence
  Description of Artificial Sequence: Synthetic coding sequence
atgcaggccatcaagtgcgtggtggtgggcgacggcgccgtgggcaagacctgcctgctgatcagctacaccaccaacgccttccccggcgagtacatccccaccgtgttcgacaactacagcgccaacgtgatggtggacggcaagcccgtgaacctgggcctgtgggacaccgccggccaggaggactacgacagactgagacccctgagctacccccagaccgacgtgttcctgatctgcttcagcctggtgagccccgccagcttcgagaacgtgagagccaagtggtaccccgaggtgagacaccactgccccaacacccccatcatcctggtgggcaccaagctggacctgagagacgacaaggacaccatcgagaagctgaaggagaagaagctgacccccatcacctacccccagggcctggccatggccaaggagatcggcgccgtgaagtacctggagtgcagcgccctgacccagagaggcctgaagaccgtgttcgacgaggccatcagagccgtgctgtgccccccccccgtgaagaagagaaagagaaagtgcctgctgctgtag

SEQ ID NO: 12623 - DNA, 636 bp, Artificial Sequence
  Description of Artificial Sequence: Synthetic coding sequence
atgcaggccatcaagtgcgtggtggtgggcgacggcgccgtgggcaagacctgcctgctgatcagctacaccaccaacgccttccccggcgagtacatccccaccgtgttcgacaactacagcgccaacgtgatggtggacggcaagcccgtgaacctgggcctgtgggacaccgccggccaggaggactacgacagactgagacccctgagctacccccagaccgtgggcgagacctacggcaaggacatcaccagcagaggcaaggacaagcccatcgccgacgtgttcctgatctgcttcagcctggtgagccccgccagcttcgagaacgtgagagccaagtggtaccccgaggtgagacaccactgccccaacacccccatcatcctggtgggcaccaagctggacctgagagacgacaaggacaccatcgagaagctgaaggagaagaagctgacccccatcacctacccccagggcctggccatggccaaggagatcggcgccgtgaagtacctggagtgcagcgccctgacccagagaggcctgaagaccgtgttcgacgaggccatcagagccgtgctgtgccccccccccgtgaagaagagaaagagaaagtgcctgctgctgtag

SEQ ID NO: 12624 - DNA, 579 bp, Artificial Sequence
  Description of Artificial Sequence: Synthetic coding sequence
atgcaggccatcaagtgcgtggtggtgggcgacggcgccgtgggcaagacctgcctgctgatcagctacaccaccaacgccttccccggcgagtacatccccaccgtgttcgacaactacagcgccaacgtgatggtggacagcaagcccgtgaacctgggcctgtgggacaccgccggccaggaggactacgacagactgagacccctgagctacccccagaccgacgtgttcctgatctgcttcagcctggtgagccccgccagctacgagaacgtgagagccaagtggttccccgaggtgagacaccactgccccagcacccccatcatcctggtgggcaccaagctggacctgagagacgacaaggacaccatcgagaagctgaaggagaagaagctggcccccatcacctacccccagggcctggccctggccaaggagatcgacagcgtgaagtacctggagtgcagcgccctgacccagagaggcctgaagaccgtgttcgacgaggccatcagagccgtgctgtgcccccagcccaccagacagcagaagagagcctgcagcctgctgtag

SEQ ID NO: 12625 - DNA, 261 bp, Artificial Sequence
  Description of Artificial Sequence: Synthetic coding sequence
atgcaggccatcaagtgcgtggtggtgggcgacggcgccgtgggcaagacctgcctgctgatcagctacaccaccaacgccttccccggcgagtacatccccaccgtgcccggcagaccctgcgccctgctgcaggacgccgaggccggcctgagcagcgacgtggagggcgcctgctggtgccagacccaggagggcagaatgaccggcgaggcccccgcccccccctggcccgccctgagaggcccccaccacagctag

SEQ ID NO: 12626 - DNA, 558 bp, Artificial Sequence
  Description of Artificial Sequence: Synthetic coding sequence
atgcaggccatcaaggccgtgggcaagacctgcctgctgatcagctacaccaccaacgccttccccggcgagtacatccccaccgtgttcgacaactacagcgccaacgtgatggtggacagcaagcccgtgaacctgggcctgtgggacaccgccggccaggaggactacgacagactgagacccctgagctacccccagaccgacgtgttcctgatctgcttcagcctggtgagccccgccagctacgagaacgtgagagccaagtggttccccgaggtgagacaccactgccccagcacccccatcatcctggtgggcaccaagctggacctgagagacgacaaggacaccatcgagaagctgaaggagaagaagctggcccccatcacctacccccagggcctggccctggccaaggagatcgacagcgtgaagtacctggagtgcagcgccctgacccagagaggcctgaagaccgtgttcgacgaggccatcagagccgtgctgtgcccccagcccaccagacagcagaagagagcctgcagcctgctgtag

SEQ ID NO: 12627 - DNA, 447 bp, Artificial Sequence
  Description of Artificial Sequence: Synthetic coding sequence
atggtggacagcaagcccgtgaacctgggcctgtgggacaccgccggccaggaggactacgacagactgagacccctgagctacccccagaccgacgtgttcctgatctgcttcagcctggtgagccccgccagctacgagaacgtgagagccaagtggttccccgaggtgagacaccactgccccagcacccccatcatcctggtgggcaccaagctggacctgagagacgacaaggacaccatcgagaagctgaaggagaagaagctggcccccatcacctacccccagggcctggccctggccaaggagatcgacagcgtgaagtacctggagtgcagcgccctgacccagagaggcctgaagaccgtgttcgacgaggccatcagagccgtgctgtgcccccagcccaccagacagcagaagagagcctgcagcctgctgtag

SEQ ID NO: 12628 - DNA, 501 bp, Artificial Sequence
  Description of Artificial Sequence: Synthetic coding sequence
atgcaggccatcaagtgcgtggtggtgggcgacggcgccgtgggcaagacctgcctgctgatcagctacaccaccaacgccttccccggcgagtacatccccaccgtgttcgacaactacagcgccaacgtgatggtggacagcaagcccgtgaacctgggcctgtgggacaccgccggccaggaggactacgacagactgagacccctgagctacccccagaccgacgtgttcctgatctgcttcagcctggtgagccccgccagctacgagaacgtgagagccaagtggttccccgaggtgagacaccactgccccagcacccccatcatcctggtgggcaccaagctggacctgagagacgacaaggacaccatcgagaagctgaaggagaagaagctggcccccatcacctacccccagggcctggccctggccaaggagatcgacagcgtgaagtacctggagtgcagcgccctgacccagagaggcctgaagtag

SEQ ID NO: 12629 - DNA, 4785 bp, Artificial Sequence
  Description of Artificial Sequence: Synthetic coding sequence
atgaagctgtacgtgttcctggtgaacaccggcaccaccctgaccttcgacaccgagctgaccgtgcagaccgtggccgacctgaagcacgccatccagagcaagtacaagatcgccatccagcaccaggtgctggtggtgaacggcggcgagtgcatggccgccgacagaagagtgtgcacctacagcgccggcaccgacaccaaccccatcttcctgttcaacaaggagatgatcctgtgcgacagaccccccgccatccccaagaccaccttcagcaccgagaacgacatggagatcaaggtggaggagagcctgatgatgcccgccgtgttccacaccgtggccagcagaacccagctggccctggagatgtacgaggtggccaagaagctgtgcagcttctgcgagggcctggtgcacgacgagcacctgcagcaccagggctgggccgccatcatggccaacctggaggactgcagcaacagctaccagaagctgctgttcaagttcgagagcatctacagcaactacctgcagagcatcgaggacatcaagctgaagctgacccacctgggcaccgccgtgagcgtgatggccaagatccccctgctggagtgcctgaccagacacagctacagagagtgcctgggcagactggacagcctgcccgagcacgaggacagcgagaaggccgagatgaagagaagcaccgagctggtgctgagccccgacatgcccagaaccaccaacgagagcctgctgaccagcttccccaagagcgtggagcacgtgagccccgacaccgccgacgccgagagcggcaaggagatcagagagagctgccagagcaccgtgcaccagcaggacgagaccaccatcgacaccaaggacggcgacctgcccttcttcaacgtgagcctgctggactggatcaacgtgcaggacagacccaacgacgtggagagcctggtgagaaagtgcttcgacagcatgagcagactggaccccagaatcatcagacccttcatcgccgagtgcagacagaccatcgccaagctggacaaccagaacatgaaggccatcaagggcctggaggacagactgtacgccctggaccagatgatcgccagctgcggcagactggtgaacgagcagaaggagctggcccagggcttcctggccaaccagaagagagccgagaacctgaaggacgccagcgtgctgcccgacctgtgcctgagccacgccaaccagctgatgatcatgctgcagaaccacagaaagctgctggacatcaagcagaagtgcaccaccgccaagcaggagctggccaacaacctgcacgtgagactgaagtggtgctgcttcgtgatgctgcacgccgaccaggacggcgagaagctgcaggccctgctgagactggtgatcgagctgctggagagagtgaagatcgtggaggccctgagcaccgtgccccagatgtactgcctggccgtggtggaggtggtgagaagaaagatgttcatcaagcactacagagagtgggccggcgccctggtgaaggacggcaagagactgtacgaggccgagaagagcaagagagagagcttcggcaagctgttcagaaagagcttcctgagaaacagactgttcagaggcctggacagctggccccccagcttctgcacccagaagcccagaaagttcgactgcgagctgcccgacatcagcctgaaggacctgcagttcctgcagagcttctgccccagcgaggtgcagcccttcctgagagtgcccctgctgtgcgacttcgagcccctgcaccagcacgtgctggccctgcacaacctggtgaaggccgcccagagcctggacgagatgagccagaccatcaccgacctgctgagcgagcagaaggccagcgtgagccagaccagcccccagagcgccagcagccccagaatggagagcaccgccggcatcaccaccaccaccagccccagaacccccccccccctgaccgtgcaggaccccctgtgccccgccgtgtgccccctggaggagctgagccccgacagcatcgacgcccacaccttcgacttcgagaccatcccccaccccaacatcgagcagaccatccaccaggtgagcctggacctggacagcctggccgagagccccgagagcgacttcatgagcgccgtgaacgagttcgtgatcgaggagaacctgagcagccccaaccccatcagcgacccccagagccccgagatgatggtggagagcctgtacagcagcgtgatcaacgccatcgacagcagaagaatgcaggacaccaacgtgtgcggcaaggaggacttcggcgaccacaccagcctgaacgtgcagctggagagatgcagagtggtggcccaggacagccacttcagcatccagaccatcaaggaggacctgtgccacttcagaaccttcgtgcagaaggagcagtgcgacttcagcaacagcctgaagtgcaccgccgtggagatcagaaacatcatcgagaaggtgaagtgcagcctggagatcaccctgaaggagaagcaccagaaggagctgctgagcctgaagaacgagtacgagggcaagctggacggcctgatcaaggagaccgaggagaacgagaacaagatcaagaagctgaagggcgagctggtgtgcctggaggaggtgctgcagaacaaggacaacgagttcgccctggtgaagcacgagaaggaggccgtgatctgcctgcagaacgagaaggaccagaagctgctggagatggagaacatcatgcacagccagaactgcgagatcaaggagctgaagcagagcagagagatcgtgctggaggacctgaagaagctgcacgtggagaacgacgagaagctgcagctgctgagagccgagctgcagagcctggagcagagccacctgaaggagctggaggacaccctgcaggtgagacacatccaggagttcgagaaggtgatgaccgaccacagagtgagcctggaggagctgaagaaggagaaccagcagatcatcaaccagatccaggagagccacgccgagatcatccaggagaaggagaagcagctgcaggagctgaagctgaaggtgagcgacctgagcgacaccagatgcaagctggaggtggagctggccctgaaggaggccgagaccgacgagatcaagatcctgctggaggagagcagagcccagcagaaggagaccctgaagagcctgctggagcaggagaccgagaacctgagaaccgagatcagcaagctgaaccagaagatccaggacaacaacgagaactaccaggtgggcctggccgagctgagaaccctgatgaccatcgagaaggaccagtgcatcagcgagctgatcagcagacacgaggaggagagcaacatcctgaaggccgagctgaacaaggtgaccagcctgcacaaccaggccttcgagatcgagaagaacctgaaggagcagatcatcgagctgcagagcaagctggacagcgagctgagcgccctggagagacagaaggacgagaagatcacccagcaggaggagaagtacgaggccatcatccagaacctggagaaggacagacagaagctggtgagcagccaggagcaggacagagagcagctgatccagaagctgaactgcgagaaggacgaggccatccagaccgccctgaaggagttcaagctggagagagaggtggtggagaaggagctgctggagaaggtgaagcacctggagaaccagatcgccaagagccccgccatcgacagcaccagaggcgacagcagcagcctggtggccgagctgcaggagaagctgcaggaggagaaggccaagttcctggagcagctggaggagcaggagaagagaaagaacgaggagatgcagaacgtgagaaccagcctgatcgccgagcagcagaccaacttcaacaccgtgctgaccagagagaagatgagaaaggagaacatcatcaacgacctgagcgacaagctgaagagcaccatgcagcagcaggagagagacaaggacctgatcgagagcctgagcgaggacagagccagactgctggaggagaagaagaagctggaggaggaggtgagcaagctgagaagcagcagcttcgtgcccagcccctacgtggccaccgcccccgagctgtacggcgcctgcgcccccgagctgcccggcgagagcgacagaagcgccgtggagaccgccgacgagggcagagtggacagcgccatggagaccagcatgatgagcgtgcaggagaacatccacatgctgagcgaggagaagcagagaatcatgctgctggagagaaccctgcagctgaaggaggaggagaacaagagactgaaccagagactgatgagccagagcatgagcagcgtgagcagcagacacagcgagaagatcgccatcagagacttccaggtgggcgacctggtgctgatcatcctggacgagagacacgacaactacgtgctgttcaccgtgagccccaccctgtacttcctgcacagcgagagcctgcccgccctggacctgaagcccggcgagggcgccagcggcgccagcagaagaccctgggtgctgggcaaggtgatggagaaggagtactgccaggccaagaaggcccagaacagattcaaggtgcccctgggcaccaagttctacagagtgaaggccgtgagctggaacaagaaggtgtag

SEQ ID NO: 12630 - DNA, 4776 bp, Artificial Sequence
  Description of Artificial Sequence: Synthetic coding sequence
atgaagctgtacgtgttcctggtgaacaccggcaccaccctgaccttcgacaccgagctgaccgtgcagaccgtggccgacctgaagcacgccatccagagcaagtacaagatcgccatccagcaccaggtgctggtggtgaacggcggcgagtgcatggccgccgacagaagagtgtgcacctacagcgccggcaccgacaccaaccccatcttcctgttcaacaaggagatgatcctgtgcgacagaccccccgccatccccaagaccaccttcagcaccgagaacgacatggagatcaaggtggaggagagcctgatgatgcccgccgtgttccacaccgtggccagcagaacccagctggccctggagatgtacgaggtggccaagaagctgtgcagcttctgcgagggcctggtgcacgacgagcacctgcagcaccagggctgggccgccatcatggccaacctggaggactgcagcaacagctaccagaagctgctgttcaagttcgagagcatctacagcaactacctgcagagcatcgaggacatcaagctgaagctgacccacctgggcaccgccgtgagcgtgatggccaagatccccctgctggagtgcctgaccagacacagctacagagagtgcctgggcagactggacagcctgcccgagcacgaggacagcgagaaggccgagatgaagagaagcaccgagctggtgctgagccccgacatgcccagaaccaccaacgagagcctgctgaccagcttccccaagagcgtggagcacgtgagccccgacaccgccgacgccgagagcggcaaggagatcagagagagctgccagagcaccgtgcaccagcaggacgagaccaccatcgacaccaaggacggcgacctgcccttcttcaacgtgagcctgctggactggatcaacgtgcaggacagacccaacgacgtggagagcctggtgagaaagtgcttcgacagcatgagcagactggaccccagaatcatcagacccttcatcgccgagtgcagacagaccatcgccaagctggacaaccagaacatgaaggccatcaagggcctggaggacagactgtacgccctggaccagatgatcgccagctgcggcagactggtgaacgagcagaaggagctggcccagggcttcctggccaaccagaagagagccgagaacctgaaggacgccagcgtgctgcccgacctgtgcctgagccacgccaaccagctgatgatcatgctgcagaaccacagaaagctgctggacatcaagcagaagtgcaccaccgccaagcaggagctggccaacaacctgcacgtgagactgaagtggtgctgcttcgtgatgctgcacgccgaccaggacggcgagaagctgcaggccctgctgagactggtgatcgagctgctggagagagtgaagatcgtggaggccctgagcaccgtgccccagatgtactgcctggccgtggtggaggtggtgagaagaaagatgttcatcaagcactacagagagtgggccggcgccctggtgaaggacggcaagagactgtacgaggccgagaagagcaagagagagagcttcggcaagctgttcagaaagagcttcctgagaaacagactgttcagaggcctggacagctggccccccagcttctgcacccagaagcccagaaagttcgactgcgagctgcccgacatcagcctgaaggacctgcagttcctgcagagcttctgccccagcgaggtgcagcccttcctgagagtgcccctgctgtgcgacttcgagcccctgcaccagcacgtgctggccctgcacaacctggtgaaggccgcccagagcctggacgagatgagccagaccatcaccgacctgctgagcgagcagaaggccagcgtgagccagaccagcccccagagcgccagcagccccagaatggagagcaccgccggcatcaccaccaccaccagccccagaacccccccccccctgaccgtgcaggaccccctgtgccccgccgtgtgccccctggaggagctgagccccgacagcatcgacgcccacaccttcgacttcgagaccatcccccaccccaacatcgagcagaccatccaccaggtgagcctggacctggacagcctggccgagagccccgagagcgacttcatgagcgccgtgaacgagttcgtgatcgaggagaacctgagcagccccaaccccatcagcgacccccagagccccgagatgatggtggagagcctgtacagcagcgtgatcaacgccatcgacagcagaagaatgcaggacaccaacgtgtgcggcaaggaggacttcggcgaccacaccagcctgaacgtgcagctggagagatgcagagtggtggcccaggacagccacttcagcatccagaccatcaaggaggacctgtgccacttcagaaccttcgtgcagaaggagcagtgcgacttcagcaacagcctgaagtgcaccgccgtggagatcagaaacatcatcgagaaggtgaagtgcagcctggagatcaccctgaaggagaagcaccagaaggagctgctgagcctgaagaacgagtacgagggcaagctggacggcctgatcaaggagaccgaggagaacgagaacaagatcaagaagctgaagggcgagctggtgtgcctggaggaggtgctgcagaacaaggacaacgagttcgccctggtgaagcacgagaaggaggccgtgatctgcctgcagaacgagaaggaccagaagctgctggagatggagaacatcatgcacagccagaactgcgagatcaaggagctgaagcagagcagagagatcgtgctggaggacctgaagaagctgcacgtggagaacgacgagaagctgcagctgctgagagccgagctgcagagcctggagcagagccacctgaaggagctggaggacaccctgcaggtgagacacatccaggagttcgagaaggtgatgaccgaccacagagtgagcctggaggagctgaagaaggagaaccagcagatcatcaaccagatccaggagagccacgccgagatcatccaggagaaggagaagcagctgcaggagctgaagctgaaggtgagcgacctgagcgacaccagatgcaagctggaggtggagctggccctgaaggaggccgagaccgacgagatcaagatcctgctggaggagagcagagcccagcagaaggagaccctgaagagcctgctggagcaggagaccgagaacctgagaaccgagatcagcaagctgaaccagaagatccaggacaacaacgagaactaccaggtgggcctggccgagctgagaaccctgatgaccatcgagaaggaccagtgcatcagcgagctgatcagcagacacgaggaggagagcaacatcctgaaggccgagctgaacaaggtgaccagcctgcacaaccaggccttcgagatcgagaagaacctgaaggagcagatcatcgagctgcagagcaagctggacagcgagctgagcgccctggagagacagaaggacgagaagatcacccagcaggaggagaagtacgaggccatcatccagaacctggagaaggacagacagaagctggtgagcagccaggagcaggacagagagcagctgatccagaagctgaactgcgagaaggacgaggccatccagaccgccctgaaggagttcaagctggagagagaggtggtggagaaggagctgctggagaaggtgaagcacctggagaaccagatcgccaagagccccgccatcgacagcaccagaggcgacagcagcagcctggtggccgagctgcaggagaagctgcaggaggagaaggccaagttcctggagcagctggaggagcaggagaagagaaagaacgaggagatgcagaacgtgagaaccagcctgatcgccgagcagcagaccaacttcaacaccgtgctgaccagagagaagatgagaaaggagaacatcatcaacgacctgagcgacaagctgaagagcaccatgcagcagcaggagagagacaaggacctgatcgagagcctgagcgaggacagagccagactgctggaggagaagaagaagctggaggaggaggtgagcaagctgagaagcagcagcttcgtgcccagcccctacgtggccaccgcccccgagctgtacggcgcctgcgcccccgagctgcccggcgagagcgacagaagcgccgtggagaccgccgacgagggcagagtggacagcgccatggagaccagcatgatgagcgtgcaggagaacatccacatgctgagcgaggagaagcagagaatcatgctgctggagagaaccctgcagctgaaggaggaggagaacaagagactgaaccagagactgatgagccagagcatgagcagcgtgagcagcagacacagcgagaagatcgccatcagagacttccaggtgggcgacctggtgctgatcatcctggacgagagacacgacaactacgtgctgttcaccgtgagccccaccctgtacttcctgcacagcgagagcctgcccgccctggacctgaagcccgccagcggcgccagcagaagaccctgggtgctgggcaaggtgatggagaaggagtactgccaggccaagaaggcccagaacagattcaaggtgcccctgggcaccaagttctacagagtgaaggccgtgagctggaacaagaaggtgtag

SEQ ID NO: 12631 - DNA, 48 bp, Artificial Sequence
  Description of Artificial Sequence: Synthetic coding sequence
atgaagctgtacgtgttcctggtgaacaccggcaccaccctgacctag

SEQ ID NO: 12632 - DNA, 4776 bp, Artificial Sequence; identical to SEQ ID NO: 12630
  Description of Artificial Sequence: Synthetic coding sequence

SEQ ID NO: 12633 - DNA, 6471 bp, Artificial Sequence
  Description of Artificial Sequence: Synthetic coding sequence
atgagcgacacccccagcaccggcttcagcatcatccaccccaccagcagcgagggccaggtgcccccccccagacacctgagcctgacccaccccgtggtggccaagagaatcagcttctacaagagcggcgacccccagttcggcggcgtgagagtggtggtgaaccccagaagcttcaagagcttcgacgccctgctggacaacctgagcagaaaggtgcccctgcccttcggcgtgagaaacatcagcacccccagaggcagacacagcatcaccagactggaggagctggaggacggcgagagctacctgtgcagccacggcagaaaggtgcagcccgtggacctggacaaggccagaagaagacccagaccctggctgagcagcagagccatcagcgcccacagccccccccaccccgtggccgtggccgcccccggcatgcccagaccccccagaagcctggtggtgttcagaaacggcgaccccaagaccagaagagccgtgctgctgagcagaagagtgacccagagcttcgaggccttcctgcagcacctgaccgaggtgatgcagagacccgtggtgaagctgtacgccaccgacggcagaagagtgcccagcctgcaggccgtgatcctgagcagcggcgccgtggtggccgccggcagagagcccttcaagcccggcaactacgacatccagaagtacctgctgcccgccagactgcccggcatcagccagagagtgtaccccaagggcaacgccaagagcgagagcagaaagatcagcacccacatgagcagcagcagcagaagccagatctacagcgtgagcagcgagaagacccacaacaacgactgctacctggactacagcttcgtgcccgagaagtacctggccctggagaagaacgacagccagaacctgcccatctaccccagcgaggacgacatcgagaagagcatcatcttcaaccaggacggcaccatgaccgtggagatgaaggtgagattcagaatcaaggaggaggagaccatcaagtggaccaccaccgtgagcaagaccggccccagcaacaacgacgagaagagcgagatgagcttccccggcagaaccgagagcagaagcagcggcctgaagctggccgcctgcagcttcagcgccgacgtgagccccatggagagaagcagcaaccaggagggcagcctggccgaggagatcaacatccagatgaccgaccaggtggccgagacctgcagcagcgccagctgggagaacgccaccgtggacaccgacatcatccagggcacccaggaccaggccaagcacagattctacagaccccccacccccggcctgagaagagtgagacagaagaagagcgtgatcggcagcgtgaccctggtgagcgagaccgaggtgcaggagaagatgatcggccagttcagctacagcgaggagagagagagcggcgagaacaagagcgagtaccacatgttcacccacagctgcagcaagatgagcagcgtgagcaacaagcccgtgctggtgcagatcaacaacaacgaccagatggaggagagcagcctggagagaaagaaggagaacagcctgctgaagagcagcgccatcagcgccggcgtgatcgagatcaccagccagaagatgctggagatgagccacaacaacggcctgcccagcaccatcagcaacaacagcatcgtggaggaggacgtggtggactgcgtggtgctggacaacaagaccggcatcaagaacttcaagacctacggcaacaccaacgacagattcagccccatcagcgccgacgccacccacttcagcagcaacaacagcggcaccgacaagaacatcagcgaggcccccgccagcgaggccagcagcaccgtgaccgccagaatcgacagactgatcaacgagttcgcccagtgcggcctgaccaagctgcccaagaacgagaagaagatcctgagcagcgtggccagcaagaagaagaagaagagcagacagcaggccatcaacagcagataccaggacggccagctggccaccaagggcatcctgaacaagaacgagagaatcaacaccaagggcagaatcaccaaggagatgatcgtgcaggacagcgacagccccctgaagggcggcatcctgtgcgaggaggacctgcagaagagcgacaccgtgatcgagagcaacaccttctgcagcaagagcaacctgaacagcaccatcagcaagaacttccacagaaacaagctgaacaccacccagaacagcaaggtgcagggcctgctgaccaagagaaagagcagaagcctgaacaagatcagcctgggcgcccccaagaagagagagatcggccagagagacaaggtgttcccccacaacgagagcaagtactgcaagagcaccttcgagaacaagagcctgttccacgtgttcaacatcctggagcagaagcccaaggacttctacgccccccagagccaggccgaggtggccagcggctacctgagaggcatggccaagaagagcctggtgagcaaggtgaccgacagccacatcaccctgaagagccagaagaagagaaagggcgacaaggtgaaggccagcgccatcctgagcaagcagcacgccaccaccagagccaacagcctggccagcctgaagaagcccgacttccccgaggccatcgcccaccacagcatccagaactacatccagagctggctgcagaacatcaacccctaccccaccctgaagcccatcaagagcgcccccgtgtgcagaaacgagaccagcgtggtgaactgcagcaacaacagcttcagcggcaacgacccccacaccaacagcggcaagatcagcaacttcgtgatggagagcaacaagcacatcaccaagatcgccggcctgaccggcgacaacctgtgcaaggagggcgacaagagcttcatcgccaacgacaccggcgaggaggacctgcacgagacccaggtgggcagcctgaacgacgcctacctggtgcccctgcacgagcactgcaccctgagccagagcgccatcaacgaccacaacaccaagagccacatcgccgccgagaagagcggccccgagaagaagctggtgtaccaggagatcaacctggccagaaagagacagagcgtggaggccgccatccaggtggaccccatcgaggaggagacccccaaggacctgctgcccgtgctgatgctgcaccagctgcaggccagcgtgcccggcatccacaagacccagaacggcgtggtgcagatgcccggcagcctggccggcgtgcccttccacagcgccatctgcaacagcagcaccaacctgctgctggcctggctgctggtgctgaacctgaagggcagcatgaacagcttctgccaggtggacgcccacaaggccaccaacaagagcagcgagaccctggccctgctggagatcctgaagcacatcgccatcaccgaggaggccgacgacctgaaggccgccgtggccaacctggtggagagcaccaccagccacttcggcctgagcgagaaggagcaggacatggtgcccatcgacctgagcgccaactgcagcaccgtgaacatccagagcgtgcccaagtgcagcgagaacgagagaacccagggcatcagcagcctggacggcggctgcagcgccagcgaggcctgcgcccccgaggtgtgcgtgctggaggtgacctgcagcccctgcgagatgtgcaccgtgaacaaggcctacagccccaaggagacctgcaaccccagcgacaccttcttccccagcgacggctacggcgtggaccagaccagcatgaacaaggcctgcttcctgggcgaggtgtgcagcctgaccgacaccgtgttcagcgacaaggcctgcgcccagaaggagaaccacacctacgagggcgcctgccccatcgacgagacctacgtgcccgtgaacgtgtgcaacaccatcgacttcctgaacagcaaggagaacacctacaccgacaacctggacagcaccgaggagctggagagaggcgacgacatccagaaggacctgaacatcctgaccgaccccgagtacaagaacggcttcaacaccctggtgagccaccagaacgtgagcaacctgagcagctgcggcctgtgcctgagcgagaaggaggccgagctggacaagaagcacagcagcctggacgacttcgagaactgcagcctgagaaagttccaggacgagaacgcctacaccagcttcgacatggaggagcccagaaccagcgaggagcccggcagcatcaccaacagcatgaccagcagcgagagaaacatcagcgagctggagagcttcgaggagctggagaaccacgacaccgacatcttcaacaccgtggtgaacggcggcgagcaggccaccgaggagctgatccaggaggaggtggaggccagcaagaccctggagctgatcgacatcagcagcaagaacatcatggaggagaagagaatgaacggcatcatctacgagatcatcagcaagagactggccaccccccccagcctggacttctgctacgacagcaagcagaacagcgagaaggagaccaacgagggcgagaccaagatggtgaagatgatggtgaagaccatggagaccggcagctacagcgagagcagccccgacctgaagaagtgcatcaagagccccgtgaccagcgactggagcgactacagacccgacagcgacagcgagcagccctacaagaccagcagcgacgaccccaacgacagcggcgagctgacccaggagaaggagtacaacatcggcttcgtgaagagagccatcgagaagctgtacggcaaggccgacatcatcaagcccagcttcttccccggcagcaccagaaagagccaggtgtgcccctacaacagcgtggagttccagtgcagcagaaaggccagcctgtacgacagcgagggccagagcttcggcagcagcgagcaggtgagcagcagcagcagcatgctgcaggagttccaggaggagagacaggacaagtgcgacgtgagcgccgtgagagacaactactgcagaggcgacatcgtggagcccggcaccaagcagaacgacgacagcagaatcctgaccgacatcgaggagggcgtgctgatcgacaagggcaagtggctgctgaaggagaaccacctgctgagaatgagcagcgagaaccccggcatgtgcggcaacgccgacaccaccagcgtggacaccctgctggacaacaacagcagcgaggtgccctacagccacttcggcaacctggcccccggccccaccatggacgagctgagcagcagcgagctggaggagctgacccagcccctggagctgaagtgcaactacttcaacatgccccacggcagcgacagcgagcccttccacgaggacctgctggacgtgagaaacgagacctgcgccaaggagagaatcgccaaccaccacaccgaggagaagggcagccaccagagcgagagagtgtgcaccagcgtgacccacagcttcatcagcgccggcaacaaggtgtaccccgtgagcgacgacgccatcaagaaccagcccctgcccggcagcaacatgatccacggcaccctgcaggaggccgacagcctggacaagctgtacgccctgtgcggccagcactgccccatcctgaccgtgatcatccagcccatgaacgaggaggacagaggcttcgcctacagaaaggagagcgacatcgagaacttcctgggcttctacctgtggatgaagatccacccctacctgctgcagaccgacaagaacgtgttcagagaggagaacaacaaggccagcatgagacagaacctgatcgacaacgccatcggcgacatcttcgaccagttctacttcagcaacaccttcgacctgatgggcaagagaagaaagcagaagagaatcaacttcctgggcctggaggaggagggcaacctgaagaagttccagcccgacctgaaggagagattctgcatgaacttcctgcacaccagcctgctggtggtgggcaacgtggacagcaacacccaggacctgagcggccagaccaacgagatcttcaaggccgtggacgagaacaacaacctgctgaacaacagattccagggcagcagaaccaacctgaaccaggtggtgagagagaacatcaactgccactacttcttcgagatgctgggccaggcctgcctgctggacatctgccaggtggagaccagcctgaacatcagcaacagaaacatcctggagctgtgcatgttcgagggcgagaacctgttcatctgggaggaggaggacatcctgaacctgaccgacctggagagcagcagagagcaggaggacctgtag

SEQ ID NO: 12634 - DNA, 1212 bp, Artificial Sequence
  Description of Artificial Sequence: Synthetic coding sequence
atgaccccccccctgctgcaccacgacctgaagacccagaacatcctgctggacaacgagttccacgtgaagatcgccgacttcggcctgagcaagtggagaatgatgagcctgagccagagcagaagcagcaagagcgcccccgagggcggcaccatcatctacatgccccccgagaactacgagcccggccagaagagcagagccagcatcaagcacgacatctacagctacgccgtgatcacctgggaggtgctgagcagaaagcagcccttcgaggacgtgaccaaccccctgcagatcatgtacagcgtgagccagggccacagacccgtgatcaacgaggagagcctgccctacgacatcccccacagagccagaatgatcagcctgatcgagagcggctgggcccagaaccccgacgagagacccagcttcctgaagtgcctgatcgagctggagcccgtgctgagaaccttcgaggagatcaccttcctggaggccgtgatccagctgaagaagaccaagctgcagagcgtgagcagcgccatccacctgtgcgacaagaagaagatggagctgagcctgaacatccccgtgaaccacggcccccaggaggagagctgcggcagcagccagctgcacgagaacagcggcagccccgagaccagcagaagcctgcccgccccccaggacaacgacttcctgagcagaaaggcccaggactgctacttcatgaagctgcaccactgccccggcaaccacagctgggacagcaccatcagcggcagccagagagccgccttctgcgaccacaagaccaccccctgcagcagcgccatcatcaaccccctgagcaccgccggcaacagcgagagactgcagcccggcatcgcccagcagtggatccagagcaagagagaggacatcgtgaaccagatgaccgaggcctgcctgaaccagagcctggacgccctgctgagcagagacctgatcatgaaggaggactacgagctggtgagcaccaagcccaccagaaccagcaaggtgagacagctgctggacaccaccgacatccagggcgaggagttcgccaaggtgatcgtgcagaagctgaaggacaacaagcagatgggcctgcagccctaccccgagatcctggtggtgagcagaagccccagcctgaacctgctgcagaacaagagcatgtag

SEQ ID NO: 12635 - DNA, 10377 bp, Artificial Sequence
  Description of Artificial Sequence: Synthetic coding sequence
atggagagaagcggctgggccagacagaccttcctgctggccctgctgctgggcgccaccctgagagccagagccgccgccggctactaccccagattcagccccttcttcttcctgtgcacccaccacggcgagctggagggcgacggcgagcagggcgaggtgctgatcagcctgcacatcgccggcaaccccacctactacgtgcccggccaggagtaccacgtgaccatcagcaccagcaccttcttcgacggcctgctggtgaccggcctgtacaccagcaccagcgtgcaggccagccagagcatcggcggcagcagcgccttcggcttcggcatcatgagcgaccaccagttcggcaaccagttcatgtgcagcgtggtggccagccacgtgagccacctgcccaccaccaacctgagcttcatctggatcgccccccccgccggcaccggctgcgtgaacttcatggccaccgccacccacagaggccaggtgatcttcaaggacgccctggcccagcagctgtgcgagcagggcgcccccaccgacgtgaccgtgcacccccacctggccgagatccacagcgacagcatcatcctgagagacgacttcgacagctaccaccagctgcagctgaaccccaacatctgggtggagtgcaacaactgcgagaccggcgagcagtgcggcgccatcatgcacggcaacgccgtgaccttctgcgagccctacggccccagagagctgatcaccaccggcctgaacaccaccaccgccagcgtgctgcagttcagcatcggcagcggcagctgcagattcagctacagcgaccccagcatcatcgtgctgtacgccaagaacaacagcgccgactggatccagctggagaagatcagagcccccagcaacgtgagcaccatcatccacatcctgtacctgcccgaggacgccaagggcgagaacgtgcagttccagtggaagcaggagaacctgagagtgggcgaggtgtacgaggcctgctgggccctggacaacatcctgatcatcaacagcgcccacagacaggtggtgctggaggacagcctggaccccgtggacaccggcaactggctgttcttccccggcgccaccgtgaagcacagctgccagagcgacggcaacagcatctacttccacggcaacgagggcagcgagttcaacttcgccaccaccagagacgtggacctgagcaccgaggacatccaggagcagtggagcgaggagttcgagagccagcccaccggctgggacgtgctgggcgccgtgatcggcaccgagtgcggcaccatcgagagcggcctgagcatggtgttcctgaaggacggcgagagaaagctgtgcacccccagcatggacaccaccggctacggcaacctgagattctacttcgtgatgggcggcatctgcgaccccggcaacagccacgagaacgacatcatcctgtacgccaagatcgagggcagaaaggagcacatcaccctggacaccctgagctacagcagctacaaggtgcccagcctggtgagcgtggtgatcaaccccgagctgcagacccccgccaccaagttctgcctgagacagaagaaccaccagggccacaacagaaacgtgtgggccgtggacttcttccacgtgctgcccgtgctgcccagcaccatgagccacatgatccagttcagcatcaacctgggctgcggcacccaccagcccggcaacagcgtgagcctggagttcagcaccaaccacggcagaagctggagcctgctgcacaccgagtgcctgcccgagatctgcgccggcccccacctgccccacagcaccgtgtacagcagcgagaactacagcggctggaacagaatcaccatccccctgcccaacgccgccctgaccagaaacaccagaatcagatggagacagaccggccccatcctgggcaacatgtgggccatcgacaacgtgtacatcggccccagctgcctgaagttctgcagcggcagaggccagtgcaccagacacggctgcaagtgcgaccccggcttcagcggccccgcctgcgagatggccagccagaccttccccatgttcatcagcgagagcttcggcagcagcagactgagcagctaccacaacttctacagcatcagaggcgccgaggtgagcttcggctgcggcgtgctggccagcggcaaggccctggtgttcaacaaggacggcagaagacagctgatcaccagcttcctggacagcagccagagcagattcctgcagttcaccctgagactgggcagcaagagcgtgctgagcacctgcagagcccccgaccagcccggcgagggcgtgctgctgcactacagctacgacaacggcatcacctggaagctgctggagcactacagctacctgagctaccacgagcccagaatcatcagcgtggagctgcccggcgacgccaagcagttcggcatccagttcagatggtggcagccctaccacagcagccagagagaggacgtgtgggccatcgacgagatcatcatgaccagcgtgctgttcaacagcatcagcctggacttcaccaacctggtggaggtgacccagagcctgggcttctacctgggcaacgtgcagccctactgcggccacgactggaccctgtgcttcaccggcgacagcaagctggccagcagcatgagatacgtggagacccagagcatgcagatcggcgccagctacatgatccagttcagcctggtgatgggctgcggccagaagtacaccccccacatggacaaccaggtgaagctggagtacagcaccaaccacggcctgacctggcacctggtgcaggaggagtgcctgcccagcatgcccagctgccaggagttcaccagcgccagcatctaccacgccagcgagttcacccagtggagaagagtgatcgtgctgctgccccagaagacctggagcagcgccaccagattcagatggagccagagctactacaccgcccaggacgagtgggccctggacagcatctacatcggccagcagtgccccaacatgtgcagcggccacggcagctgcgaccacggcatctgcagatgcgaccagggctaccagggcaccgagtgccaccccgaggccgccctgcccagcaccatcatgagcgacttcgagaaccagaacggctgggagagcgactggcaggaggtgatcggcggcgagatcgtgaagcccgagcagggctgcggcgtgatcagcagcggcagcagcctgtacttcagcaaggccggcaagagacagctggtgagctgggacctggacaccagctgggtggacttcgtgcagttctacatccagatcggcggcgagagcgccagctgcaacaagcccgacagcagagaggagggcgtgctgctgcagtacagcaacaacggcggcatccagtggcacctgctggccgagatgtacttcagcgacttcagcaagcccagattcgtgtacctggagctgcccgccgccgccaagaccccctgcaccagattcagatggtggcagcccgtgttcagcggcgaggactacgaccagtgggccgtggacgacatcatcatcctgagcgagaagcagaagcagatcatccccgtgatcaaccccaccctgccccagaacttctacgagaagcccgccttcgactaccccatgaaccagatgagcgtgtggctgatgctggccaacgagggcatggtgaagaacgagaccttctgcgccgccacccccagcgccatgatcttcggcaagagcgacggcgacagattcgccgtgaccagagacctgaccctgaagcccggctacgtgctgcagttcaagctgaacatcggctgcgccaaccagttcagcagcaccgcccccgtgctgctgcagtacagccacgacgccggcatgagctggttcctggtgaaggagggctgctaccccgccagcgccggcaagggctgcgagggcaacagcagagagctgagcgagcccaccatgtaccacaccggcgacttcgaggagtggaccagaatcaccatcgtgatccccagaagcctggccagcagcaagaccagattcagatggatccaggagagcagcagccagaagaacgtgccccccttcggcctggacggcgtgtacatcagcgagccctgccccagctactgcagcggccacggcgactgcatcagcggcgtgtgcttctgcgacctgggctacaccgccgcccagggcacctgcgtgagcaacgtgcccaaccacaacgagatgttcgacagattcgagggcaagctgagccccctgtggtacaagatcaccggcgcccaggtgggcaccggctgcggcaccctgaacgacggcaagagcctgtacttcaacggccccggcaagagagaggccagaaccgtgcccctggacaccagaaacatcagactggtgcagttctacatccagatcggcagcaagaccagcggcatcacctgcatcaagcccagaaccagaaacgagggcctgatcgtgcagtacagcaacgacaacggcatcctgtggcacctgctgagagagctggacttcatgagcttcctggagccccagatcatcagcatcgacctgccccaggacgccaagacccccgccaccgccttcagatggtggcagccccagcacggcaagcacagcgcccagtgggccctggacgacgtgctgatcggcatgaacgacagcagccagaccggcttccaggacaagttcgacggcagcatcgacctgcaggccaactggtacagaatccagggcggccaggtggacatcgactgcctgagcatggacaccgccctgatcttcaccgagaacatcggcaagcccagatacgccgagacctgggacttccacgtgagcgccagcaccttcctgcagttcgagatgagcatgggctgcagcaagcccttcagcaacagccacagcgtgcagctgcagtacagcctgaacaacggcaaggactggcacctggtgaccgaggagtgcgtgccccccaccatcggctgcctgcactacaccgagagcagcatctacaccagcgagagattccagaactggaagagaatcaccgtgtacctgcccctgagcaccatcagccccagaaccagattcagatggatccaggccaactacaccgtgggcgccgacagctgggccatcgacaacgtggtgctggccagcggctgcccctggatgtgcagcggcagaggcatctgcgacgccggcagatgcgtgtgcgacagaggcttcggcggcccctactgcgtgcccgtggtgcccctgcccagcatcctgaaggacgacttcaacggcaacctgcaccccgacctgtggcccgaggtgtacggcgccgagagaggcaacctgaacggcgagaccatcaagagcggcaccagcctgatcttcaagggcgagggcctgagaatgctgatcagcagagacctggactgcaccaacaccatgtacgtgcagttcagcctgagattcatcgccaagagcacccccgagagaagccacagcatcctgctgcagttcagcatcagcggcggcatcacctggcacctgatggacgagttctacttcccccagaccaccaacatcctgttcatcaacgtgcccctgccctacaccgcccagaccaacgccaccagattcagactgtggcagccctacaacaacggcaagaaggaggagatctggatcgtggacgacttcatcatcgacggcaacaacgtgaacaaccccgtgatgctgctggacaccttcgacttcggccccagagaggacaactggttcttctaccccggcggcaacatcggcctgtactgcccctacagcagcaagggcgcccccgaggaggacagcgccatggtgttcgtgagcaacgaggtgggcgagcacagcatcaccaccagagacctgaacgtgaacgagaacaccatcatccagttcgagatcaacgtgggctgcagcaccgacagcagcagcgccgaccccgtgagactggagttcagcagagacttcggcgccacctggcacctgctgctgcccctgtgctaccacagcagcagccacgtgagcagcctgtgcagcaccgagcaccaccccagcagcacctactacgccggcaccatgcagggctggagaagagaggtggtgcacttcggcaagctgcacctgtgcggcagcgtgagattcagatggtaccagggcttctaccccgccggcagccagcccgtgacctgggccatcgacaacgtgtacatcggcccccagtgcgaggagatgtgcaacggccagggcagctgcatcaacggcaccaagtgcatctgcgaccccggctacagcggccccacctgcaagatcagcaccaagaaccccgacttcctgaaggacgacttcgagggccagctggagagcgacagattcctgctgatgagcggcggcaagcccagcagaaagtgcggcatcctgagcagcggcaacaacctgttcttcaacgaggacggcctgagaatgctgatgaccagagacctggacctgagccacgccagattcgtgcagttcttcatgagactgggctgcggcaagggcgtgcccgaccccagaagccagcccgtgctgctgcagtacagcctgaacggcggcctgagctggagcctgctgcaggagttcctgttcagcaacagcagcaacgtgggcagatacatcgccctggagatccccctgaaggccagaagcggcagcaccagactgagatggtggcagcccagcgagaacggccacttctacagcccctgggtgatcgaccagatcctgatcggcggcaacatcagcggcaacaccgtgctggaggacgacttcaccaccctggacagcagaaagtggctgctgcaccccggcggcaccaagatgcccgtgtgcggcagcaccggcgacgccctggtgttcatcgagaaggccagcaccagatacgtggtgagcaccgacgtggccgtgaacgaggacagcttcctgcagatcgacttcgccgccagctgcagcgtgaccgacagctgctacgccatcgagctggagtacagcgtggacctgggcctgagctggcaccccctggtgagagactgcctgcccaccaacgtggagtgcagcagataccacctgcagagaatcctggtgagcgacaccttcaacaagtggaccagaatcaccctgcccctgcccccctacaccagaagccaggccaccagattcagatggcaccagcccgcccccttcgacaagcagcagacctgggccatcgacaacgtgtacatcggcgacggctgcatcgacatgtgcagcggccacggcagatgcatccagggcaactgcgtgtgcgacgagcagtggggcggcctgtactgcgacgaccccgagaccagcctgcccacccagctgaaggacaacttcaacagagcccccagcagccagaactggctgaccgtgaacggcggcaagctgagcaccgtgtgcggcgccgtggccagcggcatggccctgcacttcagcggcggctgcagcagactgctggtgaccgtggacctgaacctgaccaacgccgagttcatccagttctacttcatgtacggctgcctgatcacccccaacaacagaaaccagggcgtgctgctggagtacagcgtgaacggcggcatcacctggaacctgctgatggagatcttctacgaccagtacagcaagcccggcttcgtgaacatcctgctgccccccgacgccaaggagatcgccaccagattcagatggtggcagcccagacacgacggcctggaccagaacgactgggccatcgacaacgtgctgatcagcggcagcgccgaccagagaaccgtgatgctggacaccttcagcagcgcccccgtgccccagcacgagagaagccccgccgacgccggccccgtgggcagaatcgccttcgacatgttcatggaggacaagaccagcgtgaacgagcactggctgttccacgacgactgcaccgtggagagattctgcgacagccccgacggcgtgatgctgtgcggcagccacgacggcagagaggtgtacgccgtgacccacgacctgacccccaccgagggctggatcatgcagttcaagatcagcgtgggctgcaaggtgagcgagaagatcgcccagaaccagatccacgtgcagtacagcaccgacttcggcgtgagctggaactacctggtgccccagtgcctgcccgccgaccccaagtgcagcggcagcgtgagccagcccagcgtgttcttccccaccaagggctggaagagaatcacctaccccctgcccgagagcctggtgggcaaccccgtgagattcagattctaccagaagtacagcgacatgcagtgggccatcgacaacttctacctgggccccggctgcctggacaactgcagaggccacggcgactgcctgagagagcagtgcatctgcgaccccggctacagcggccccaactgctacctgacccacaccctgaagaccttcctgaaggagagattcgacagcgaggagatcaagcccgacctgtggatgagcctggagggcggcagcacctgcaccgagtgcggcatcctggccgaggacaccgccctgtacttcggcggcagcaccgtgagacaggccgtgacccaggacctggacctgagaggcgccaagttcctgcagtactggggcagaatcggcagcgagaacaacatgaccagctgccacagacccatctgcagaaaggagggcgtgctgctggactacagcaccgacggcggcatcacctggaccctgctgcacgagatggactaccagaagtacatcagcgtgagacacgactacatcctgctgcccgaggacgccctgaccaacaccaccagactgagatggtggcagcccttcgtgatcagcaacggcatcgtggtgagcggcgtggagagagcccagtgggccctggacaacatcctgatcggcggcgccgagatcaaccccagccagctggtggacaccttcgacgacgagggcaccagccacgaggagaactggagcttctaccccaacgccgtgagaaccgccggcttctgcggcaaccccagcttccacctgtactggcccaacaagaagaaggacaagacccacaacgccctgagcagcagagagctgatcatccagcccggctacatgatgcagttcaagatcgtggtgggctgcgaggccaccagctgcggcgacctgcacagcgtgatgctggagtacaccaaggacgccagaagcgacagctggcagctggtgcagacccagtgcctgcccagcagcagcaacagcatcggctgcagccccttccagttccacgaggccaccatctacaacagcgtgaacagcagcagctggaagagaatcaccatccagctgcccgaccacgtgagcagcagcgccacccagttcagatggatccagaagggcgaggagaccgagaagcagagctgggccatcgaccacgtgtacatcggcgaggcctgccccaagctgtgcagcggccacggctactgcaccaccggcgccatctgcatctgcgacgagagcttccagggcgacgactgcagcgtgttcagccacgacctgcccagctacatcaaggacaacttcgagagcgccagagtgaccgaggccaactgggagaccatccagggcggcgtgatcggcagcggctgcggccagctggccccctacgcccacggcgacagcctgtacttcaacggctgccagatcagacaggccgccaccaagcccctggacctgaccagagccagcaagatcatgttcgtgctgcagatcggcagcatgagccagaccgacagctgcaacagcgacctgagcggcccccacgccgtggacaaggccgtgctgctgcagtacagcgtgaacaacggcatcacctggcacgtgatcgcccagcaccagcccaaggacttcacccaggcccagagagtgagctacaacgtgcccctggaggccagaatgaagggcgtgctgctgagatggtggcagcccagacacaacggcaccggccacgaccagtgggccctggaccacgtggaggtggtgctgaccagaaagcagaactacatgatgaacttcagcagacagcacggcctgagacacttctacaacagaagaagaagaagcctgagaagatacccctag

SEQ ID NO: 12636 - DNA, 10383 bp, Artificial Sequence
  Description of Artificial Sequence: Synthetic coding sequence
atggagagaagcggctgggccagacagaccttcctgctggccctgctgctgggcgccaccctgagagccagagccgccgccggctactaccccagattcagccccttcttcttcctgtgcacccaccacggcgagctggagggcgacggcgagcagggcgaggtgctgatcagcctgcacatcgccggcaaccccacctactacgtgcccggccaggagtaccacgtgaccatcagcaccagcaccttcttcgacggcctgctggtgaccggcctgtacaccagcaccagcgtgcaggccagccagagcatcggcggcagcagcgccttcggcttcggcatcatgagcgaccaccagttcggcaaccagttcatgtgcagcgtggtggccagccacgtgagccacctgcccaccaccaacctgagcttcatctggatcgccccccccgccggcaccggctgcgtgaacttcatggccaccgccacccacagaggccaggtgatcttcaaggacgccctggcccagcagctgtgcgagcagggcgcccccaccgacgtgaccgtgcacccccacctggccgagatccacagcgacagcatcatcctgagagacgacttcgacagctaccaccagctgcagctgaaccccaacatctgggtggagtgcaacaactgcgagaccggcgagcagtgcggcgccatcatgcacggcaacgccgtgaccttctgcgagccctacggccccagagagctgatcaccaccggcctgaacaccaccaccgccagcgtgctgcagttcagcatcggcagcggcagctgcagattcagctacagcgaccccagcatcatcgtgctgtacgccaagaacaacagcgccgactggatccagctggagaagatcagagcccccagcaacgtgagcaccatcatccacatcctgtacctgcccgaggacgccaagggcgagaacgtgcagttccagtggaagcaggagaacctgagagtgggcgaggtgtacgaggcctgctgggccctggacaacatcctgatcatcaacagcgcccacagacaggtggtgctggaggacagcctggaccccgtggacaccggcaactggctgttcttccccggcgccaccgtgaagcacagctgccagagcgacggcaacagcatctacttccacggcaacgagggcagcgagttcaacttcgccaccaccagagacgtggacctgagcaccgaggacatccaggagcagtggagcgaggagttcgagagccagcccaccggctgggacgtgctgggcgccgtgatcggcaccgagtgcggcaccatcgagagcggcctgagcatggtgttcctgaaggacggcgagagaaagctgtgcacccccagcatggacaccaccggctacggcaacctgagattctacttcgtgatgggcggcatctgcgaccccggcaacagccacgagaacgacatcatcctgtacgccaagatcgagggcagaaaggagcacatcaccctggacaccctgagctacagcagctacaaggtgcccagcctggtgagcgtggtgatcaaccccgagctgcagacccccgccaccaagttctgcctgagacagaagaaccaccagggccacaacagaaacgtgtgggccgtggacttcttccacgtgctgcccgtgctgcccagcaccatgagccacatgatccagttcagcatcaacctgggctgcggcacccaccagcccggcaacagcgtgagcctggagttcagcaccaaccacggcagaagctggagcctgctgcacaccgagtgcctgcccgagatctgcgccggcccccacctgccccacagcaccgtgtacagcagcgagaactacagcggctggaacagaatcaccatccccctgcccaacgccgccctgaccagaaacaccagaatcagatggagacagaccggccccatcctgggcaacatgtgggccatcgacaacgtgtacatcggccccagctgcctgaagttctgcagcggcagaggccagtgcaccagacacggctgcaagtgcgaccccggcttcagcggccccgcctgcgagatggccagccagaccttccccatgttcatcagcgagagcttcggcagcagcagactgagcagctaccacaacttctacagcatcagaggcgccgaggtgagcttcggctgcggcgtgctggccagcggcaaggccctggtgttcaacaaggacggcagaagacagctgatcaccagcttcctggacagcagccagagcagattcctgcagttcaccctgagactgggcagcaagagcgtgctgagcacctgcagagcccccgaccagcccggcgagggcgtgctgctgcactacagctacgacaacggcatcacctggaagctgctggagcactacagctacctgagctaccacgagcccagaatcatcagcgtggagctgcccggcgacgccaagcagttcggcatccagttcagatggtggcagccctaccacagcagccagagagaggacgtgtgggccatcgacgagatcatcatgaccagcgtgctgttcaacagcatcagcctggacttcaccaacctggtggaggtgacccagagcctgggcttctacctgggcaacgtgcagccctactgcggccacgactggaccctgtgcttcaccggcgacagcaagctggccagcagcatgagatacgtggagacccagagcatgcagatcggcgccagctacatgatccagttcagcctggtgatgggctgcggccagaagtacaccccccacatggacaaccaggtgaagctggagtacagcaccaaccacggcctgacctggcacctggtgcaggaggagtgcctgcccagcatgcccagctgccaggagttcaccagcgccagcatctaccacgccagcgagttcacccagtggagaagagtgatcgtgctgctgccccagaagacctggagcagcgccaccagattcagatggagccagagctactacaccgcccaggacgagtgggccctggacagcatctacatcggccagcagtgccccaacatgtgcagcggccacggcagctgcgaccacggcatctgcagatgcgaccagggctaccagggcaccgagtgccaccccgaggccgccctgcccagcaccatcatgagcgacttcgagaaccagaacggctgggagagcgactggcaggaggtgatcggcggcgagatcgtgaagcccgagcagggctgcggcgtgatcagcagcggcagcagcctgtacttcagcaaggccggcaagagacagctggtgagctgggacctggacaccagctgggtggacttcgtgcagttctacatccagatcggcggcgagagcgccagctgcaacaagcccgacagcagagaggagggcgtgctgctgcagtacagcaacaacggcggcatccagtggcacctgctggccgagatgtacttcagcgacttcagcaagcccagattcgtgtacctggagctgcccgccgccgccaagaccccctgcaccagattcagatggtggcagcccgtgttcagcggcgaggactacgaccagtgggccgtggacgacatcatcatcctgagcgagaagcagaagcagatcatccccgtgatcaaccccaccctgccccagaacttctacgagaagcccgccttcgactaccccatgaaccagatgagcgtgtggctgatgctggccaacgagggcatggtgaagaacgagaccttctgcgccgccacccccagcgccatgatcttcggcaagagcgacggcgacagattcgccgtgaccagagacctgaccctgaagcccggctacgtgctgcagttcaagctgaacatcggctgcgccaaccagttcagcagcaccgcccccgtgctgctgcagtacagccacgacgccggcatgagctggttcctggtgaaggagggctgctaccccgccagcgccggcaagggctgcgagggcaacagcagagagctgagcgagcccaccatgtaccacaccggcgacttcgaggagtggaccagaatcaccatcgtgatccccagaagcctggccagcagcaagaccagattcagatggatccaggagagcagcagccagaagaacgtgccccccttcggcctggacggcgtgtacatcagcgagccctgccccagctactgcagcggccacggcgactgcatcagcggcgtgtgcttctgcgacctgggctacaccgccgcccagggcacctgcgtgagcaacgtgcccaaccacaacgagatgttcgacagattcgagggcaagctgagccccctgtggtacaagatcaccggcgcccaggtgggcaccggctgcggcaccctgaacgacggcaagagcctgtacttcaacggccccggcaagagagaggccagaaccgtgcccctggacaccagaaacatcagactggtgcagttctacatccagatcggcagcaagaccagcggcatcacctgcatcaagcccagaaccagaaacgagggcctgatcgtgcagtacagcaacgacaacggcatcctgtggcacctgctgagagagctggacttcatgagcttcctggagccccagatcatcagcatcgacctgccccaggacgccaagacccccgccaccgccttcagatggtggcagccccagcacggcaagcacagcgcccagtgggccctggacgacgtgctgatcggcatgaacgacagcagccagaccggcttccaggacaagttcgacggcagcatcgacctgcaggccaactggtacagaatccagggcggccaggtggacatcgactgcctgagcatggacaccgccctgatcttcaccgagaacatcggcaagcccagatacgccgagacctgggacttccacgtgagcgccagcaccttcctgcagttcgagatgagcatgggctgcagcaagcccttcagcaacagccacagcgtgcagctgcagtacagcctgaacaacggcaaggactggcacctggtgaccgaggagtgcgtgccccccaccatcggctgcctgcactacaccgagagcagcatctacaccagcgagagattccagaactggaagagaatcaccgtgtacctgcccctgagcaccatcagccccagaaccagattcagatggatccaggccaactacaccgtgggcgccgacagctgggccatcgacaacgtggtgctggccagcggctgcccctggatgtgcagcggcagaggcatctgcgacgccggcagatgcgtgtgcgacagaggcttcggcggcccctactgcgtgcccgtggtgcccctgcccagcatcctgaaggacgacttcaacggcaacctgcaccccgacctgtggcccgaggtgtacggcgccgagagaggcaacctgaacggcgagaccatcaagagcggcaccagcctgatcttcaagggcgagggcctgagaatgctgatcagcagagacctggactgcaccaacaccatgtacgtgcagttcagcctgagattcatcgccaagagcacccccgagagaagccacagcatcctgctgcagttcagcatcagcggcggcatcacctggcacctgatggacgagttctacttcccccagaccaccaacatcctgttcatcaacgtgcccctgccctacaccgcccagaccaacgccaccagattcagactgtggcagccctacaacaacggcaagaaggaggagatctggatcgtggacgacttcatcatcgacggcaacaacgtgaacaaccccgtgatgctgctggacaccttcgacttcggccccagagaggacaactggttcttctaccccggcggcaacatcggcctgtactgcccctacagcagcaagggcgcccccgaggaggacagcgccatggtgttcgtgagcaacgaggtgggcgagcacagcatcaccaccagagacctgaacgtgaacgagaacaccatcatccagttcgagatcaacgtgggctgcagcaccgacagcagcagcgccgaccccgtgagactggagttcagcagagacttcggcgccacctggcacctgctgctgcccctgtgctaccacagcagcagccacgtgagcagcctgtgcagcaccgagcaccaccccagcagcacctactacgccggcaccatgcagggctggagaagagaggtggtgcacttcggcaagctgcacctgtgcggcagcgtgagattcagatggtaccagggcttctaccccgccggcagccagcccgtgacctgggccatcgacaacgtgtacatcggcccccagtgcgaggagatgtgcaacggccagggcagctgcatcaacggcaccaagtgcatctgcgaccccggctacagcggccccacctgcaagatcagcaccaagaaccccgacttcctgaaggacgacttcgagggccagctggagagcgacagattcctgctgatgagcggcggcaagcccagcagaaagtgcggcatcctgagcagcggcaacaacctgttcttcaacgaggacggcctgagaatgctgatgaccagagacctggacctgagccacgccagattcgtgcagttcttcatgagactgggctgcggcaagggcgtgcccgaccccagaagccagcccgtgctgctgcagtacagcctgaacggcggcctgagctggagcctgctgcaggagttcctgttcagcaacagcagcaacgtgggcagatacatcgccctggagatccccctgaaggccagaagcggcagcaccagactgagatggtggcagcccagcgagaacggccacttctacagcccctgggtgatcgaccagatcctgatcggcggcaacatcagcggcaacaccgtgctggaggacgacttcaccaccctggacagcagaaagtggctgctgcaccccggcggcaccaagatgcccgtgtgcggcagcaccggcgacgccctggtgttcatcgagaaggccagcaccagatacgtggtgagcaccgacgtggccgtgaacgaggacagcttcctgcagatcgacttcgccgccagctgcagcgtgaccgacagctgctacgccatcgagctggagtacagcgtggacctgggcctgagctggcaccccctggtgagagactgcctgcccaccaacgtggagtgcagcagataccacctgcagagaatcctggtgagcgacaccttcaacaagtggaccagaatcaccctgcccctgcccccctacaccagaagccaggccaccagattcagatggcaccagcccgcccccttcgacaagcagcagacctgggccatcgacaacgtgtacatcggcgacggctgcatcgacatgtgcagcggccacggcagatgcatccagggcaactgcgtgtgcgacgagcagtggggcggcctgtactgcgacgaccccgagaccagcctgcccacccagctgaaggacaacttcaacagagcccccagcagccagaactggctgaccgtgaacggcggcaagctgagcaccgtgtgcggcgccgtggccagcggcatggccctgcacttcagcggcggctgcagcagactgctggtgaccgtggacctgaacctgaccaacgccgagttcatccagttctacttcatgtacggctgcctgatcacccccaacaacagaaaccagggcgtgctgctggagtacagcgtgaacggcggcatcacctggaacctgctgatggagatcttctacgaccagtacagcaagcccggcttcgtgaacatcctgctgccccccgacgccaaggagatcgccaccagattcagatggtggcagcccagacacgacggcctggaccagaacgactgggccatcgacaacgtgctgatcagcggcagcgccgaccagagaaccgtgatgctggacaccttcagcagcgcccccgtgccccagcacgagagaagccccgccgacgccggccccgtgggcagaatcgccttcgacatgttcatggaggacaagaccagcgtgaacgagcactggctgttccacgacgactgcaccgtggagagattctgcgacagccccgacggcgtgatgctgtgcggcagccacgacggcagagaggtgtacgccgtgacccacgacctgacccccaccgagggctggatcatgcagttcaagatcagcgtgggctgcaaggtgagcgagaagatcgcccagaaccagatccacgtgcagtacagcaccgacttcggcgtgagctggaactacctggtgccccagtgcctgcccgccgaccccaagtgcagcggcagcgtgagccagcccagcgtgttcttccccaccaagggctggaagagaatcacctaccccctgcccgagagcctggtgggcaaccccgtgagattcagattctaccagaagtacagcgacatgcagtgggccatcgacaacttctacctgggccccggctgcctggacaactgcagaggccacggcgactgcctgagagagcagtgcatctgcgaccccggctacagcggccccaactgctacctgacccacaccctgaagaccttcctgaaggagagattcgacagcgaggagatcaagcccgacctgtggatgagcctggagggcggcagcacctgcaccgagtgcggcatcctggccgaggacaccgccctgtacttcggcggcagcaccgtgagacaggccgtgacccaggacctggacctgagaggcgccaagttcctgcagtactggggcagaatcggcagcgagaacaacatgaccagctgccacagacccatctgcagaaaggagggcgtgctgctggactacagcaccgacggcggcatcacctggaccctgctgcacgagatggactaccagaagtacatcagcgtgagacacgactacatcctgctgcccgaggacgccctgaccaacaccaccagactgagatggtggcagcccttcgtgatcagcaacggcatcgtggtgagcggcgtggagagagcccagtgggccctggacaacatcctgatcggcggcgccgagatcaaccccagccagctggtggacaccttcgacgacgagggcaccagccacgaggagaactggagcttctaccccaacgccgtgagaaccgccggcttctgcggcaaccccagcttccacctgtactggcccaacaagaagaaggacaagacccacaacgccctgagcagcagagagctgatcatccagcccggctacatgatgcagttcaagatcgtggtgggctgcgaggccaccagctgcggcgacctgcacagcgtgatgctggagtacaccaaggacgccagaagcgacagctggcagctggtgcagacccagtgcctgcccagcagcagcaacagcatcggctgcagccccttccagttccacgaggccaccatctacaacagcgtgaacagcagcagctggaagagaatcaccatccagctgcccgaccacgtgagcagcagcgccacccagttcagatggatccagaagggcgaggagaccgagaagcagagctgggccatcgaccacgtgtacatcggcgaggcctgccccaagctgtgcagcggccacggctactgcaccaccggcgccatctgcatctgcgacgagagcttccagggcgacgactgcagcgtgttcagccacgacctgcccagctacatcaaggacaacttcgagagcgccagagtgaccgaggccaactgggagaccatccagggcggcgtgatcggcagcggctgcggccagctggccccctacgcccacggcgacagcctgtacttcaacggctgccagatcagacaggccgccaccaagcccctggacctgaccagagccagcaagatcatgttcgtgctgcagatcggcagcatgagccagaccgacagctgcaacagcgacctgagcggcccccacgccgtggacaaggccgtgctgctgcagtacagcgtgaacaacggcatcacctggcacgtgatcgcccagcaccagcccaaggacttcacccaggcccagagagtgagctacaacgtgcccctggaggccagaatgaagggcgtgctgctgagatggtggcagcccagacacaacggcaccggccacgaccagtgggccctggaccacgtggaggtggtgctgttcagcaccagaaagcagaactacatgatgaacttcagcagacagcacggcctgagacacttctacaacagaagaagaagaagcctgagaagatacccctag

SEQ ID NO: 12637 - DNA, 2934 bp, Artificial Sequence
  Description of Artificial Sequence: Synthetic coding sequence
atgtgcagcggccacggcagatgcatccagggcaactgcgtgtgcgacgagcagtggggcggcctgtactgcgacgaccccgagaccagcctgcccacccagctgaaggacaacttcaacagagcccccagcagccagaactggctgaccgtgaacggcggcaagctgagcaccgtgtgcggcgccgtggccagcggcatggccctgcacttcagcggcggctgcagcagactgctggtgaccgtggacctgaacctgaccaacgccgagttcatccagttctacttcatgtacggctgcctgatcacccccaacaacagaaaccagggcgtgctgctggagtacagcgtgaacggcggcatcacctggaacctgctgatggagatcttctacgaccagtacagcaagcccggcttcgtgaacatcctgctgccccccgacgccaaggagatcgccaccagattcagatggtggcagcccagacacgacggcctggaccagaacgactgggccatcgacaacgtgctgatcagcggcagcgccgaccagagaaccgtgatgctggacaccttcagcagcgcccccgtgccccagcacgagagaagccccgccgacgccggccccgtgggcagaatcgccttcgacatgttcatggaggacaagaccagcgtgaacgagcactggctgttccacgacgactgcaccgtggagagattctgcgacagccccgacggcgtgatgctgtgcggcagccacgacggcagagaggtgtacgccgtgacccacgacctgacccccaccgagggctggatcatgcagttcaagatcagcgtgggctgcaaggtgagcgagaagatcgcccagaaccagatccacgtgcagtacagcaccgacttcggcgtgagctggaactacctggtgccccagtgcctgcccgccgaccccaagtgcagcggcagcgtgagccagcccagcgtgttcttccccaccaagggctggaagagaatcacctaccccctgcccgagagcctggtgggcaaccccgtgagattcagattctaccagaagtacagcgacatgcagtgggccatcgacaacttctacctgggccccggctgcctggacaactgcagaggccacggcgactgcctgagagagcagtgcatctgcgaccccggctacagcggccccaactgctacctgacccacaccctgaagaccttcctgaaggagagattcgacagcgaggagatcaagcccgacctgtggatgagcctggagggcggcagcacctgcaccgagtgcggcatcctggccgaggacaccgccctgtacttcggcggcagcaccgtgagacaggccgtgacccaggacctggacctgagaggcgccaagttcctgcagtactggggcagaatcggcagcgagaacaacatgaccagctgccacagacccatctgcagaaaggagggcgtgctgctggactacagcaccgacggcggcatcacctggaccctgctgcacgagatggactaccagaagtacatcagcgtgagacacgactacatcctgctgcccgaggacgccctgaccaacaccaccagactgagatggtggcagcccttcgtgatcagcaacggcatcgtggtgagcggcgtggagagagcccagtgggccctggacaacatcctgatcggcggcgccgagatcaaccccagccagctggtggacaccttcgacgacgagggcaccagccacgaggagaactggagcttctaccccaacgccgtgagaaccgccggcttctgcggcaaccccagcttccacctgtactggcccaacaagaagaaggacaagacccacaacgccctgagcagcagagagctgatcatccagcccggctacatgatgcagttcaagatcgtggtgggctgcgaggccaccagctgcggcgacctgcacagcgtgatgctggagtacaccaaggacgccagaagcgacagctggcagctggtgcagacccagtgcctgcccagcagcagcaacagcatcggctgcagccccttccagttccacgaggccaccatctacaacagcgtgaacagcagcagctggaagagaatcaccatccagctgcccgaccacgtgagcagcagcgccacccagttcagatggatccagaagggcgaggagaccgagaagcagagctgggccatcgaccacgtgtacatcggcgaggcctgccccaagctgtgcagcggccacggctactgcaccaccggcgccatctgcatctgcgacgagagcttccagggcgacgactgcagcgtgttcagccacgacctgcccagctacatcaaggacaacttcgagagcgccagagtgaccgaggccaactgggagaccatccagggcggcgtgatcggcagcggctgcggccagctggccccctacgcccacggcgacagcctgtacttcaacggctgccagatcagacaggccgccaccaagcccctggacctgaccagagccagcaagatcatgttcgtgctgcagatcggcagcatgagccagaccgacagctgcaacagcgacctgagcggcccccacgccgtggacaaggccgtgctgctgcagtacagcgtgaacaacggcatcacctggcacgtgatcgcccagcaccagcccaaggacttcacccaggcccagagagtgagctacaacgtgcccctggaggccagaatgaagggcgtgctgctgagatggtggcagcccagacacaacggcaccggccacgaccagtgggccctggaccacgtggaggtggtgctggtgaccaccagaaagcagaactacatgatgaacttcagcagacagcacggcctgagacacttctacaacagaagaagaagaagcctgagaagatacccctag

SEQ ID NO: 12638 - DNA, 10383 bp, Artificial Sequence
  Description of Artificial Sequence: Synthetic coding sequence
atggagagaagcggctgggccagacagaccttcctgctggccctgctgctgggcgccaccctgagagccagagccgccgccggctactaccccagattcagccccttcttcttcctgtgcacccaccacggcgagctggagggcgacggcgagcagggcgaggtgctgatcagcctgcacatcgccggcaaccccacctactacgtgcccggccaggagtaccacgtgaccatcagcaccagcaccttcttcgacggcctgctggtgaccggcctgtacaccagcaccagcgtgcaggccagccagagcatcggcggcagcagcgccttcggcttcggcatcatgagcgaccaccagttcggcaaccagttcatgtgcagcgtggtggccagccacgtgagccacctgcccaccaccaacctgagcttcatctggatcgccccccccgccggcaccggctgcgtgaacttcatggccaccgccacccacagaggccaggtgatcttcaaggacgccctggcccagcagctgtgcgagcagggcgcccccaccgacgtgaccgtgcacccccacctggccgagatccacagcgacagcatcatcctgagagacgacttcgacagctaccaccagctgcagctgaaccccaacatctgggtggagtgcaacaactgcgagaccggcgagcagtgcggcgccatcatgcacggcaacgccgtgaccttctgcgagccctacggccccagagagctgatcaccaccggcctgaacaccaccaccgccagcgtgctgcagttcagcatcggcagcggcagctgcagattcagctacagcgaccccagcatcatcgtgctgtacgccaagaacaacagcgccgactggatccagctggagaagatcagagcccccagcaacgtgagcaccatcatccacatcctgtacctgcccgaggacgccaagggcgagaacgtgcagttccagtggaagcaggagaacctgagagtgggcgaggtgtacgaggcctgctgggccctggacaacatcctgatcatcaacagcgcccacagacaggtggtgctggaggacagcctggaccccgtggacaccggcaactggctgttcttccccggcgccaccgtgaagcacagctgccagagcgacggcaacagcatctacttccacggcaacgagggcagcgagttcaacttcgccaccaccagagacgtggacctgagcaccgaggacatccaggagcagtggagcgaggagttcgagagccagcccaccggctgggacgtgctgggcgccgtgatcggcaccgagtgcggcaccatcgagagcggcctgagcatggtgttcctgaaggacggcgagagaaagctgtgcacccccagcatggacaccaccggctacggcaacctgagattctacttcgtgatgggcggcatctgcgaccccggcaacagccacgagaacgacatcatcctgtacgccaagatcgagggcagaaaggagcacatcaccctggacaccctgagctacagcagctacaaggtgcccagcctggtgagcgtggtgatcaaccccgagctgcagacccccgccaccaagttctgcctgagacagaagaaccaccagggccacaacagaaacgtgtgggccgtggacttcttccacgtgctgcccgtgctgcccagcaccatgagccacatgatccagttcagcatcaacctgggctgcggcacccaccagcccggcaacagcgtgagcctggagttcagcaccaaccacggcagaagctggagcctgctgcacaccgagtgcctgcccgagatctgcgccggcccccacctgccccacagcaccgtgtacagcagcgagaactacagcggctggaacagaatcaccatccccctgcccaacgccgccctgaccagaaacaccagaatcagatggagacagaccggccccatcctgggcaacatgtgggccatcgacaacgtgtacatcggccccagctgcctgaagttctgcagcggcagaggccagtgcaccagacacggctgcaagtgcgaccccggcttcagcggccccgcctgcgagatggccagccagaccttccccatgttcatcagcgagagcttcggcagcagcagactgagcagctaccacaacttctacagcatcagaggcgccgaggtgagcttcggctgcggcgtgctggccagcggcaaggccctggtgttcaacaaggacggcagaagacagctgatcaccagcttcctggacagcagccagagcagattcctgcagttcaccctgagactgggcagcaagagcgtgctgagcacctgcagagcccccgaccagcccggcgagggcgtgctgctgcactacagctacgacaacggcatcacctggaagctgctggagcactacagctacctgagctaccacgagcccagaatcatcagcgtggagctgcccggcgacgccaagcagttcggcatccagttcagatggtggcagccctaccacagcagccagagagaggacgtgtgggccatcgacgagatcatcatgaccagcgtgctgttcaacagcatcagcctggacttcaccaacctggtggaggtgacccagagcctgggcttctacctgggcaacgtgcagccctactgcggccacgactggaccctgtgcttcaccggcgacagcaagctggccagcagcatgagatacgtggagacccagagcatgcagatcggcgccagctacatgatccagttcagcctggtgatgggctgcggccagaagtacaccccccacatggacaaccaggtgaagctggagtacagcaccaaccacggcctgacctggcacctggtgcaggaggagtgcctgcccagcatgcccagctgccaggagttcaccagcgccagcatctaccacgccagcgagttcacccagtggagaagagtgatcgtgctgctgccccagaagacctggagcagcgccaccagattcagatggagccagagctactacaccgcccaggacgagtgggccctggacagcatctacatcggccagcagtgccccaacatgtgcagcggccacggcagctgcgaccacggcatctgcagatgcgaccagggctaccagggcaccgagtgccaccccgaggccgccctgcccagcaccatcatgagcgacttcgagaaccagaacggctgggagagcgactggcaggaggtgatcggcggcgagatcgtgaagcccgagcagggctgcggcgtgatcagcagcggcagcagcctgtacttcagcaaggccggcaagagacagctggtgagctgggacctggacaccagctgggtggacttcgtgcagttctacatccagatcggcggcgagagcgccagctgcaacaagcccgacagcagagaggagggcgtgctgctgcagtacagcaacaacggcggcatccagtggcacctgctggccgagatgtacttcagcgacttcagcaagcccagattcgtgtacctggagctgcccgccgccgccaagaccccctgcaccagattcagatggtggcagcccgtgttcagcggcgaggactacgaccagtgggccgtggacgacatcatcatcctgagcgagaagcagaagcagatcatccccgtgatcaaccccaccctgccccagaacttctacgagaagcccgccttcgactaccccatgaaccagatgagcgtgtggctgatgctggccaacgagggcatggtgaagaacgagaccttctgcgccgccacccccagcgccatgatcttcggcaagagcgacggcgacagattcgccgtgaccagagacctgaccctgaagcccggctacgtgctgcagttcaagctgaacatcggctgcgccaaccagttcagcagcaccgcccccgtgctgctgcagtacagccacgacgccggcatgagctggttcctggtgaaggagggctgctaccccgccagcgccggcaagggctgcgagggcaacagcagagagctgagcgagcccaccatgtaccacaccggcgacttcgaggagtggaccagaatcaccatcgtgatccccagaagcctggccagcagcaagaccagattcagatggatccaggagagcagcagccagaagaacgtgccccccttcggcctggacggcgtgtacatcagcgagccctgccccagctactgcagcggccacggcgactgcatcagcggcgtgtgcttctgcgacctgggctacaccgccgcccagggcacctgcgtgagcaacgtgcccaaccacaacgagatgttcgacagattcgagggcaagctgagccccctgtggtacaagatcaccggcgcccaggtgggcaccggctgcggcaccctgaacgacggcaagagcctgtacttcaacggccccggcaagagagaggccagaaccgtgcccctggacaccagaaacatcagactggtgcagttctacatccagatcggcagcaagaccagcggcatcacctgcatcaagcccagaaccagaaacgagggcctgatcgtgcagtacagcaacgacaacggcatcctgtggcacctgctgagagagctggacttcatgagcttcctggagccccagatcatcagcatcgacctgccccaggacgccaagacccccgccaccgccttcagatggtggcagccccagcacggcaagcacagcgcccagtgggccctggacgacgtgctgatcggcatgaacgacagcagccagaccggcttccaggacaagttcgacggcagcatcgacctgcaggccaactggtacagaatccagggcggccaggtggacatcgactgcctgagcatggacaccgccctgatcttcaccgagaacatcggcaagcccagatacgccgagacctgggacttccacgtgagcgccagcaccttcctgcagttcgagatgagcatgggctgcagcaagcccttcagcaacagccacagcgtgcagctgcagtacagcctgaacaacggcaaggactggcacctggtgaccgaggagtgcgtgccccccaccatcggctgcctgcactacaccgagagcagcatctacaccagcgagagattccagaactggaagagaatcaccgtgtacctgcccctgagcaccatcagccccagaaccagattcagatggatccaggccaactacaccgtgggcgccgacagctgggccatcgacaacgtggtgctggccagcggctgcccctggatgtgcagcggcagaggcatctgcgacgccggcagatgcgtgtgcgacagaggcttcggcggcccctactgcgtgcccgtggtgcccctgcccagcatcctgaaggacgacttcaacggcaacctgcaccccgacctgtggcccgaggtgtacggcgccgagagaggcaacctgaacggcgagaccatcaagagcggcaccagcctgatcttcaagggcgagggcctgagaatgctgatcagcagagacctggactgcaccaacaccatgtacgtgcagttcagcctgagattcatcgccaagagcacccccgagagaagccacagcatcctgctgcagttcagcatcagcggcggcatcacctggcacctgatggacgagttctacttcccccagaccaccaacatcctgttcatcaacgtgcccctgccctacaccgcccagaccaacgccaccagattcagactgtggcagccctacaacaacggcaagaaggaggagatctggatcgtggacgacttcatcatcgacggcaacaacgtgaacaaccccgtgatgctgctggacaccttcgacttcggccccagagaggacaactggttcttctaccccggcggcaacatcggcctgtactgcccctacagcagcaagggcgcccccgaggaggacagcgccatggtgttcgtgagcaacgaggtgggcgagcacagcatcaccaccagagacctgaacgtgaacgagaacaccatcatccagttcgagatcaacgtgggctgcagcaccgacagcagcagcgccgaccccgtgagactggagttcagcagagacttcggcgccacctggcacctgctgctgcccctgtgctaccacagcagcagccacgtgagcagcctgtgcagcaccgagcaccaccccagcagcacctactacgccggcaccatgcagggctggagaagagaggtggtgcacttcggcaagctgcacctgtgcggcagcgtgagattcagatggtaccagggcttctaccccgccggcagccagcccgtgacctgggccatcgacaacgtgtacatcggcccccagtgcgaggagatgtgcaacggccagggcagctgcatcaacggcaccaagtgcatctgcgaccccggctacagcggccccacctgcaagatcagcaccaagaaccccgacttcctgaaggacgacttcgagggccagctggagagcgacagattcctgctgatgagcggcggcaagcccagcagaaagtgcggcatcctgagcagcggcaacaacctgttcttcaacgaggacggcctgagaatgctgatgaccagagacctggacctgagccacgccagattcgtgcagttcttcatgagactgggctgcggcaagggcgtgcccgaccccagaagccagcccgtgctgctgcagtacagcctgaacggcggcctgagctggagcctgctgcaggagttcctgttcagcaacagcagcaacgtgggcagatacatcgccctggagatccccctgaaggccagaagcggcagcaccagactgagatggtggcagcccagcgagaacggccacttctacagcccctgggtgatcgaccagatcctgatcggcggcaacatcagcggcaacaccgtgctggaggacgacttcaccaccctggacagcagaaagtggctgctgcaccccggcggcaccaagatgcccgtgtgcggcagcaccggcgacgccctggtgttcatcgagaaggccagcaccagatacgtggtgagcaccgacgtggccgtgaacgaggacagcttcctgcagatcgacttcgccgccagctgcagcgtgaccgacagctgctacgccatcgagctggagtacagcgtggacctgggcctgagctggcaccccctggtgagagactgcctgcccaccaacgtggagtgcagcagataccacctgcagagaatcctggtgagcgacaccttcaacaagtggaccagaatcaccctgcccctgcccccctacaccagaagccaggccaccagattcagatggcaccagcccgcccccttcgacaagcagcagacctgggccatcgacaacgtgtacatcggcgacggctgcatcgacatgtgcagcggccacggcagatgcatccagggcaactgcgtgtgcgacgagcagtggggcggcctgtactgcgacgaccccgagaccagcctgcccacccagctgaaggacaacttcaacagagcccccagcagccagaactggctgaccgtgaacggcggcaagctgagcaccgtgtgcggcgccgtggccagcggcatggccctgcacttcagcggcggctgcagcagactgctggtgaccgtggacctgaacctgaccaacgccgagttcatccagttctacttcatgtacggctgcctgatcacccccaacaacagaaaccagggcgtgctgctggagtacagcgtgaacggcggcatcacctggaacctgctgatggagatcttctacgaccagtacagcaagcccggcttcgtgaacatcctgctgccccccgacgccaaggagatcgccaccagattcagatggtggcagcccagacacgacggcctggaccagaacgactgggccatcgacaacgtgctgatcagcggcagcgccgaccagagaaccgtgatgctggacaccttcagcagcgcccccgtgccccagcacgagagaagccccgccgacgccggccccgtgggcagaatcgccttcgacatgttcatggaggacaagaccagcgtgaacgagcactggctgttccacgacgactgcaccgtggagagattctgcgacagccccgacggcgtgatgctgtgcggcagccacgacggcagagaggtgtacgccgtgacccacgacctgacccccaccgagggctggatcatgcagttcaagatcagcgtgggctgcaaggtgagcgagaagatcgcccagaaccagatccacgtgcagtacagcaccgacttcggcgtgagctggaactacctggtgccccagtgcctgcccgccgaccccaagtgcagcggcagcgtgagccagcccagcgtgttcttccccaccaagggctggaagagaatcacctaccccctgcccgagagcctggtgggcaaccccgtgagattcagattctaccagaagtacagcgacatgcagtgggccatcgacaacttctacctgggccccggctgcctggacaactgcagaggccacggcgactgcctgagagagcagtgcatctgcgaccccggctacagcggccccaactgctacctgacccacaccctgaagaccttcctgaaggagagattcgacagcgaggagatcaagcccgacctgtggatgagcctggagggcggcagcacctgcaccgagtgcggcatcctggccgaggacaccgccctgtacttcggcggcagcaccgtgagacaggccgtgacccaggacctggacctgagaggcgccaagttcctgcagtactggggcagaatcggcagcgagaacaacatgaccagctgccacagacccatctgcagaaaggagggcgtgctgctggactacagcaccgacggcggcatcacctggaccctgctgcacgagatggactaccagaagtacatcagcgtgagacacgactacatcctgctgcccgaggacgccctgaccaacaccaccagactgagatggtggcagcccttcgtgatcagcaacggcatcgtggtgagcggcgtggagagagcccagtgggccctggacaacatcctgatcggcggcgccgagatcaaccccagccagctggtggacaccttcgacgacgagggcaccagccacgaggagaactggagcttctaccccaacgccgtgagaaccgccggcttctgcggcaaccccagcttccacctgtactggcccaacaagaagaaggacaagacccacaacgccctgagcagcagagagctgatcatccagcccggctacatgatgcagttcaagatcgtggtgggctgcgaggccaccagctgcggcgacctgcacagcgtgatgctggagtacaccaaggacgccagaagcgacagctggcagctggtgcagacccagtgcctgcccagcagcagcaacagcatcggctgcagccccttccagttccacgaggccaccatctacaacagcgtgaacagcagcagctggaagagaatcaccatccagctgcccgaccacgtgagcagcagcgccacccagttcagatggatccagaagggcgaggagaccgagaagcagagctgggccatcgaccacgtgtacatcggcgaggcctgccccaagctgtgcagcggccacggctactgcaccaccggcgccatctgcatctgcgacgagagcttccagggcgacgactgcagcgtgttcagccacgacctgcccagctacatcaaggacaacttcgagagcgccagagtgaccgaggccaactgggagaccatccagggcggcgtgatcggcagcggctgcggccagctggccccctacgcccacggcgacagcctgtacttcaacggctgccagatcagacaggccgccaccaagcccctggacctgaccagagccagcaagatcatgttcgtgctgcagatcggcagcatgagccagaccgacagctgcaacagcgacctgagcggcccccacgccgtggacaaggccgtgctgctgcagtacagcgtgaacaacggcatcacctggcacgtgatcgcccagcaccagcccaaggacttcacccaggcccagagagtgagctacaacgtgcccctggaggccagaatgaagggcgtgctgctgagatggtggcagcccagacacaacggcaccggccacgaccagtgggccctggaccacgtggaggtggtgctggtgagcaccagaaagcagaactacatgatgaacttcagcagacagcacggcctgagacacttctacaacagaagaagaagaagcctgagaagatacccctag

SEQ ID NO: 12639 - DNA, 10284 bp, Artificial Sequence
  Description of Artificial Sequence: Synthetic coding sequence
atggagagaagcggctgggccagacagaccttcctgctggccctgctgctgggcgccaccctgagagccagagccgccgccggctactaccccagattcagccccttcttcttcctgtgcacccaccacggcgagctggagggcgacggcgagcagggcgaggtgctgatcagcctgcacatcgccggcaaccccacctactacgtgcccggccaggagtaccacgtgaccatcagcaccagcaccttcttcgacggcctgctggtgaccggcctgtacaccagcaccagcgtgcaggccagccagagcatcggcggcagcagcgccttcggcttcggcatcatgagcgaccaccagttcggcaaccagttcatgtgcagcgtggtggccagccacgtgagccacctgcccaccaccaacctgagcttcatctggatcgccccccccgccggcaccggctgcgtgaacttcatggccaccgccacccacagaggccaggtgatcttcaaggacgccctggcccagcagctgtgcgagcagggcgcccccaccgacgtgaccgtgcacccccacctggccgagatccacagcgacagcatcatcctgagagacgacttcgacagctaccaccagctgcagctgaaccccaacatctgggtggagtgcaacaactgcgagaccggcgagcagtgcggcgccatcatgcacggcaacgccgtgaccttctgcgagccctacggccccagagagctgatcaccaccggcctgaacaccaccaccgccagcgtgctgcagttcagcatcggcagcggcagctgcagattcagctacagcgaccccagcatcatcgtgctgtacgccaagaacaacagcgccgactggatccagctggagaagatcagagcccccagcaacgtgagcaccatcatccacatcctgtacctgcccgaggacgccaagggcgagaacgtgcagttccagtggaagcaggagaacctgagagtgggcgaggtgtacgaggcctgctgggccctggacaacatcctgatcatcaacagcgcccacagacaggtggtgctggaggacagcctggaccccgtggacaccggcaactggctgttcttccccggcgccaccgtgaagcacagctgccagagcgacggcaacagcatctacttccacggcaacgagggcagcgagttcaacttcgccaccaccagagacgtggacctgagcaccgaggacatccaggagcagtggagcgaggagttcgagagccagcccaccggctgggacgtgctgggcgccgtgatcggcaccgagtgcggcaccatcgagagcggcctgagcatggtgttcctgaaggacggcgagagaaagctgtgcacccccagcatggacaccaccggctacggcaacctgagattctacttcgtgatgggcggcatctgcgaccccggcaacagccacgagaacgacatcatcctgtacgccaagatcgagggcagaaaggagcacatcaccctggacaccctgagctacagcagctacaaggtgcccagcctggtgagcgtggtgatcaaccccgagctgcagacccccgccaccaagttctgcctgagacagaagaaccaccagggccacaacagaaacgtgtgggccgtggacttcttccacgtgctgcccgtgctgcccagcaccatgagccacatgatccagttcagcatcaacctgggctgcggcacccaccagcccggcaacagcgtgagcctggagttcagcaccaaccacggcagaagctggagcctgctgcacaccgagtgcctgcccgagatctgcgccggcccccacctgccccacagcaccgtgtacagcagcgagaactacagcggctggaacagaatcaccatccccctgcccaacgccgccctgaccagaaacaccagaatcagatggagacagaccggccccatcctgggcaacatgtgggccatcgacaacgtgtacatcggccccagctgcctgaagttctgcagcggcagaggccagtgcaccagacacggctgcaagtgcgaccccggcttcagcggccccgcctgcgagatggccagccagaccttccccatgttcatcagcgagagcttcggcagcagcagactgagcagctaccacaacttctacagcatcagaggcgccgaggtgagcttcggctgcggcgtgctggccagcggcaaggccctggtgttcaacaaggacggcagaagacagctgatcaccagcttcctggacagcagccagagcagattcctgcagttcaccctgagactgggcagcaagagcgtgctgagcacctgcagagcccccgaccagcccggcgagggcgtgctgctgcactacagctacgacaacggcatcacctggaagctgctggagcactacagctacctgagctaccacgagcccagaatcatcagcgtggagctgcccggcgacgccaagcagttcggcatccagttcagatggtggcagccctaccacagcagccagagagaggacgtgtgggccatcgacgagatcatcatgaccagcgtgctgttcaacagcatcagcctggacttcaccaacctggtggaggtgacccagagcctgggcttctacctgggcaacgtgcagccctactgcggccacgactggaccctgtgcttcaccggcgacagcaagctggccagcagcatgagatacgtggagacccagagcatgcagatcggcgccagctacatgatccagttcagcctggtgatgggctgcggccagaagtacaccccccacatggacaaccaggtgaagctggagtacagcaccaaccacggcctgacctggcacctggtgcaggaggagtgcctgcccagcatgcccagctgccaggagttcaccagcgccagcatctaccacgccagcgagttcacccagtggagaagagtgatcgtgctgctgccccagaagacctggagcagcgccaccagattcagatggagccagagctactacaccgcccaggacgagtgggccctggacagcatctacatcggccagcagtgccccaacatgtgcagcggccacggcagctgcgaccacggcatctgcagatgcgaccagggctaccagggcaccgagtgccaccccgaggccgccctgcccagcaccatcatgagcgacttcgagaaccagaacggctgggagagcgactggcaggaggtgatcggcggcgagatcgtgaagcccgagcagggctgcggcgtgatcagcagcggcagcagcctgtacttcagcaaggccggcaagagacagctggtgagctgggacctggacaccagctgggtggacttcgtgcagttctacatccagatcggcggcgagagcgccagctgcaacaagcccgacagcagagaggagggcgtgctgctgcagtacagcaacaacggcggcatccagtggcacctgctggccgagatgtacttcagcgacttcagcaagcccagattcgtgtacctggagctgcccgccgccgccaagaccccctgcaccagattcagatggtggcagcccgtgttcagcggcgaggactacgaccagtgggccgtggacgacatcatcatcctgagcgagaagcagaagcagatcatccccgtgatcaaccccaccctgccccagaacttctacgagaagcccgccttcgactaccccatgaaccagatgagcgtgtggctgatgctggccaacgagggcatggtgaagaacgagaccttctgcgccgccacccccagcgccatgatcttcggcaagagcgacggcgacagattcgccgtgaccagagacctgaccctgaagcccggctacgtgctgcagttcaagctgaacatcggctgcgccaaccagttcagcagcaccgcccccgtgctgctgcagtacagccacgacgccggcatgagctggttcctggtgaaggagggctgctaccccgccagcgccggcaagggctgcgagggcaacagcagagagctgagcgagcccaccatgtaccacaccggcgacttcgaggagtggaccagaatcaccatcgtgatccccagaagcctggccagcagcaagaccagattcagatggatccaggagagcagcagccagaagaacgtgccccccttcggcctggacggcgtgtacatcagcgagccctgccccagctactgcagcggccacggcgactgcatcagcggcgtgtgcttctgcgacctgggctacaccgccgcccagggcacctgcgtgagcaacgtgcccaaccacaacgagatgttcgacagattcgagggcaagctgagccccctgtggtacaagatcaccggcgcccaggtgggcaccggctgcggcaccctgaacgacggcaagagcctgtacttcaacggccccggcaagagagaggccagaaccgtgcccctggacaccagaaacatcagactggtgcagttctacatccagatcggcagcaagaccagcggcatcacctgcatcaagcccagaaccagaaacgagggcctgatcgtgcagtacagcaacgacaacggcatcctgtggcacctgctgagagagctggacttcatgagcttcctggagccccagatcatcagcatcgacctgccccaggacgccaagacccccgccaccgccttcagatggtggcagccccagcacggcaagcacagcgcccagtgggccctggacgacgtgctgatcggcatgaacgacagcagccagaccggcttccaggacaagttcgacggcagcatcgacctgcaggccaactggtacagaatccagggcggccaggtggacatcgactgcctgagcatggacaccgccctgatcttcaccgagaacatcggcaagcccagatacgccgagacctgggacttccacgtgagcgccagcaccttcctgcagttcgagatgagcatgggctgcagcaagcccttcagcaacagccacagcgtgcagctgcagtacagcctgaacaacggcaaggactggcacctggtgaccgaggagtgcgtgccccccaccatcggctgcctgcactacaccgagagcagcatctacaccagcgagagattccagaactggaagagaatcaccgtgtacctgcccctgagcaccatcagccccagaaccagattcagatggatccaggccaactacaccgtgggcgccgacagctgggccatcgacaacgtggtgctggccagcggctgcccctggatgtgcagcggcagaggcatctgcgacgccggcagatgcgtgtgcgacagaggcttcggcggcccctactgcgtgcccgtggtgcccctgcccagcatcctgaaggacgacttcaacggcaacctgcaccccgacctgtggcccgaggtgtacggcgccgagagaggcaacctgaacggcgagaccatcaagagcggcaccagcctgatcttcaagggcgagggcctgagaatgctgatcagcagagacctggactgcaccaacaccatgtacgtgcagttcagcctgagattcatcgccaagagcacccccgagagaagccacagcatcctgctgcagttcagcatcagcggcggcatcacctggcacctgatggacgagttctacttcccccagaccaccaacatcctgttcatcaacgtgcccctgccctacaccgcccagaccaacgccaccagattcagactgtggcagccctacaacaacggcaagaaggaggagatctggatcgtggacgacttcatcatcgacggcaacaacgtgaacaaccccgtgatgctgctggacaccttcgacttcggccccagagaggacaactggttcttctaccccggcggcaacatcggcctgtactgcccctacagcagcaagggcgcccccgaggaggacagcgccatggtgttcgtgagcaacgaggtgggcgagcacagcatcaccaccagagacctgaacgtgaacgagaacaccatcatccagttcgagatcaacgtgggctgcagcaccgacagcagcagcgccgaccccgtgagactggagttcagcagagacttcggcgccacctggcacctgctgctgcccctgtgctaccacagcagcagccacgtgagcagcctgtgcagcaccgagcaccaccccagcagcacctactacgccggcaccatgcagggctggagaagagaggtggtgcacttcggcaagctgcacctgtgcggcagcgtgagattcagatggtaccagggcttctaccccgccggcagccagcccgtgacctgggccatcgacaacgtgtacatcggcccccagtgcgaggagatgtgcaacggccagggcagctgcatcaacggcaccaagtgcatctgcgaccccggctacagcggccccacctgcaagatcagcaccaagaaccccgacttcctgaaggacgacttcgagggccagctggagagcgacagattcctgctgatgagcggcggcaagcccagcagaaagtgcggcatcctgagcagcggcaacaacctgttcttcaacgaggacggcctgagaatgctgatgaccagagacctggacctgagccacgccagattcgtgcagttcttcatgagactgggctgcggcaagggcgtgcccgaccccagaagccagcccgtgctgctgcagtacagcctgaacggcggcctgagctggagcctgctgcaggagttcctgttcagcaacagcagcaacgtgggcagatacatcgccctggagatccccctgaaggccagaagcggcagcaccagactgagatggtggcagcccagcgagaacggccacttctacagcccctgggtgatcgaccagatcctgatcggcggcaacatcagcggcaacaccgtgctggaggacgacttcaccaccctggacagcagaaagtggctgctgcaccccggcggcaccaagatgcccgtgtgcggcagcaccggcgacgccctggtgttcatcgagaaggccagcaccagatacgtggtgagcaccgacgtggccgtgaacgaggacagcttcctgcagatcgacttcgccgccagctgcagcgtgaccgacagctgctacgccatcgagctggagtacagcgtggacctgggcctgagctggcaccccctggtgagagactgcctgcccaccaacgtggagtgcagcagataccacctgcagagaatcctggtgagcgacaccttcaacaagtggaccagaatcaccctgcccctgcccccctacaccagaagccaggccaccagattcagatggcaccagcccgcccccttcgacaagcagcagacctgggccatcgacaacgtgtacatcggcgacggctgcatcgacatgtgcagcggccacggcagatgcatccagggcaactgcgtgtgcgacgagcagtggggcggcctgtactgcgacgaccccgagaccagcctgcccacccagctgaaggacaacttcaacagagcccccagcagccagaactggctgaccgtgaacggcggcaagctgagcaccgtgtgcggcgccgtggccagcggcatggccctgcacttcagcggcggctgcagcagactgctggtgaccgtggacctgaacctgaccaacgccgagttcatccagttctacttcatgtacggctgcctgatcacccccaacaacagaaaccagggcgtgctgctggagtacagcgtgaacggcggcatcacctggaacctgctgatggagatcttctacgaccagtacagcaagcccggcttcgtgaacatcctgctgccccccgacgccaaggagatcgccaccagattcagatggtggcagcccagacacgacggcctggaccagaacgactgggccatcgacaacgtgctgatcagcggcagcgccgaccagagaaccgtgatgctggacaccttcagcagcgcccccgtgccccagcacgagagaagccccgccgacgccggccccgtgggcagaatcgccttcgacatgttcatggaggacaagaccagcgtgaacgagcactggctgttccacgacgactgcaccgtggagagattctgcgacagccccgacggcgtgatgctgtgcggcagccacgacggcagagaggtgtacgccgtgacccacgacctgacccccaccgagggctggatcatgcagttcaagatcagcgtgggctgcaaggtgagcgagaagatcgcccagaaccagatccacgtgcagtacagcaccgacttcggcgtgagctggaactacctggtgccccagtgcctgcccgccgaccccaagtgcagcggcagcgtgagccagcccagcgtgttcttccccaccaagggctggaagagaatcacctaccccctgcccgagagcctggtgggcaaccccgtgagattcagattctaccagaagtacagcgacatgcagtgggccatcgacaacttctacctgggccccggctgcctggacaactgcagaggccacggcgactgcctgagagagcagtgcatctgcgaccccggctacagcggccccaactgctacctgacccacaccctgaagaccttcctgaaggagagattcgacagcgaggagatcaagcccgacctgtggatgagcctggagggcggcagcacctgcaccgagtgcggcatcctggccgaggacaccgccctgtacttcggcggcagcaccgtgagacaggccgtgacccaggacctggacctgagaggcgccaagttcctgcagtactggggcagaatcggcagcgagaacaacatgaccagctgccacagacccatctgcagaaaggagggcgtgctgctggactacagcaccgacggcggcatcacctggaccctgctgcacgagatggactaccagaagtacatcagcgtgagacacgactacatcctgctgcccgaggacgccctgaccaacaccaccagactgagatggtggcagcccttcgtgatcagcaacggcatcgtggtgagcggcgtggagagagcccagtgggccctggacaacatcctgatcggcggcgccgagatcaaccccagccagctggtggacaccttcgacgacgagggcaccagccacgaggagaactggagcttctaccccaacgccgtgagaaccgccggcttctgcggcaaccccagcttccacctgtactggcccaacaagaagaaggacaagacccacaacgccctgagcagcagagagctgatcatccagcccggctacatgatgcagttcaagatcgtggtgggctgcgaggccaccagctgcggcgacctgcacagcgtgatgctggagtacaccaaggacgccagaagcgacagctggcagctggtgcagacccagtgcctgcccagcagcagcaacagcatcggctgcagccccttccagttccacgaggccaccatctacaacagcgtgaacagcagcagctggaagagaatcaccatccagctgcccgaccacgtgagcagcagcgccacccagttcagatggatccagaagggcgaggagaccgagaagcagagctgggccatcgaccacgtgtacatcggcgaggcctgccccaagctgtgcagcggccacggctactgcaccaccggcgccatctgcatctgcgacgagagcttccagggcgacgactgcagcgtgttcagccacgacctgcccagctacatcaaggacaacttcgagagcgccagagtgaccgaggccaactgggagaccatccagggcggcgtgatcggcagcggctgcggccagctggccccctacgcccacggcgacagcctgtacttcaacggctgccagatcagacaggccgccaccaagcccctggacctgaccagagccagcaagatcatgttcgtgctgcagatcggcagcatgagccagaccgacagctgcaacagcgacctgagcggcccccacgccgtggacaaggccgtgctgctgcagtacagcgtgaacaacggcatcacctggcacgtgatcgcccagcaccagcccaaggacttcacccaggcccagagagtgagctacaacgtgcccctggaggccagaatgaagggcgtgctgctgagatggtggcagcccagacacaacggcaccggccacgaccagtgggccctggaccacgtggaggtggtgctgtag

SEQ ID NO: 12640 - DNA, 1668 bp, Artificial Sequence
  Description of Artificial Sequence: Synthetic coding sequence
atgaagaagcacgacttcgccgagaacctgcccagcagcctgctgatcatcatcctggtgatcttcaccctgagcggcagcaagttcggcagaggcaccggcctgacccagcccagccagagaaccagcgccagaagaagcttcggcagaagcaagagattcagcatcaccagaagcctggacgacctggagagcgccaccgtgagcgacggcgagctgaccggcgccgacctgaaggactgcgtgagcaacaacagcctgagcagcaacgccagcctgcccagcgtgcagagctgcagaagactgagagagagaagagtggccagctgggccgtgagcttcgagagactgctgcaggaccccgtgggcgtgagatacttcagcgacttcctgagaaaggagttcagcgaggagaacatcctgttctggcaggcctgcgagtacttcaaccacgtgcccgcccacgacaagaaggagctgagctacagagccagagagatcttcagcaagttcctgtgcagcaaggccaccacccccgtgaacatcgacagccaggcccagctggccgacgacgtgctgagagccccccaccccgacatgttcaaggagcagcagctgcagatcttcaacctgatgaagttcgacagctacaccagattcctgaagagccccctgtaccaggagtgcatcctggccgaggtggagggcagagccctgcccgacagccagcaggtgcccagcagccccgccagcaagcacagcctgggcagcgaccacagcagcgtgagcacccccaagaagctgagcggcaagagcaagagcggcagaagcctgaacgaggagctgggcgacgaggacagcgagaagaagagaaagggcgccttcttcagctggagcagaaccagaagcaccggcagaagccagaagaagagagagcacggcgaccacgccgacgacgccctgcacgccaacggcggcctgtgcagaagagagagccagggcagcgtgagcagcgccggcagcctggacctgagcgaggcctgcagaaccctggcccccgagaaggacaaggccaccaagcactgctgcatccacctgcccgacggcaccagctgcgtggtggccgtgaaggccggcttcagcatcaaggacatcctgagcggcctgtgcgagagacacggcatcaacggcgccgccgccgacctgttcctggtgggcggcgacaagcccctggtgctgcaccaggacagcagcatcctggagagcagagacctgagactggagaagagaaccctgttcagactggacctggtgcccatcaacagaagcgtgggcctgaaggccaagcccaccaagcccgtgaccgaggtgctgagacccgtggtggccagatacggcctggacctgagcggcctgctggtgagactgagcggcgagaaggagcccctggacctgggcgcccccatcagcagcctggacggccagagagtggtgctggaggagaaggaccccagcagaggcaaggccagcgccgacaagcagaagggcgtgcccgtgaagcagaacaccgccgtgaacagcagcagcagaaaccacagcgccaccagcttcctgagcctgttccccaagctgagagccaccgagcagatgaccaacgtgggctgctag

SEQ ID NO: 12641 - DNA, 4131 bp, Artificial Sequence
  Description of Artificial Sequence: Synthetic coding sequence
atgttcagagccggcgaggccagcaagagacccctgcccggccccagcccccccagagtgagaagcgtggaggtggccagaggcagagccggctacggcttcaccctgagcggccaggccccctgcgtgctgagctgcgtgatgagaggcagccccgccgacttcgtgggcctgagagccggcgaccagatcctggccgtgaacgagatcaacgtgaagaaggccagccacgaggacgtggtgaagctgatcggcaagtgcagcggcgtgctgcacatggtgatcgccgagggcgtgggcagattcgagagctgcagcagcgacgaggagggcggcctgtacgagggcaagggctggctgaagcccaagctggacagcaaggccctgggcatcaacagagccgagagagtggtggaggagatgcagagcggcggcatcttcaacatgatcttcgagaaccccagcctgtgcgccagcaacagcgagcccctgaagctgaagcagagaagcctgagcgagagcgccgccaccagattcgacgtgggccacgagagcatcaacaaccccaaccccaacatgctgagcaaggaggagatcagcaaggtgatccacgacgacagcgtgttcagcatcggcctggagagccacgacgacttcgccctggacgccagcatcctgaacgtggccatgatcgtgggctacctgggcagcatcgagctgcccagcaccagcagcaacctggagagcgacagcctgcaggccatcagaggctgcatgagaagactgagagccgagcagaagatccacagcctggtgaccatgaagatcatgcacgactgcgtgcagctgagcaccgacaaggccggcgtggtggccgagtaccccgccgagaagctggccttcagcgccgtgtgccccgacgacagaagattcttcggcctggtgaccatgcagaccaacgacgacggcagcctggcccaggaggaggagggcgccctgagaaccagctgccacgtgttcatggtggaccccgacctgttcaaccacaagatccaccagggcatcgccagaagattcggcttcgagtgcaccgccgaccccgacaccaacggctgcctggagttccccgccagcagcctgcccgtgctgcagttcatcagcgtgctgtacagagacatgggcgagctgatcgagggcatgagagccagagccttcctggacggcgacgccgacgcccaccagaacaacagcaccagcagcaacagcgacagcggcatcggcaacttccaccaggaggagaagagcaacagagtgctggtggtggacctgggcggcagcagcagcagacacggccccggcggcagcgcctgggacggcgtgggcggcagaggcgcccagccctggggcgccccctggaccggccccttctgccccgaccccgagggcagcccccccttcgaggccgcccaccagaccgacagattctgggacctgaacaagcacctgggccccgccagccccgtggaggtgccccccgccagcctgagaagcagcgtgccccccagcaagagaggcaccgtgggcgccggctgcggcttcaaccagagatggctgcccgtgcacgtgctgagagagtggcagtgcggccacaccagcgaccaggacagctacaccgacagcaccgacggctggagcagcatcaactgcggcaccctgcccccccccatgagcaagatccccgccgacagatacagagtggagggcagcttcgcccagccccccctgaacgcccccaagagagagtggagcagaaaggccttcggcatgcagagcatcttcggcccccacagaaacgtgagaaagaccaaggaggacaagaagggcagcaagttcggcagaggcaccggcctgacccagcccagccagagaaccagcgccagaagaagcttcggcagaagcaagagattcagcatcaccagaagcctggacgacctggagagcgccaccgtgagcgacggcgagctgaccggcgccgacctgaaggactgcgtgagcaacaacagcctgagcagcaacgccagcctgcccagcgtgcagagctgcagaagactgagagagagaagagtggccagctgggccgtgagcttcgagagactgctgcaggaccccgtgggcgtgagatacttcagcgacttcctgagaaaggagttcagcgaggagaacatcctgttctggcaggcctgcgagtacttcaaccacgtgcccgcccacgacaagaaggagctgagctacagagccagagagatcttcagcaagttcctgtgcagcaaggccaccacccccgtgaacatcgacagccaggcccagctggccgacgacgtgctgagagccccccaccccgacatgttcaaggagcagcagctgcagatcttcaacctgatgaagttcgacagctacaccagattcctgaagagccccctgtaccaggagtgcatcctggccgaggtggagggcagagccctgcccgacagccagcaggtgcccagcagccccgccagcaagcacagcctgggcagcgaccacagcagcgtgagcacccccaagaagctgagcggcaagagcaagagcggcagaagcctgaacgaggagctgggcgacgaggacagcgagaagaagagaaagggcgccttcttcagctggagcagaaccagaagcaccggcagaagccagaagaagagagagcacggcgaccacgccgacgacgccctgcacgccaacggcggcctgtgcagaagagagagccagggcagcgtgagcagcgccggcagcctggacctgagcgaggcctgcagaaccctggcccccgagaaggacaaggccaccaagcactgctgcatccacctgcccgacggcaccagctgcgtggtggccgtgaaggccggcttcagcatcaaggacatcctgagcggcctgtgcgagagacacggcatcaacggcgccgccgccgacctgttcctggtgggcggcgacaagcccctggtgctgcaccaggacagcagcatcctggagagcagagacctgagactggagaagagaaccctgttcagactggacctggtgcccatcaacagaagcgtgggcctgaaggccaagcccaccaagcccgtgaccgaggtgctgagacccgtggtggccagatacggcctggacctgagcggcctgctggtgagactgagcggcgagaaggagcccctggacctgggcgcccccatcagcagcctggacggccagagagtggtgctggaggagaaggaccccagcagaggcaaggccagcgccgacaagcagaagggcgtgcccgtgaagcagaacaccgccgtgaacagcagcagcagaaaccacagcgccaccggcgaggagagaaccctgggcaagagcaacagcatcaagatcaagggcgagaacggcaagaacgccagagaccccagactgagcaagagagaggagagcatcgccaagatcggcaagaagaagtaccagaagatcaacctggacgaggccgaggagttcttcgagctgatcagcaaggcccagagcaacagagccgacgaccagagaggcctgctgagaaaggaggacctggtgctgcccgagttcctgagactgccccccggcagcaccgagctgaccctgcccacccccgccgccgtggccaagggcttcagcaagagaagcgccaccggcaacggcagagagagcgccagccagcccggcgagcagtgggagcccgtgcaggagagcagcgacagccccagcaccagccccggcagcgccagcagcccccccggcccccccggcaccaccccccccggccagaagagccccagcggccccttctgcaccccccagagccccgtgagcctggcccaggagggcaccgcccagatctggaagagacagagccaggaggtggaggccggcggcatccagaccgtggaggacgagcacgtggccgagctgaccctgatgggcgagggcgacatcagcagccccaacagcaccctgctgcccccccccagcaccccccaggaggtgcccggccccagcagacccggcaccagcagattctag

SEQ ID NO: 12642 - DNA, 2400 bp, Artificial Sequence
  Description of Artificial Sequence: Synthetic coding sequence
atgaacctgggcaaggagctgagcaacgagacccacgtgagcaacgaccagcagagcgccaccgtgagcgacggcgagctgaccggcgccgacctgaaggactgcgtgagcaacaacagcctgagcagcaacgccagcctgcccagcgtgcagagctgcagaagactgagagagagaagagtggccagctgggccgtgagcttcgagagactgctgcaggaccccgtgggcgtgagatacttcagcgacttcctgagaaaggagttcagcgaggagaacatcctgttctggcaggcctgcgagtacttcaaccacgtgcccgcccacgacaagaaggagctgagctacagagccagagagatcttcagcaagttcctgtgcagcaaggccaccacccccgtgaacatcgacagccaggcccagctggccgacgacgtgctgagagccccccaccccgacatgttcaaggagcagcagctgcagatcttcaacctgatgaagttcgacagctacaccagattcctgaagagccccctgtaccaggagtgcatcctggccgaggtggagggcagagccctgcccgacagccagcaggtgcccagcagccccgccagcaagcacagcctgggcagcgaccacagcagcgtgagcacccccaagaagctgagcggcaagagcaagagcggcagaagcctgaacgaggagctgggcgacgaggacagcgagaagaagagaaagggcgccttcttcagctggagcagaaccagaagcaccggcagaagccagaagaagagagagcacggcgaccacgccgacgacgccctgcacgccaacggcggcctgtgcagaagagagagccagggcagcgtgagcagcgccggcagcctggacctgagcgaggcctgcagaaccctggcccccgagaaggacaaggccaccaagcactgctgcatccacctgcccgacggcaccagctgcgtggtggccgtgaaggccggcttcagcatcaaggacatcctgagcggcctgtgcgagagacacggcatcaacggcgccgccgccgacctgttcctggtgggcggcgacaagcccctggtgctgcaccaggacagcagcatcctggagagcagagacctgagactggagaagagaaccctgttcagactggacctggtgcccatcaacagaagcgtgggcctgaaggccaagcccaccaagcccgtgaccgaggtgctgagacccgtggtggccagatacggcctggacctgagcggcctgctggtgagactgagcggcgagaaggagcccctggacctgggcgcccccatcagcagcctggacggccagagagtggtgctggaggagaaggaccccagcagaggcaaggccagcgccgacaagcagaagggcgtgcccgtgaagcagaacaccgccgtgaacagcagcagcagaaaccacagcgccaccggcgaggagagaaccctgggcaagagcaacagcatcaagatcaagggcgagaacggcaagaacgccagagaccccagactgagcaagagagaggagagcatcgccaagatcggcaagaagaagtaccagaagatcaacctggacgaggccgaggagttcttcgagctgatcagcaaggcccagagcaacagagccgacgaccagagaggcctgctgagaaaggaggacctggtgctgcccgagttcctgagactgccccccggcagcaccgagctgaccctgcccacccccgccgccgtggccaagggcttcagcaagagaagcgccaccggcaacggcagagagagcgccagccagcccggcgagcagtgggagcccgtgcaggagagcagcgacagccccagcaccagccccggcagcgccagcagcccccccggcccccccggcaccaccccccccggccagaagagccccagcggccccttctgcaccccccagagccccgtgagcctggcccaggagggcaccgcccagatctggaagagacagagccaggaggtggaggccggcggcatccagaccgtggaggacgagcacgtggccgagctgaccctgatgggcgagggcgacatcagcagccccaacagcaccctgctgcccccccccagcaccccccaggaggtgcccggccccagcagacccggcagcggcacccacggcagcagagacctgcccgtgaacagaatcatcgacgtggacctggtgaccggcagcgcccccggcagagacggcggcatcgccggcgcccaggccggccccggcagaagccaggccagcggcggcccccccaccagcgacctgcccggcctgggccccgtgcccggcgagcccgccaagcccaagaccagcgcccaccacgccaccttcgtgtag

SEQ ID NO: 12643 - DNA, 4344 bp, Artificial Sequence
  Description of Artificial Sequence: Synthetic coding sequence
atgttcagagccggcgaggccagcaagagacccctgcccggccccagcccccccagagtgagaagcgtggaggtggccagaggcagagccggctacggcttcaccctgagcggccaggccccctgcgtgctgagctgcgtgatgagaggcagccccgccgacttcgtgggcctgagagccggcgaccagatcctggccgtgaacgagatcaacgtgaagaaggccagccacgaggacgtggtgaagctgatcggcaagtgcagcggcgtgctgcacatggtgatcgccgagggcgtgggcagattcgagagctgcagcagcgacgaggagggcggcctgtacgagggcaagggctggctgaagcccaagctggacagcaaggccctgggcatcaacagagccgagagagtggtggaggagatgcagagcggcggcatcttcaacatgatcttcgagaaccccagcctgtgcgccagcaacagcgagcccctgaagctgaagcagagaagcctgagcgagagcgccgccaccagattcgacgtgggccacgagagcatcaacaaccccaaccccaacatgctgagcaaggaggagatcagcaaggtgatccacgacgacagcgtgttcagcatcggcctggagagccacgacgacttcgccctggacgccagcatcctgaacgtggccatgatcgtgggctacctgggcagcatcgagctgcccagcaccagcagcaacctggagagcgacagcctgcaggccatcagaggctgcatgagaagactgagagccgagcagaagatccacagcctggtgaccatgaagatcatgcacgactgcgtgcagctgagcaccgacaaggccggcgtggtggccgagtaccccgccgagaagctggccttcagcgccgtgtgccccgacgacagaagattcttcggcctggtgaccatgcagaccaacgacgacggcagcctggcccaggaggaggagggcgccctgagaaccagctgccacgtgttcatggtggaccccgacctgttcaaccacaagatccaccagggcatcgccagaagattcggcttcgagtgcaccgccgaccccgacaccaacggctgcctggagttccccgccagcagcctgcccgtgctgcagttcatcagcgtgctgtacagagacatgggcgagctgatcgagggcatgagagccagagccttcctggacggcgacgccgacgcccaccagaacaacagcaccagcagcaacagcgacagcggcatcggcaacttccaccaggaggagaagagcaacagagtgctggtggtggacctgggcggcagcagcagcagacacggccccggcggcagcgcctgggacggcgtgggcggcagaggcgcccagccctggggcgccccctggaccggccccttctgccccgaccccgagggcagcccccccttcgaggccgcccaccagaccgacagattctgggacctgaacaagcacctgggccccgccagccccgtggaggtgccccccgccagcctgagaagcagcgtgccccccagcaagagaggcaccgtgggcgccggctgcggcttcaaccagagatggctgcccgtgcacgtgctgagagagtggcagtgcggccacaccagcgaccaggacagctacaccgacagcaccgacggctggagcagcatcaactgcggcaccctgcccccccccatgagcaagatccccgccgacagatacagagtggagggcagcttcgcccagccccccctgaacgcccccaagagagagtggagcagaaaggccttcggcatgcagagcatcttcggcccccacagaaacgtgagaaagaccaaggaggacaagaagggcagcaagttcggcagaggcaccggcctgacccagcccagccagagaaccagcgccagaagaagcttcggcagaagcaagagattcagcatcaccagaagcctggacgacctggagagcgccaccgtgagcgacggcgagctgaccggcgccgacctgaaggactgcgtgagcaacaacagcctgagcagcaacgccagcctgcccagcgtgcagagctgcagaagactgagagagagaagagtggccagctgggccgtgagcttcgagagactgctgcaggaccccgtgggcgtgagatacttcagcgacttcctgagaaaggagttcagcgaggagaacatcctgttctggcaggcctgcgagtacttcaaccacgtgcccgcccacgacaagaaggagctgagctacagagccagagagatcttcagcaagttcctgtgcagcaaggccaccacccccgtgaacatcgacagccaggcccagctggccgacgacgtgctgagagccccccaccccgacatgttcaaggagcagcagctgcagatcttcaacctgatgaagttcgacagctacaccagattcctgaagagccccctgtaccaggagtgcatcctggccgaggtggagggcagagccctgcccgacagccagcaggtgcccagcagccccgccagcaagcacagcctgggcagcgaccacagcagcgtgagcacccccaagaagctgagcggcaagagcaagagcggcagaagcctgaacgaggagctgggcgacgaggacagcgagaagaagagaaagggcgccttcttcagctggagcagaaccagaagcaccggcagaagccagaagaagagagagcacggcgaccacgccgacgacgccctgcacgccaacggcggcctgtgcagaagagagagccagggcagcgtgagcagcgccggcagcctggacctgagcgaggcctgcagaaccctggcccccgagaaggacaaggccaccaagcactgctgcatccacctgcccgacggcaccagctgcgtggtggccgtgaaggccggcttcagcatcaaggacatcctgagcggcctgtgcgagagacacggcatcaacggcgccgccgccgacctgttcctggtgggcggcgacaagcccctggtgctgcaccaggacagcagcatcctggagagcagagacctgagactggagaagagaaccctgttcagactggacctggtgcccatcaacagaagcgtgggcctgaaggccaagcccaccaagcccgtgaccgaggtgctgagacccgtggtggccagatacggcctggacctgagcggcctgctggtgagactgagcggcgagaaggagcccctggacctgggcgcccccatcagcagcctggacggccagagagtggtgctggaggagaaggaccccagcagaggcaaggccagcgccgacaagcagaagggcgtgcccgtgaagcagaacaccgccgtgaacagcagcagcagaaaccacagcgccaccggcgaggagagaaccctgggcaagagcaacagcatcaagatcaagggcgagaacggcaagaacgccagagaccccagactgagcaagagagaggagagcatcgccaagatcggcaagaagaagtaccagaagatcaacctggacgaggccgaggagttcttcgagctgatcagcaaggcccagagcaacagagccgacgaccagagaggcctgctgagaaaggaggacctggtgctgcccgagttcctgagactgccccccggcagcaccgagctgaccctgcccacccccgccgccgtggccaagggcttcagcaagagaagcgccaccggcaacggcagagagagcgccagccagcccggcgagcagtgggagcccgtgcaggagagcagcgacagccccagcaccagccccggcagcgccagcagcccccccggcccccccggcaccaccccccccggccagaagagccccagcggccccttctgcaccccccagagccccgtgagcctggcccaggagggcaccgcccagatctggaagagacagagccaggaggtggaggccggcggcatccagaccgtggaggacgagcacgtggccgagctgaccctgatgggcgagggcgacatcagcagccccaacagcaccctgctgcccccccccagcaccccccaggaggtgcccggccccagcagacccggcagcggcacccacggcagcagagacctgcccgtgaacagaatcatcgacgtggacctggtgaccggcagcgcccccggcagagacggcggcatcgccggcgcccaggccggccccggcagaagccaggccagcggcggcccccccaccagcgacctgcccggcctgggccccgtgcccggcgagcccgccaagcccaagaccagcgcccaccacgccaccttcgtgtag

SEQ ID NO: 12644 - DNA, 4131 bp, Artificial Sequence; identical to SEQ ID NO: 12641
  Description of Artificial Sequence: Synthetic coding sequence

SEQ ID NO: 12645 - DNA, 1500 bp, Artificial Sequence
  Description of Artificial Sequence: Synthetic coding sequence
atgagcctgagcctgttcttccagagcgccaccgtgagcgacggcgagctgaccggcgccgacctgaaggactgcgtgagcaacaacagcctgagcagcaacgccagcctgcccagcgtgcagagctgcagaagactgagagagagaagagtggccagctgggccgtgagcttcgagagactgctgcaggaccccgtgggcgtgagatacttcagcgacttcctgagaaaggagttcagcgaggagaacatcctgttctggcaggcctgcgagtacttcaaccacgtgcccgcccacgacaagaaggagctgagctacagagccagagagatcttcagcaagttcctgtgcagcaaggccaccacccccgtgaacatcgacagccaggcccagctggccgacgacgtgctgagagccccccaccccgacatgttcaaggagcagcagctgcagatcttcaacctgatgaagttcgacagctacaccagattcctgaagagccccctgtaccaggagtgcatcctggccgaggtggagggcagagccctgcccgacagccagcaggtgcccagcagccccgccagcaagcacagcctgggcagcgaccacagcagcgtgagcacccccaagaagctgagcggcaagagcaagagcggcagaagcctgaacgaggagctgggcgacgaggacagcgagaagaagagaaagggcgccttcttcagctggagcagaaccagaagcaccggcagaagccagaagaagagagagcacggcgaccacgccgacgacgccctgcacgccaacggcggcctgtgcagaagagagagccagggcagcgtgagcagcgccggcagcctggacctgagcgaggcctgcagaaccctggcccccgagaaggacaaggccaccaagcactgctgcatccacctgcccgacggcaccagctgcgtggtggccgtgaaggccggcttcagcatcaaggacatcctgagcggcctgtgcgagagacacggcatcaacggcgccgccgccgacctgttcctggtgggcggcgacaagcccctggtgctgcaccaggacagcagcatcctggagagcagagacctgagactggagaagagaaccctgttcagactggacctggtgcccatcaacagaagcgtgggcctgaaggccaagcccaccaagcccgtgaccgaggtgctgagacccgtggtggccagatacggcctggacctgagcggcctgctggtgagactgagcggcgagaaggagcccctggacctgggcgcccccatcagcagcctggacggccagagagtggtgctggaggagaaggaccccagcagaggcaaggccagcgccgacaagcagaagggcgtgcccgtgaagcagaacaccgccgtgaacagcagcagcagaaaccacagcgccaccagcttcctgagcctgttccccaagctgagagccaccgagcagatgaccaacgtgggctgctag

SEQ ID NO: 12646 - DNA, 2004 bp, Artificial Sequence
  Description of Artificial Sequence: Synthetic coding sequence
atgttcagagccggcgaggccagcaagagacccctgcccggccccagcccccccagagtgagaagcgtggaggtggccagaggcagagccggctacggcttcaccctgagcggccaggccccctgcgtgctgagctgcgtgatgagaggcagccccgccgacttcgtgggcctgagagccggcgaccagatcctggccgtgaacgagatcaacgtgaagaaggccagccacgaggacgtggtgaagctgatcggcaagtgcagcggcgtgctgcacatggtgatcgccgagggcgtgggcagattcgagagctgcagcagcgacgaggagggcggcctgtacgagggcaagggctggctgaagcccaagctggacagcaaggccctgggcatcaacagagccgagagagtggtggaggagatgcagagcggcggcatcttcaacatgatcttcgagaaccccagcctgtgcgccagcaacagcgagcccctgaagctgaagcagagaagcctgagcgagagcgccgccaccagattcgacgtgggccacgagagcatcaacaaccccaaccccaacatgctgagcaaggaggagatcagcaaggtgatccacgacgacagcgtgttcagcatcggcctggagagccacgacgacttcgccctggacgccagcatcctgaacgtggccatgatcgtgggctacctgggcagcatcgagctgcccagcaccagcagcaacctggagagcgacagcctgcaggccatcagaggctgcatgagaagactgagagccgagcagaagatccacagcctggtgaccatgaagatcatgcacgactgcgtgcagctgagcaccgacaaggccggcgtggtggccgagtaccccgccgagaagctggccttcagcgccgtgtgccccgacgacagaagattcttcggcctggtgaccatgcagaccaacgacgacggcagcctggcccaggaggaggagggcgccctgagaaccagctgccacgtgttcatggtggaccccgacctgttcaaccacaagatccaccagggcatcgccagaagattcggcttcgagtgcaccgccgaccccgacaccaacggctgcctggagttccccgccagcagcctgcccgtgctgcagttcatcagcgtgctgtacagagacatgggcgagctgatcgagggcatgagagccagagccttcctggacggcgacgccgacgcccaccagaacaacagcaccagcagcaacagcgacagcggcatcggcaacttccaccaggaggagaagagcaacagagtgctggtggtggacctgggcggcagcagcagcagacacggccccggcggcagcgcctgggacggcgtgggcggcagaggcgcccagccctggggcgccccctggaccggccccttctgccccgaccccgagggcagcccccccttcgaggccgcccaccagaccgacagattctgggacctgaacaagcacctgggccccgccagccccgtggaggtgccccccgccagcctgagaagcagcgtgccccccagcaagagaggcaccgtgggcgccggctgcggcttcaaccagagatggctgcccgtgcacgtgctgagagagtggcagtgcggccacaccagcgaccaggacagctacaccgacagcaccgacggctggagcagcatcaactgcggcaccctgcccccccccatgagcaagatccccgccgacagatacagagtggagggcagcttcgcccagccccccctgaacgcccccaagagagagtggagcagaaaggccttcggcatgcagagcatcttcggcccccacagaaacgtgagaaagaccaaggaggacaagaagggcagcaagttcggcagaggcaccggcctgacccagcccagccagagaaccagcgccagaagaagcttcggcagaagcaagagattcagcatcaccagaagcctggacgacctggagagctag

SEQ ID NO: 12647 - DNA, 636 bp, Artificial Sequence
  Description of Artificial Sequence: Synthetic coding sequence
atgcagagcgccatgttcctggccgtgcagcacgactgcagacccatggacaagagcgccggcagcggccacaagagcgaggagaagagagagaagatgaagagaaccctgctgaaggactggaagaccagactgagctacttcctgcagaacagcagcacccccggcaagcccaagaccggcaagaagagcaagcagcaggccttcatcaagcccagccccgaggaggcccagctgtggagcgaggccttcgacgagctgctggccagcaagtacggcctggccgccttcagagccttcctgaagagcgagttctgcgaggagaacatcgagttctggctggcctgcgaggacttcaagaagaccaagagcccccagaagctgagcagcaaggccagaaagatctacaccgacttcatcgagaaggaggcccccaaggagatcaacatcgacttccagaccaagaccctgatcgcccagaacatccaggaggccaccagcggctgcttcaccaccgcccagaagagagtgtacagcctgatggagaacaacagctaccccagattcctggagagcgagttctaccaggacctgtgcaagaagccccagatcaccaccgagccccacgccacctag

SEQ ID NO: 12648 - DNA, 4203 bp, Artificial Sequence
  Description of Artificial Sequence: Synthetic coding sequence
atgcccaagatcgtgctgaacggcgtgaccgtggacttccccttccagccctacaagtgccagcaggagtacatgaccaaggtgctggagtgcctgcagcagaaggtgaacggcatcctggagagccccaccggcaccggcaagaccctgtgcctgctgtgcaccaccctggcctggagagagcacctgagagacggcatcagcgccagaaagatcgccgagagagcccagggcgagctgttccccgacagagccctgagcagctggggcaacgccgccgccgccgccggcgaccccatcgcctgctacaccgacatccccaagatcatctacgccagcagaacccacagccagctgacccaggtgatcaacgagctgagaaacaccagctacagacccaaggtgtgcgtgctgggcagcagagagcagctgtgcatccaccccgaggtgaagaagcaggagagcaaccacctgcagatccacctgtgcagaaagaaggtggccagcagaagctgccacttctacaacaacgtggaggagaagagcctggagcaggagctggccagccccatcctggacatcgaggacctggtgaagagcggcagcaagcacagagtgtgcccctactacctgagcagaaacctgaagcagcaggccgacatcatcttcatgccctacaactacctgctggacgccaagagcagaagagcccacaacatcgacctgaagggcaccgtggtgatcttcgacgaggcccacaacgtggagaagatgtgcgaggagagcgccagcttcgacctgaccccccacgacctggccagcggcctggacgtgatcgaccaggtgctggaggagcagaccaaggccgcccagcagggcgagccccaccccgagttcagcgccgacagccccagccccggcctgaacatggagctggaggacatcgccaagctgaagatgatcctgctgagactggagggcgccatcgacgccgtggagctgcccggcgacgacagcggcgtgaccaagcccggcagctacatcttcgagctgttcgccgaggcccagatcaccttccagaccaagggctgcatcctggacagcctggaccagatcatccagcacctggccggcagagccggcgtgttcaccaacaccgccggcctgcagaagctggccgacatcatccagatcgtgttcagcgtggaccccagcgagggcagccccggcagccccgccggcctgggcgccctgcagagctacaaggtgcacatccaccccgacgccggccacagaagaaccgcccagagaagcgacgcctggagcaccaccgccgccagaaagagaggcaaggtgctgagctactggtgcttcagccccggccacagcatgcacgagctggtgagacagggcgtgagaagcctgatcctgaccagcggcaccctggcccccgtgagcagcttcgccctggagatgcagatccccttccccgtgtgcctggagaacccccacatcatcgacaagcaccagatctgggtgggcgtggtgcccagaggccccgacggcgcccagctgagcagcgccttcgacagaagattcagcgaggagtgcctgagcagcctgggcaaggccctgggcaacatcgccagagtggtgccctacggcctgctgatcttcttccccagctaccccgtgatggagaagagcctggagttctggagagccagagacctggccagaaagatggaggccctgaagcccctgttcgtggagcccagaagcaagggcagcttcagcgagaccatcagcgcctactacgccagagtggccgcccccggcagcaccggcgccaccttcctggccgtgtgcagaggcaaggccagcgagggcctggacttcagcgacaccaacggcagaggcgtgatcgtgaccggcctgccctacccccccagaatggaccccagagtggtgctgaagatgcagttcctggacgagatgaagggccagggcggcgccggcggccagttcctgagcggccaggagtggtacagacagcaggccagcagagccgtgaaccaggccatcggcagagtgatcagacacagacaggactacggcgccgtgttcctgtgcgaccacagattcgccttcgccgacgccagagcccagctgcccagctgggtgagaccccacgtgagagtgtacgacaacttcggccacgtgatcagagacgtggcccagttcttcagagtggccgagagaaccatgcccgcccccgcccccagagccaccgcccccagcgtgagaggcgaggacgccgtgagcgaggccaagagccccggccccttcttcagcaccagaaaggccaagagcctggacctgcacgtgcccagcctgaagcagagaagcagcggcagccccgccgccggcgaccccgagagcagcctgtgcgtggagtacgagcaggagcccgtgcccgccagacagagacccagaggcctgctggccgccctggagcacagcgagcagagagccggcagccccggcgaggagcaggcccacagctgcagcaccctgagcctgctgagcgagaagagacccgccgaggagcccagaggcggcagaaagaagatcagactggtgagccaccccgaggagcccgtggccggcgcccagaccgacagagccaagctgttcatggtggccgtgaagcaggagctgagccaggccaacttcgccaccttcacccaggccctgcaggactacaagggcagcgacgacttcgccgccctggccgcctgcctgggccccctgttcgccgaggaccccaagaagcacaacctgctgcagggcttctaccagttcgtgagaccccaccacaagcagcagttcgaggaggtgtgcatccagctgaccggcagaggctgcggctacagacccgagcacagcatccccagaagacagagagcccagcccgtgctggaccccaccggcagaaccgcccccgaccccaagctgaccgtgagcaccgccgccgcccagcagctggacccccaggagcacctgaaccagggcagaccccacctgagccccagacccccccccaccggcgaccccggcagccagccccagtggggcagcggcgtgcccagagccggcaagcagggccagcacgccgtgagcgcctacctggccgacgccagaagagccctgggcagcgccggctgcagccagctgctggccgccctgaccgcctacaagcaggacgacgacctggacaaggtgctggccgtgctggccgccctgaccaccgccaagcccgaggacttccccctgctgcacagattcagcatgttcgtgagaccccaccacaagcagagattcagccagacctgcaccgacctgaccggcagaccctaccccggcatggagccccccggcccccaggaggagagactggccgtgccccccgtgctgacccacagagccccccagcccggccccagcagaagcgagaagaccggcaagacccagagcaagatcagcagcttcctgagacagagacccgccggcaccgtgggcgccggcggcgaggacgccggccccagccagagcagcggccccccccacggccccgccgccagcgagtggggcgagccccacggcagagacatcgccggccagcaggccaccggcgcccccggcggccccctgagcgccggctgcgtgtgccagggctgcggcgccgaggacgtggtgcccttccagtgccccgcctgcgacttccagagatgccaggcctgctggcagagacacctgcaggccagcagaatgtgccccgcctgccacaccgccagcagaaagcagagcgtgatgcaggtgttctggcccgagccccacaaggaccacgagggcgccggcggcgccagacccgtggccgccgtgcccggcgtgggcgccgcctgccccgccgccggcgccggctgcaccagaagcggcagaaacacccacctgcccctggccggcagaagagacagaggcgccgccggcgtgagacccgtgccccccagacacctgtgcgccgccgccgtgccccccagacagccccacgacgtgtggcccgtgagcaccgcccccctgcacgccgtgctggagctgcccagagccctgcccctgctgcagagacccctgagaggcgcctag

SEQ ID NO: 12649 - DNA, 1638 bp, Artificial Sequence
  Description of Artificial Sequence: Synthetic coding sequence
atgcccgcccccgcccccagagccaccgcccccagcgtgagaggcgaggacgccgtgagcgaggccaagagccccggccccttcttcagcaccagaaaggccaagagcctggacctgcacgtgcccagcctgaagcagagaagcagcggcagccccgccgccggcgaccccgagagcagcctgtgcgtggagtacgagcaggagcccgtgcccgccagacagagacccagaggcctgctggccgccctggagcacagcgagcagagagccggcagccccggcgaggagcaggcccacagctgcagcaccctgagcctgctgagcgagaagagacccgccgaggagcccagaggcggcagaaagaagatcagactggtgagccaccccgaggagcccgtggccggcgcccagaccgacagagccaagctgttcatggtggccgtgaagcaggagctgagccaggccaacttcgccaccttcacccaggccctgcaggactacaagggcagcgacgacttcgccgccctggccgcctgcctgggccccctgttcgccgaggaccccaagaagcacaacctgctgcagggcttctaccagttcgtgagaccccaccacaagcagcagttcgaggaggtgtgcatccagctgaccggcagaggctgcggctacagacccgagcacagcatccccagaagacagagagcccagcccgtgctggaccccaccggcagaaccgcccccgaccccaagctgaccgtgagcaccgccgccgcccagcagctggacccccaggagcacctgaaccagggcagaccccacctgagccccagacccccccccaccggcgaccccggcagccagccccagtggggcagcggcgtgcccagagccggcaagcagggccagcacgccgtgagcgcctacctggccgacgccagaagagccctgggcagcgccggctgcagccagctgctggccgccctgaccgcctacaagcaggacgacgacctggacaaggtgctggccgtgctggccgccctgaccaccgccaagcccgaggacttccccctgctgcacagattcagcatgttcgtgagaccccaccacaagcagagattcagccagacctgcaccgacctgaccggcagaccctaccccggcatggagccccccggcccccaggaggagagactggccgtgccccccgtgctgacccacagagccccccagcccggccccagcagaagcgagaagaccggcaagacccagagcaagatcagcagcttcctgagacagagacccgccggcaccgtgggcgccggcggcgaggacgccggccccagccagagcagcggccccccccacggccccgccgccagcgagtggggcgagccccacggcagagacatcgccggccagcaggccaccggcgcccccggcggccccctgagcgccggctgcgtgtgccagggctgcggcgccgaggacgtggtgcccttccagtgccccgcctgcgacttccagagatgccaggcctgctggcagagacacctgcaggccagcagaatgtgccccgcctgccacaccgccagcagaaagcagagcgtgatgcaggtgttctggcccgagccccagtag

SEQ ID NO: 12650 - DNA, 3660 bp, Artificial Sequence
  Description of Artificial Sequence: Synthetic coding sequence
atgcccaagatcgtgctgaacggcgtgaccgtggacttccccttccagccctacaagtgccagcaggagtacatgaccaaggtgctggagtgcctgcagcagaaggtgaacggcatcctggagagccccaccggcaccggcaagaccctgtgcctgctgtgcaccaccctggcctggagagagcacctgagagacggcatcagcgccagaaagatcgccgagagagcccagggcgagctgttccccgacagagccctgagcagctggggcaacgccgccgccgccgccggcgaccccatcgcctgctacaccgacatccccaagatcatctacgccagcagaacccacagccagctgacccaggtgatcaacgagctgagaaacaccagctacagacccaaggtgtgcgtgctgggcagcagagagcagctgtgcatccaccccgaggtgaagaagcaggagagcaaccacctgcagatccacctgtgcagaaagaaggtggccagcagaagctgccacttctacaacaacgtggaggagaagagcctggagcaggagctggccagccccatcctggacatcgaggacctggtgaagagcggcagcaagcacagagtgtgcccctactacctgagcagaaacctgaagcagcaggccgacatcatcttcatgccctacaactacctgctggacgccaagagcagaagagcccacaacatcgacctgaagggcaccgtggtgatcttcgacgaggcccacaacgtggagaagatgtgcgaggagagcgccagcttcgacctgaccccccacgacctggccagcggcctggacgtgatcgaccaggtgctggaggagcagaccaaggccgcccagcagggcgagccccaccccgagttcagcgccgacagccccagccccggcctgaacatggagctggaggacatcgccaagctgaagatgatcctgctgagactggagggcgccatcgacgccgtggagctgcccggcgacgacagcggcgtgaccaagcccggcagctacatcttcgagctgttcgccgaggcccagatcaccttccagaccaagggctgcatcctggacagcctggaccagatcatccagcacctggccggcagagccggcgtgttcaccaacaccgccggcctgcagaagctggccgacatcatccagatcgtgttcagcgtggaccccagcgagggcagccccggcagccccgccggcctgggcgccctgcagagctacaaggtgcacatccaccccgacgccggccacagaagaaccgcccagagaagcgacgcctggagcaccaccgccgccagaaagagaggcaaggtgctgagctactggtgcttcagccccggccacagcatgcacgagctggtgagacagggcgtgagaagcctgatcctgaccagcggcaccctggcccccgtgagcagcttcgccctggagatgcagatccccttccccgtgtgcctggagaacccccacatcatcgacaagcaccagatctgggtgggcgtggtgcccagaggccccgacggcgcccagctgagcagcgccttcgacagaagattcagcgaggagtgcctgagcagcctgggcaaggccctgggcaacatcgccagagtggtgccctacggcctgctgatcttcttccccagctaccccgtgatggagaagagcctggagttctggagagccagagacctggccagaaagatggaggccctgaagcccctgttcgtggagcccagaagcaagggcagcttcagcgagaccatcagcgcctactacgccagagtggccgcccccggcagcaccggcgccaccttcctggccgtgtgcagaggcaaggccagcgagggcctggacttcagcgacaccaacggcagaggcgtgatcgtgaccggcctgccctacccccccagaatggaccccagagtggtgctgaagatgcagttcctggacgagatgaagggccagggcggcgccggcggccagttcctgagcggccaggagtggtacagacagcaggccagcagagccgtgaaccaggccatcggcagagtgatcagacacagacaggactacggcgccgtgttcctgtgcgaccacagattcgccttcgccgacgccagagcccagctgcccagctgggtgagaccccacgtgagagtgtacgacaacttcggccacgtgatcagagacgtggcccagttcttcagagtggccgagagaaccatgcccgcccccgcccccagagccaccgcccccagcgtgagaggcgaggacgccgtgagcgaggccaagagccccggccccttcttcagcaccagaaaggccaagagcctggacctgcacgtgcccagcctgaagcagagaagcagcggcagccccgccgccggcgaccccgagagcagcctgtgcgtggagtacgagcaggagcccgtgcccgccagacagagacccagaggcctgctggccgccctggagcacagcgagcagagagccggcagccccggcgaggagcaggcccacagctgcagcaccctgagcctgctgagcgagaagagacccgccgaggagcccagaggcggcagaaagaagatcagactggtgagccaccccgaggagcccgtggccggcgcccagaccgacagagccaagctgttcatggtggccgtgaagcaggagctgagccaggccaacttcgccaccttcacccaggccctgcaggactacaagggcagcgacgacttcgccgccctggccgcctgcctgggccccctgttcgccgaggaccccaagaagcacaacctgctgcagggcttctaccagttcgtgagaccccaccacaagcagcagttcgaggaggtgtgcatccagctgaccggcagaggctgcggctacagacccgagcacagcatccccagaagacagagagcccagcccgtgctggaccccaccggcagaaccgcccccgaccccaagctgaccgtgagcaccgccgccgcccagcagctggacccccaggagcacctgaaccagggcagaccccacctgagccccagacccccccccaccggcgaccccggcagccagccccagtggggcagcggcgtgcccagagccggcaagcagggccagcacgccgtgagcgcctacctggccgacgccagaagagccctgggcagcgccggctgcagccagctgctggccgccctgaccgcctacaagcaggacgacgacctggacaaggtgctggccgtgctggccgccctgaccaccgccaagcccgaggacttccccctgctgcacagattcagcatgttcgtgagaccccaccacaagcagagattcagccagacctgcaccgacctgaccggcagaccctaccccggcatggagccccccggcccccaggaggagagactggccgtgccccccgtgctgacccacagagccccccagcccggccccagcagaagcgagaagaccggcaagacccagagcaagatcagcagcttcctgagacagagacccgccggcaccgtgggcgccggcggcgaggacgccggccccagccagagcagcggccccccccacggccccgccgccagcgagtggggcctgtag

SEQ ID NO: 12651 - DNA, 3732 bp, Artificial Sequence
  Description of Artificial Sequence: Synthetic coding sequence
atgcccaagatcgtgctgaacggcgtgaccgtggacttccccttccagccctacaagtgccagcaggagtacatgaccaaggtgctggagtgcctgcagcagaaggtgaacggcatcctggagagccccaccggcaccggcaagaccctgtgcctgctgtgcaccaccctggcctggagagagcacctgagagacggcatcagcgccagaaagatcgccgagagagcccagggcgagctgttccccgacagagccctgagcagctggggcaacgccgccgccgccgccggcgaccccatcgcctgctacaccgacatccccaagatcatctacgccagcagaacccacagccagctgacccaggtgatcaacgagctgagaaacaccagctacagaagcagatgcagagccaccctgtgggtgctggagaccgccccccccagacccaccgtgctgagccccaccagacccaaggtgtgcgtgctgggcagcagagagcagctgtgcatccaccccgaggtgaagaagcaggagagcaaccacctgcagatccacctgtgcagaaagaaggtggccagcagaagctgccacttctacaacaacgtggaggagaagagcctggagcaggagctggccagccccatcctggacatcgaggacctggtgaagagcggcagcaagcacagagtgtgcccctactacctgagcagaaacctgaagcagcaggccgacatcatcttcatgccctacaactacctgctggacgccaagagcagaagagcccacaacatcgacctgaagggcaccgtggtgatcttcgacgaggcccacaacgtggagaagatgtgcgaggagagcgccagcttcgacctgaccccccacgacctggccagcggcctggacgtgatcgaccaggtgctggaggagcagaccaaggccgcccagcagggcgagccccaccccgagttcagcgccgacagccccagccccggcctgaacatggagctggaggacatcgccaagctgaagatgatcctgctgagactggagggcgccatcgacgccgtggagctgcccggcgacgacagcggcgtgaccaagcccggcagctacatcttcgagctgttcgccgaggcccagatcaccttccagaccaagggctgcatcctggacagcctggaccagatcatccagcacctggccggcagagccggcgtgttcaccaacaccgccggcctgcagaagctggccgacatcatccagatcgtgttcagcgtggaccccagcgagggcagccccggcagccccgccggcctgggcgccctgcagagctacaaggtgcacatccaccccgacgccggccacagaagaaccgcccagagaagcgacgcctggagcaccaccgccgccagaaagagaggcaaggtgctgagctactggtgcttcagccccggccacagcatgcacgagctggtgagacagggcgtgagaagcctgatcctgaccagcggcaccctggcccccgtgagcagcttcgccctggagatgcagatccccttccccgtgtgcctggagaacccccacatcatcgacaagcaccagatctgggtgggcgtggtgcccagaggccccgacggcgcccagctgagcagcgccttcgacagaagattcagcgaggagtgcctgagcagcctgggcaaggccctgggcaacatcgccagagtggtgccctacggcctgctgatcttcttccccagctaccccgtgatggagaagagcctggagttctggagagccagagacctggccagaaagatggaggccctgaagcccctgttcgtggagcccagaagcaagggcagcttcagcgagaccatcagcgcctactacgccagagtggccgcccccggcagcaccggcgccaccttcctggccgtgtgcagaggcaaggccagcgagggcctggacttcagcgacaccaacggcagaggcgtgatcgtgaccggcctgccctacccccccagaatggaccccagagtggtgctgaagatgcagttcctggacgagatgaagggccagggcggcgccggcggccagttcctgagcggccaggagtggtacagacagcaggccagcagagccgtgaaccaggccatcggcagagtgatcagacacagacaggactacggcgccgtgttcctgtgcgaccacagattcgccttcgccgacgccagagcccagctgcccagctgggtgagaccccacgtgagagtgtacgacaacttcggccacgtgatcagagacgtggcccagttcttcagagtggccgagagaaccatgcccgcccccgcccccagagccaccgcccccagcgtgagaggcgaggacgccgtgagcgaggccaagagccccggccccttcttcagcaccagaaaggccaagagcctggacctgcacgtgcccagcctgaagcagagaagcagcggcagccccgccgccggcgaccccgagagcagcctgtgcgtggagtacgagcaggagcccgtgcccgccagacagagacccagaggcctgctggccgccctggagcacagcgagcagagagccggcagccccggcgaggagcaggcccacagctgcagcaccctgagcctgctgagcgagaagagacccgccgaggagcccagaggcggcagaaagaagatcagactggtgagccaccccgaggagcccgtggccggcgcccagaccgacagagccaagctgttcatggtggccgtgaagcaggagctgagccaggccaacttcgccaccttcacccaggccctgcaggactacaagggcagcgacgacttcgccgccctggccgcctgcctgggccccctgttcgccgaggaccccaagaagcacaacctgctgcagggcttctaccagttcgtgagaccccaccacaagcagcagttcgaggaggtgtgcatccagctgaccggcagaggctgcggctacagacccgagcacagcatccccagaagacagagagcccagcccgtgctggaccccaccggcagaaccgcccccgaccccaagctgaccgtgagcaccgccgccgcccagcagctggacccccaggagcacctgaaccagggcagaccccacctgagccccagacccccccccaccggcgaccccggcagccagccccagtggggcagcggcgtgcccagagccggcaagcagggccagcacgccgtgagcgcctacctggccgacgccagaagagccctgggcagcgccggctgcagccagctgctggccgccctgaccgcctacaagcaggacgacgacctggacaaggtgctggccgtgctggccgccctgaccaccgccaagcccgaggacttccccctgctgcacagcaacagcatgttcgtgagaccccaccacaagcagagattcagccagacctgcaccgacctgaccggcagaccctaccccggcatggagccccccggcccccaggaggagagactggccgtgccccccgtgctgacccacagagccccccagcccggccccagcagaagcgagaagaccggcaagacccagagcaagatcagcagcttcctgagacagagacccgccggcaccgtgggcgccggcggcgaggacgccggccccagccagagcagcggccccccccacggccccgccgccagcgagtggggcctgtag

SEQ ID NO: 12652 - DNA, 3444 bp, Artificial Sequence
  Description of Artificial Sequence: Synthetic coding sequence
atggacatcagaaagttcttcggcgtgatccccagcggcaagaagctggtgagcgagaccgtgaagaagaacgagaagaccaagagcgacgaggagaccctgaaggccaagaagggcatcaaggagatcaaggtgaacagcagcagaaaggaggacgacttcaagcagaagcagcccagcaagaagaagagaatcatctacgacagcgacagcgagagcgaggagaccctgcaggtgaagaacgccaagaagccccccgagaagctgcccgtgagcagcaagcccggcaagatcagcagacaggaccccgtgacctacatcagcgagaccgacgaggaggacgacttcatgtgcaagaaggccgccagcaagagcaaggagaacggcagaagcaccaacagccacctgggcaccagcaacatgaagaagaacgaggagaacaccaagaccaagaacaagcccctgagccccatcaagctgacccccaccagcgtgctggactacttcggcaccggcagcgtgcagagaagcaacaagaagatggtggccagcaagagaaaggagctgagccagaacaccgacgagagcggcctgaacgacgaggccatcgccaagcagctgcagctggacgaggacgccgagctggagagacagctgcacgaggacgaggagttcgccagaaccctggccatgctggacgaggagcccaagaccaagaaggccagaaaggacaccgaggccggcgagaccttcagcagcgtgcaggccaacctgagcaaggccgagaagcacaagtacccccacaaggtgaagaccgcccaggtgagcgacgagagaaagagctacagccccagaaagcagagcaagtacgagagcagcaaggagagccagcagcacagcaagagcagcgccgacaagatcggcgaggtgagcagccccaaggccagcagcaagctggccatcatgaagagaaaggaggagagcagctacaaggagatcgagcccgtggccagcaagagaaaggagaacgccatcaagctgaagggcgagaccaagacccccaagaagaccaagagcagccccgccaagaaggagagcgtgagccccgaggacagcgagaagaagagaaccaactaccaggcctacagaagctacctgaacagagagggccccaaggccctgggcagcaaggagatccccaagggcgccgagaactgcctggagggcctgatcttcgtgatcaccggcgtgctggagagcatcgagagagacgaggccaagagcctgatcgagagatacggcggcaaggtgaccggcaacgtgagcaagaagaccaactacctggtgatgggcagagacagcggccagagcaagagcgacaaggccgccgccctgggcaccaagatcatcgacgaggacggcctgctgaacctgatcagaaccatgcccggcaagaagagcaagtacgagatcgccgtggagaccgagatgaagaaggagagcaagctggagagaaccccccagaagaacgtgcagggcaagagaaagatcagccccagcaagaaggagagcgagagcaagaagagcagacccaccagcaagagagacagcctggccaagaccatcaagaaggagaccgacgtgttctggaagagcctggacttcaaggagcaggtggccgaggagaccagcggcgacagcaaggccagaaacctggccgacgacagcagcgagaacaaggtggagaacctgctgtgggtggacaagtacaagcccaccagcctgaagaccatcatcggccagcagggcgaccagagctgcgccaacaagctgctgagatggctgagaaactggcagaagagcagcagcgaggacaagaagcacgccaagttcggcaagttcagcggcaaggacgacggcagcagcttcaaggccgccctgctgagcggcccccccggcgtgggcaagaccaccaccgccagcctggtgtgccaggagctgggctacagctacgtggagctgaacgccagcgacaccagaagcaagagcagcctgaaggccatcgtggccgagagcctgaacaacaccagcatcaagggcttctacagcaacggcgccgccagcagcgtgagcaccaagcacgccctgatcatggacgaggtggacggcatggccggcaacgaggacagaggcggcatccaggagctgatcggcctgatcaagcacaccaagatccccatcatctgcatgtgcaacgacagaaaccaccccaagatcagaagcctggtgcactactgcttcgacctgagattccagagacccagagtggagcagatcaagggcgccatgatgagcatcgccttcaaggagggcctgaagatccccccccccgccatgaacgagatcatcctgggcgccaaccaggacatcagacaggtgctgcacaacctgagcatgtggtgcgccagaagcaaggccctgacctacgaccaggccaaggccgacagccacagagccaagaaggacatcaagatgggccccttcgacgtggccagaaaggtgttcgccgccggcgaggagaccgcccacatgagcctggtggacaagagcgacctgttcttccacgactacagcatcgcccccctgttcgtgcaggagaactacatccacgtgaagcccgtggccgccggcggcgacatgaagaagcacctgatgctgctgagcagagccgccgacagcatctgcgacggcgacctggtggacagccagatcagaagcaagcagaactggagcctgctgcccgcccaggccatctacgccagcgtgctgcccggcgagctgatgagaggctacatgacccagttccccaccttccccagctggctgggcaagcacagcagcaccggcaagcacgacagaatcgtgcaggacctggccctgcacatgagcctgagaacctacagcagcaagagaaccgtgaacatggactacctgagcctgctgagagacgccctggtgcagcccctgaccagccagggcgtggacggcgtgcaggacgtggtggccctgatggacacctactacctgatgaaggaggacttcgagaacatcatggagatcagcagctggggcggcaagcccagccccttcagcaagctggaccccaaggtgaaggccgccttcaccagagcctacaacaaggaggcccacctgaccccctacagcctgcaggccatcaaggccagcagacacagcaccagccccagcctggacagcgagtacaacgaggagctgaacgaggacgacagccagagcgacgagaaggaccaggacgccatcgagaccgacgccatgatcaagaagaagaccaagagcagcaagcccagcaagcccgagaaggacaaggagcccagaaagggcaagggcaagagcagcaagaagtag

SEQ ID NO: 12653 - DNA, 3447 bp, Artificial Sequence
  Description of Artificial Sequence: Synthetic coding sequence
atggacatcagaaagttcttcggcgtgatccccagcggcaagaagctggtgagcgagaccgtgaagaagaacgagaagaccaagagcgacgaggagaccctgaaggccaagaagggcatcaaggagatcaaggtgaacagcagcagaaaggaggacgacttcaagcagaagcagcccagcaagaagaagagaatcatctacgacagcgacagcgagagcgaggagaccctgcaggtgaagaacgccaagaagccccccgagaagctgcccgtgagcagcaagcccggcaagatcagcagacaggaccccgtgacctacatcagcgagaccgacgaggaggacgacttcatgtgcaagaaggccgccagcaagagcaaggagaacggcagaagcaccaacagccacctgggcaccagcaacatgaagaagaacgaggagaacaccaagaccaagaacaagcccctgagccccatcaagctgacccccaccagcgtgctggactacttcggcaccggcagcgtgcagagaagcaacaagaagatggtggccagcaagagaaaggagctgagccagaacaccgacgagagcggcctgaacgacgaggccatcgccaagcagctgcagctggacgaggacgccgagctggagagacagctgcacgaggacgaggagttcgccagaaccctggccatgctggacgaggagcccaagaccaagaaggccagaaaggacaccgaggccggcgagaccttcagcagcgtgcaggccaacctgagcaaggccgagaagcacaagtacccccacaaggtgaagaccgcccaggtgagcgacgagagaaagagctacagccccagaaagcagagcaagtacgagagcagcaaggagagccagcagcacagcaagagcagcgccgacaagatcggcgaggtgagcagccccaaggccagcagcaagctggccatcatgaagagaaaggaggagagcagctacaaggagatcgagcccgtggccagcaagagaaaggagaacgccatcaagctgaagggcgagaccaagacccccaagaagaccaagagcagccccgccaagaaggagagcgtgagccccgaggacagcgagaagaagagaaccaactaccaggcctacagaagctacctgaacagagagggccccaaggccctgggcagcaaggagatccccaagggcgccgagaactgcctggagggcctgatcttcgtgatcaccggcgtgctggagagcatcgagagagacgaggccaagagcctgatcgagagatacggcggcaaggtgaccggcaacgtgagcaagaagaccaactacctggtgatgggcagagacagcggccagagcaagagcgacaaggccgccgccctgggcaccaagatcatcgacgaggacggcctgctgaacctgatcagaaccatgcccggcaagaagagcaagtacgagatcgccgtggagaccgagatgaagaaggagagcaagctggagagaaccccccagaagaacgtgcagggcaagagaaagatcagccccagcaagaaggagagcgagagcaagaagagcagacccaccagcaagagagacagcctggccaagaccatcaagaaggagaccgacgtgttctggaagagcctggacttcaaggagcaggtggccgaggagaccagcggcgacagcaaggccagaaacctggccgacgacagcagcgagaacaaggtggagaacctgctgtgggtggacaagtacaagcccaccagcctgaagaccatcatcggccagcagggcgaccagagctgcgccaacaagctgctgagatggctgagaaactggcagaagagcagcagcgaggacaagaagcacgccgccaagttcggcaagttcagcggcaaggacgacggcagcagcttcaaggccgccctgctgagcggcccccccggcgtgggcaagaccaccaccgccagcctggtgtgccaggagctgggctacagctacgtggagctgaacgccagcgacaccagaagcaagagcagcctgaaggccatcgtggccgagagcctgaacaacaccagcatcaagggcttctacagcaacggcgccgccagcagcgtgagcaccaagcacgccctgatcatggacgaggtggacggcatggccggcaacgaggacagaggcggcatccaggagctgatcggcctgatcaagcacaccaagatccccatcatctgcatgtgcaacgacagaaaccaccccaagatcagaagcctggtgcactactgcttcgacctgagattccagagacccagagtggagcagatcaagggcgccatgatgagcatcgccttcaaggagggcctgaagatccccccccccgccatgaacgagatcatcctgggcgccaaccaggacatcagacaggtgctgcacaacctgagcatgtggtgcgccagaagcaaggccctgacctacgaccaggccaaggccgacagccacagagccaagaaggacatcaagatgggccccttcgacgtggccagaaaggtgttcgccgccggcgaggagaccgcccacatgagcctggtggacaagagcgacctgttcttccacgactacagcatcgcccccctgttcgtgcaggagaactacatccacgtgaagcccgtggccgccggcggcgacatgaagaagcacctgatgctgctgagcagagccgccgacagcatctgcgacggcgacctggtggacagccagatcagaagcaagcagaactggagcctgctgcccgcccaggccatctacgccagcgtgctgcccggcgagctgatgagaggctacatgacccagttccccaccttccccagctggctgggcaagcacagcagcaccggcaagcacgacagaatcgtgcaggacctggccctgcacatgagcctgagaacctacagcagcaagagaaccgtgaacatggactacctgagcctgctgagagacgccctggtgcagcccctgaccagccagggcgtggacggcgtgcaggacgtggtggccctgatggacacctactacctgatgaaggaggacttcgagaacatcatggagatcagcagctggggcggcaagcccagccccttcagcaagctggaccccaaggtgaaggccgccttcaccagagcctacaacaaggaggcccacctgaccccctacagcctgcaggccatcaaggccagcagacacagcaccagccccagcctggacagcgagtacaacgaggagctgaacgaggacgacagccagagcgacgagaaggaccaggacgccatcgagaccgacgccatgatcaagaagaagaccaagagcagcaagcccagcaagcccgagaaggacaaggagcccagaaagggcaagggcaagagcagcaagaagtag

SEQ ID NO: 12654 - DNA, 564 bp, Artificial Sequence
  Description of Artificial Sequence: Synthetic coding sequence
cccgaggacagcgagaagaagagaaccaactaccaggcctacagaagctacctgaacagagagggccccaaggccctgggcagcaaggagatccccaagggcgccgagaactgcctggagggcctgatcttcgtgatcaccggcgtgctggagagcatcgagagagacgaggccaagagcctgatcgagagatacggcggcaaggtgaccggcaacgtgagcaagaagaccaactacctggtgatgggcagagacagcggccagagcaagagcgacaaggccgccgccctgggcaccaagatcatcgacgaggacggcctgctgaacctgatcagaaccatgcccggcaagaagagcaagtacgagatcgccgtggagaccgaggagctgggctacagctacgtggagctgaacgccagcgacaccagaagcaagagcagcctgaaggccatcgtggccgagagcctgaacaacaccagcatcaagggcttctacagcaacggcgccgccagcagcgtgagcaccaagcacgccctgatcatggacgaggtggacggcatgtag

SEQ ID NO: 12655 - DNA, 1851 bp, Artificial Sequence
  Description of Artificial Sequence: Synthetic coding sequence
atggtgggccagctgagcgagggcgccatcgccgccatcatgcagaagggcgacaccaacatcaagcccatcctgcaggtgatcaacatcagacccatcaccaccggcaacagcccccccagatacagactgctgatgagcgacggcctgaacaccctgagcagcttcatgctggccacccagctgaaccccctggtggaggaggagcagctgagcagcaactgcgtgtgccagatccacagattcatcgtgaacaccctgaaggacggcagaagagtggtgatcctgatggagctggaggtgctgaagagcgccgaggccgtgggcgtgaagatcggcaaccccgtgccctacaacgagggcctgggccagccccaggtggccccccccgcccccgccgccagccccgccgccagcagcagaccccagccccagaacggcagcagcggcatgggcagcaccgtgagcaaggcctacggcgccagcaagaccttcggcaaggccgccggccccagcctgagccacaccagcggcggcacccagagcaaggtggtgcccatcgccagcctgaccccctaccagagcaagtggaccatctgcgccagagtgaccaacaagagccagatcagaacctggagcaacagcagaggcgagggcaagctgttcagcctggagctggtggacgagagcggcgagatcagagccaccgccttcaacgagcaggtggacaagttcttccccctgatcgaggtgaacaaggtgtactacttcagcaagggcaccctgaagatcgccaacaagcagttcaccgccgtgaagaacgactacgagatgaccttcaacaacgagaccagcgtgatgccctgcgaggacgaccaccacctgcccaccgtgcagttcgacttcaccggcatcgacgacctggagaacaagagcaaggacagcctggtggacatcatcggcatctgcaagagctacgaggacgccaccaagatcaccgtgagaagcaacaacagagaggtggccaagagaaacatctacctgatggacaccagcggcaaggtggtgaccgccaccctgtggggcgaggacgccgacaagttcgacggcagcagacagcccgtgctggccatcaagggcgccagagtgagcgacttcggcggcagaagcctgagcgtgctgagcagcagcaccatcatcgccaaccccgacatccccgaggcctacaagctgagaggctggttcgacgccgagggccaggccctggacggcgtgagcatcagcgacctgaagagcggcggcgtgggcggcagcaacaccaactggaagaccctgtacgaggtgaagagcgagaacctgggccagggcgacaagcccgactacttcagcagcgtggccaccgtggtgtacctgagaaaggagaactgcatgtaccaggcctgccccacccaggactgcaacaagaaggtgatcgaccagcagaacggcctgtacagatgcgagaagtgcgacaccgagttccccaacttcaagtacagaatgatcctgagcgtgaacatcgccgacttccaggagaaccagtgggtgacctgcttccaggagagcgccgaggccatcctgggccagaacgccgcctacctgggcgagctgaaggacaagaacgagcaggccttcgaggaggtgttccagaacgccaacttcagaagcttcatcttcagagtgagagtgaaggtggagacctacaacgacgagagcagaatcaaggccaccgtgatggacgtgaagcccgtggactacagagagtacggcagaagactggtgatgagcatcagaagaagcgccctgatgtag

SEQ ID NO: 12656 - DNA, 2217 bp, Artificial Sequence
  Description of Artificial Sequence: Synthetic coding sequence
atgaccagcagcggccccggccccagattcctgctgctgctgcccctgctgctgccccccgccgccagcgccagcgacagacccagaggcagagaccccgtgaaccccgagaagctgctggtgatcaccgtggccaccgccgagaccgagggctacctgagattcctgagaagcgccgagttcttcaactacaccgtgagaaccctgggcctgggcgaggagtggagaggcggcgacgtggccagaaccgtgggcggcggccagaaggtgagatggctgaagaaggagatggagaagtacgccgacagagaggacatgatcatcatgttcgtggacagctacgacgtgatcctggccggcagccccaccgagctgctgaagaagttcgtgcagagcggcagcagactgctgttcagcgccgagagcttctgctggcccgagtggggcctggccgagcagtaccccgaggtgggcaccggcaagagattcctgaacagcggcggcttcatcggcttcgccaccaccatccaccagatcgtgagacagtggaagtacaaggacgacgacgacgaccagctgttctacaccagactgtacctggaccccggcctgagagagaagctgagcctgaacctggaccacaagagcagaatcttccagaacctgaacggcgccctggacgaggtggtgctgaagttcgacagaaacagagtgagaatcagaaacgtggcctacgacaccctgcccatcgtggtgcacggcaacggccccaccaagctgcagctgaactacctgggcaactacgtgcccaacggctggacccccgagggcggctgcggcttctgcaaccaggacagaagaaccctgcccggcggccagcccccccccagagtgttcctggccgtgttcgtggagcagcccacccccttcctgcccagattcctgcagagactgctgctgctggactacccccccgacagagtgaccctgttcctgcacaacaacgaggtgttccacgagccccacatcgccgacagctggccccagctgcaggaccacttcagcgccgtgaagctggtgggccccgaggaggccctgagccccggcgaggccagagacatggccatggacctgtgcagacaggaccccgagtgcgagttctacttcagcctggacgccgacgccgtgctgaccaacctgcagaccctgagaatcctgatcgaggagaacagaaaggtgatcgcccccatgctgagcagacacggcaagctgtggagcaacttctggggcgccctgagccccgacgagtactacgccagaagcgaggactacgtggagctggtgcagagaaagagagtgggcgtgtggaacgtgccctacatcagccaggcctacgtgatcagaggcgacaccctgagaatggagctgccccagagagacgtgttcagcggcagcgacaccgaccccgacatggccttctgcaagagcttcagagacaagggcatcttcctgcacctgagcaaccagcacgagttcggcagactgctggccaccagcagatacgacaccgagcacctgcaccccgacctgtggcagatcttcgacaaccccgtggactggaaggagcagtacatccacgagaactacagcagagccctggagggcgagggcatcgtggagcagccctgccccgacgtgtactggttccccctgctgagcgagcagatgtgcgacgagctggtggccgagatggagcactacggccagtggagcggcggcagacacgaggacagcagactggccggcggctacgagaacgtgcccaccgtggacatccacatgaagcaggtgggctacgaggaccagtggctgcagctgctgagaacctacgtgggccccatgaccgagagcctgttccccggctaccacaccaaggccagagccgtgatgaacttcgtggtgagatacagacccgacgagcagcccagcctgagaccccaccacgacagcagcaccttcaccctgaacgtggccctgaaccacaagggcctggactacgagggcggcggctgcagattcctgagatacgactgcgtgatcagcagccccagaaagggctgggccctgctgcaccccggcagactgacccactaccacgagggcctgcccaccacctggggcaccagatacatcatggtgagcttcgtggacccctag

SEQ ID NO: 12657 - DNA, 366 bp, Artificial Sequence
  Description of Artificial Sequence: Synthetic coding sequence
atggtggacatgatggacctgcccagaagcagaatcaacgccggcatgctggcccagttcatcgacaagcccgtgtgcttcgtgggcagactggagaagatccaccccaccggcaagatgttcatcctgagcgacggcgagggcaagaacggcaccatcgagctgatggagcccctggacgaggagatcagcggcatcgtggaggtggtgggcagagtgaccgccaaggccaccatcctgtgcaccagctacgtgcagttcaaggaggacagccaccccttcgacctgggcctgtacaacgaggccgtgaagatcatccacgacttcccccagttctaccccctgggcatcgtgcagcacgactag

SEQ ID NO: 12658 - DNA, 2787 bp, Artificial Sequence
  Description of Artificial Sequence: Synthetic coding sequence
atgccccccaagacccccagaaagaccgccgccaccgccgccgccgccgccgccgagccccccgcccccccccccccccccccccccgaggaggaccccgagcaggacagcggccccgaggacctgcccctggtgagactggagttcgaggagaccgaggagcccgacttcaccgccctgtgccagaagctgaagatccccgaccacgtgagagagagagcctggctgacctgggagaaggtgagcagcgtggacggcgtgctgggcggctacatccagaagaagaaggagctgtggggcatctgcatcttcatcgccgccgtggacctggacgagatgagcttcaccttcaccgagctgcagaagaacatcgagatcagcgtgcacaagttcttcaacctgctgaaggagatcgacaccagcaccaaggtggacaacgccatgagcagactgctgaagaagtacgacgtgctgttcgccctgttcagcaagctggagagaacctgcgagctgatctacctgacccagcccagcagcagcatcagcaccgagatcaacagcgccctggtgctgaaggtgagctggatcaccttcctgctggccaagggcgaggtgctgcagatggaggacgacctggtgatcagcttccagctgatgctgtgcgtgctggactacttcatcaagctgagcccccccatgctgctgaaggagccctacaagaccgccgtgatccccatcaacggcagccccagaacccccagaagaggccagaacagaagcgccagaatcgccaagcagctggagaacgacaccagaatcatcgaggtgctgtgcaaggagcacgagtgcaacatcgacgaggtgaagaacgtgtacttcaagaacttcatccccttcatgaacagcctgggcctggtgaccagcaacggcctgcccgaggtggagaacctgagcaagagatacgaggagatctacctgaagaacaaggacctggacgccagactgttcctggaccacgacaagaccctgcagaccgacagcatcgacagcttcgagacccagagaacccccagaaagagcaacctggacgaggaggtgaacgtgatccccccccacacccccgtgagaaccgtgatgaacaccatccagcagctgatgatgatcctgaacagcgccagcgaccagcccagcgagaacctgatcagctacttcaacaactgcaccgtgaaccccaaggagagcatcctgaagagagtgaaggacatcggctacatcttcaaggagaagttcgccaaggccgtgggccagggctgcgtggagatcggcagccagagatacaagctgggcgtgagactgtactacagagtgatggagagcatgctgaagagcgaggaggagagactgagcatccagaacttcagcaagctgctgaacgacaacatcttccacatgagcctgctggcctgcgccctggaggtggtgatggccacctacagcagaagcaccagccagaacctggacagcggcaccgacctgagcttcccctggatcctgaacgtgctgaacctgaaggccttcgacttctacaaggtgatcgagagcttcatcaaggccgagggcaacctgaccagagagatgatcaagcacctggagagatgcgagcacagaatcatggagagcctggcctggctgagcgacagccccctgttcgacctgatcaagcagagcaaggacagagagggccccaccgaccacctggagagcgcctgccccctgaacctgcccctgcagaacaaccacaccgccgccgacatgtacctgagccccgtgagaagccccaagaagaagggcagcaccaccagagtgaacagcaccgccaacgccgagacccaggccaccagcgccttccagacccagaagcccctgaagagcaccagcctgagcctgttctacaagaaggtgtacagactggcctacctgagactgaacaccctgtgcgagagactgctgagcgagcaccccgagctggagcacatcatctggaccctgttccagcacaccctgcagaacgagtacgagctgatgagagacagacacctggaccagatcatgatgtgcagcatgtacggcatctgcaaggtgaagaacatcgacctgaagttcaagatcatcgtgaccgcctacaaggacctgccccacgccgtgcaggagaccttcaagagagtgctgatcaaggaggaggagtacgacagcatcatcgtgttctacaacagcgtgttcatgcagagactgaagaccaacatcctgcagtacgccagcaccagaccccccaccctgagccccatcccccacatccccagaagcccctacaagttccccagcagccccctgagaatccccggcggcaacatctacatcagccccctgaagagcccctacaagatcagcgagggcctgcccacccccaccaagatgacccccagaagcagaatcctggtgagcatcggcgagagcttcggcaccagcgagaagttccagaagatcaaccagatggtgtgcaacagcgacagagtgctgaagagaagcgccgagggcagcaacccccccaagcccctgaagaagctgagattcgacatcgagggcagcgacgaggccgacggcagcaagcacctgcccggcgagagcaagttccagcagaagctggccgagatgaccagcaccagaaccagaatgcagaagcagaagatgaacgacagcatggacaccagcaacaaggaggagaagtag

SEQ ID NO: 12659 - DNA, 162 bp, Artificial Sequence
  Description of Artificial Sequence: Synthetic coding sequence
atgccccccaagacccccagaaagaccgccgccaccgccgccgccgccgccgccgagccccccgcccccccccccccccccccccccgaggaggaccccgagcaggacagcggccccgaggacctgcccctggtgagaggcagcatcaccaacggcagatag

SEQ ID NO: 12660 - DNA, 2724 bp, Artificial Sequence
  Description of Artificial Sequence: Synthetic coding sequence
atgccccccaagacccccccccccgaggaggaccccgagcaggacagcggccccgaggacctgcccctggtgagactggagttcgaggagaccgaggagcccgacttcaccgccctgtgccagaagctgaagatccccgaccacgtgagagagagagcctggctgacctgggagaaggtgagcagcgtggacggcgtgctgggcggctacatccagaagaagaaggagctgtggggcatctgcatcttcatcgccgccgtggacctggacgagatgagcttcaccttcaccgagctgcagaagaacatcgagatcagcgtgcacaagttcttcaacctgctgaaggagatcgacaccagcaccaaggtggacaacgccatgagcagactgctgaagaagtacgacgtgctgttcgccctgttcagcaagctggagagaacctgcgagctgatctacctgacccagcccagcagcagcatcagcaccgagatcaacagcgccctggtgctgaaggtgagctggatcaccttcctgctggccaagggcgaggtgctgcagatggaggacgacctggtgatcagcttccagctgatgctgtgcgtgctggactacttcatcaagctgagcccccccatgctgctgaaggagccctacaagaccgccgtgatccccatcaacggcagccccagaacccccagaagaggccagaacagaagcgccagaatcgccaagcagctggagaacgacaccagaatcatcgaggtgctgtgcaaggagcacgagtgcaacatcgacgaggtgaagaacgtgtacttcaagaacttcatccccttcatgaacagcctgggcctggtgaccagcaacggcctgcccgaggtggagaacctgagcaagagatacgaggagatctacctgaagaacaaggacctggacgccagactgttcctggaccacgacaagaccctgcagaccgacagcatcgacagcttcgagacccagagaacccccagaaagagcaacctggacgaggaggtgaacgtgatccccccccacacccccgtgagaaccgtgatgaacaccatccagcagctgatgatgatcctgaacagcgccagcgaccagcccagcgagaacctgatcagctacttcaacaactgcaccgtgaaccccaaggagagcatcctgaagagagtgaaggacatcggctacatcttcaaggagaagttcgccaaggccgtgggccagggctgcgtggagatcggcagccagagatacaagctgggcgtgagactgtactacagagtgatggagagcatgctgaagagcgaggaggagagactgagcatccagaacttcagcaagctgctgaacgacaacatcttccacatgagcctgctggcctgcgccctggaggtggtgatggccacctacagcagaagcaccagccagaacctggacagcggcaccgacctgagcttcccctggatcctgaacgtgctgaacctgaaggccttcgacttctacaaggtgatcgagagcttcatcaaggccgagggcaacctgaccagagagatgatcaagcacctggagagatgcgagcacagaatcatggagagcctggcctggctgagcgacagccccctgttcgacctgatcaagcagagcaaggacagagagggccccaccgaccacctggagagcgcctgccccctgaacctgcccctgcagaacaaccacaccgccgccgacatgtacctgagccccgtgagaagccccaagaagaagggcagcaccaccagagtgaacagcaccgccaacgccgagacccaggccaccagcgccttccagacccagaagcccctgaagagcaccagcctgagcctgttctacaagaaggtgtacagactggcctacctgagactgaacaccctgtgcgagagactgctgagcgagcaccccgagctggagcacatcatctggaccctgttccagcacaccctgcagaacgagtacgagctgatgagagacagacacctggaccagatcatgatgtgcagcatgtacggcatctgcaaggtgaagaacatcgacctgaagttcaagatcatcgtgaccgcctacaaggacctgccccacgccgtgcaggagaccttcaagagagtgctgatcaaggaggaggagtacgacagcatcatcgtgttctacaacagcgtgttcatgcagagactgaagaccaacatcctgcagtacgccagcaccagaccccccaccctgagccccatcccccacatccccagaagcccctacaagttccccagcagccccctgagaatccccggcggcaacatctacatcagccccctgaagagcccctacaagatcagcgagggcctgcccacccccaccaagatgacccccagaagcagaatcctggtgagcatcggcgagagcttcggcaccagcgagaagttccagaagatcaaccagatggtgtgcaacagcgacagagtgctgaagagaagcgccgagggcagcaacccccccaagcccctgaagaagctgagattcgacatcgagggcagcgacgaggccgacggcagcaagcacctgcccggcgagagcaagttccagcagaagctggccgagatgaccagcaccagaaccagaatgcagaagcagaagatgaacgacagcatggacaccagcaacaaggaggagaagtag

SEQ ID NO: 12661 - DNA, 2694 bp, Artificial Sequence
  Description of Artificial Sequence: Synthetic coding sequence
atgaacatcagcggcagcagctgcggcagccccaacagcgccgacaccagcagcgacttcaaggacctgtggaccaagctgaaggagtgccacgacagagaggtgcagggcctgcaggtgaaggtgaccaagctgaagcaggagagaatcctggacgcccagagactggaggagttcttcaccaagaaccagcagctgagagagcagcagaaggtgctgcacgagaccatcaaggtgctggaggacagactgagagccggcctgtgcgacagatgcgccgtgaccgaggagcacatgagaaagaagcagcaggagttcgagaacatcagacagcagaacctgaagctgatcaccgagctgatgaacgagagaaacaccctgcaggaggagaacaagaagctgagcgagcagctgcagcagaagatcgagaacgaccagcagcaccaggccgccgagctggagtgcgaggaggacgtgatccccgacagccccatcaccgccttcagcttcagcggcgtgaacagactgagaagaaaggagaacccccacgtgagatacatcgagcagacccacaccaagctggagcacagcgtgtgcgccaacgagatgagaaaggtgagcaagagcagcacccacccccagcacaaccccaacgagaacgagatcctggtggccgacacctacgaccagagccagagccccatggccaaggcccacggcaccagcagctacacccccgacaagagcagcttcaacctggccaccgtggtggccgagaccctgggcctgggcgtgcaggaggagagcgagacccagggccccatgagccccctgggcgacgagctgtaccactgcctggagggcaaccacaagaagcagcccttcgaggagagcaccagaaacaccgaggacagcctgagattcagcgacagcaccagcaagacccccccccaggaggagctgcccaccagagtgagcagccccgtgttcggcgccaccagcagcatcaagagcggcctggacctgaacaccagcctgagccccagcctgctgcagcccggcaagaagaagcacctgaagaccctgcccttcagcaacacctgcatcagcagactggagaagaccagaagcaagagcgaggacagcgccctgttcacccaccacagcctgggcagcgaggtgaacaagatcatcatccagagcagcaacaagcagatcctgatcaacaagaacatcagcgagagcctgggcgagcagaacagaaccgagtacggcaaggacagcaacaccgacaagcacctggagcccctgaagagcctgggcggcagaaccagcaagagaaagaagaccgaggaggagagcgagcacgaggtgagctgcccccaggccagcttcgacaaggagaacgccttccccttccccatggacaaccagttcagcatgaacggcgactgcgtgatggacaagcccctggacctgagcgacagattcagcgccatccagagacaggagaagagccagggcagcgagaccagcaagaacaagttcagacaggtgaccctgtacgaggccctgaagaccatccccaagggcttcagcagcagcagaaaggccagcgacggcaactgcaccctgcccaaggacagccccggcgagccctgcagccaggagtgcatcatcctgcagcccctgaacaagtgcagccccgacaacaagcccagcctgcagatcaaggaggagaacgccgtgttcaagatccccctgagacccagagagagcctggagaccgagaacgtgctggacgacatcaagagcgccggcagccacgagcccatcaagatccagaccagaagcgaccacggcggctgcgagctggccagcgtgctgcagctgaacccctgcagaaccggcaagatcaagagcctgcagaacaaccaggacgtgagcttcgagaacatccagtggagcatcgaccccggcgccgacctgagccagtacaagatggacgtgaccgtgatcgacaccaaggacggcagccagagcaagctgggcggcgagaccgtggacatggactgcaccctggtgagcgagaccgtgctgctgaagatgaagaagcaggagcagaagggcgagaagagcagcaacgaggagagaaagatgaacgacagcctggaggacatgttcgacagaaccacccacgaggagtacgagagctgcctggccgacagcttcagccaggccgccgacgaggaggaggagctgagcaccgccaccaagaagctgcacacccacggcgacaagcaggacaaggtgaagcagaaggccttcgtggagccctacttcaagggcgacgagagagagaccagcctgcagaacttcccccacatcgaggtggtgagaaagaaggaggagagaagaaagctgctgggccacacctgcaaggagtgcgagatctactacgccgacatgcccgccgaggagagagagaagaagctggccagctgcagcagacacagattcagatacatcccccccaacacccccgagaacttctgggaggtgggcttccccagcacccagacctgcatggagagaggctacatcaaggaggacctggacccctgccccagacccaagagaagacagccctacaacgccatcttcagccccaagggcaaggagcagaagacctag

SEQ ID NO: 12662 - DNA, 2709 bp, Artificial Sequence
  Description of Artificial Sequence: Synthetic coding sequence
atgaacatcagcggcagcagctgcggcagccccaacagcgccgacaccagcagcgacttcaaggacctgtggaccaagctgaaggagtgccacgacagagaggtgcagggcctgcaggtgaaggtgaccaagctgaagcaggagagaatcctggacgcccagagactggaggagttcttcaccaagaaccagcagctgagagagcagcagaaggtgctgcacgagaccatcaaggtgctggaggacagactgagagccggcctgtgcgacagatgcgccgtgaccgaggagcacatgagaaagaagcagcaggagttcgagaacatcagacagcagaacctgaagctgatcaccgagctgatgaacgagagaaacaccctgcaggaggagaacaagaagctgagcgagcagctgcagcagaagatcgagaacgaccagcagcaccaggccgccgagctggagtgcgaggaggacgtgatccccgacagccccatcaccgccttcagcttcagcggcgtgaacagactgagaagaaaggagaacccccacgtgagatacatcgagcagacccacaccaagctggagcacagcgtgtgcgccaacgagatgagaaaggtgagcaagagcagcacccacccccagcacaaccccaacgagaacgagatcctggtggccgacacctacgaccagagccagagccccatggccaaggcccacggcaccagcagctacacccccgacaagagcagcttcaacctggccaccgtggtggccgagaccctgggcctgggcgtgcaggaggagagcgagacccagggccccatgagccccctgggcgacgagctgtaccactgcctggagggcaaccacaagaagcagcccttcgaggagagcaccagaaacaccgaggacagcctgagattcagcgacagcaccagcaagacccccccccaggaggagctgcccaccagagtgagcagccccgtgttcggcgccaccagcagcatcaagagcggcctggacctgaacaccagcctgagccccagcctgctgcagcccggcaagaagaagcacctgaagaccctgcccttcagcaacacctgcatcagcagactggagaagaccagaagcaagagcgaggacagcgccctgttcacccaccacagcctgggcagcgaggtgaacaagatcatcatccagagcagcaacaagcagatcctgatcaacaagaacatcagcgagagcctgggcgagcagaacagaaccgagtacggcaaggacagcaacaccgacaagcacctggagcccctgaagagcctgggcggcagaaccagcaagagaaagaagaccgaggaggagagcgagcacgaggtgagctgcccccaggccagcttcgacaaggagaacgccttccccttccccatggacaaccagttcagcatgaacggcgactgcgtgatggacaagcccctggacctgagcgacagattcagcgccatccagagacaggagaagagccagggcagcgagaccagcaagaacaagttcagacaggtgaccctgtacgaggccctgaagaccatccccaagggcttcagcagcagcagaaaggccagcgacggcaactgcaccctgcccaaggacagccccggcgagccctgcagccaggagtgcatcatcctgcagcccctgaacaagtgcagccccgacaacaagcccagcctgcagatcaaggaggagaacgccgtgttcaagatccccctgagacccagagagagcctggagaccgagaacgtgctggacgacatcaagagcgccggcagccacgagcccatcaagatccagaccagaagcgaccacggcggctgcgagctggccagcgtgctgcagctgaacccctgcagaaccggcaagatcaagagcctgcagaacaaccaggacgtgagcttcgagaacatccagtggagcatcgaccccggcgccgacctgagccagtacaagatggacgtgaccgtgatcgacaccaaggacggcagccagagcaagctgggcggcgagaccgtggacatggactgcaccctggtgagcgagaccgtgctgctgaagatgaagaagcaggagcagaagggcgagaagagcagcatgctgttctacatcgacgaggagagaaagatgaacgacagcctggaggacatgttcgacagaaccacccacgaggagtacgagagctgcctggccgacagcttcagccaggccgccgacgaggaggaggagctgagcaccgccaccaagaagctgcacacccacggcgacaagcaggacaaggtgaagcagaaggccttcgtggagccctacttcaagggcgacgagagagagaccagcctgcagaacttcccccacatcgaggtggtgagaaagaaggaggagagaagaaagctgctgggccacacctgcaaggagtgcgagatctactacgccgacatgcccgccgaggagagagagaagaagctggccagctgcagcagacacagattcagatacatcccccccaacacccccgagaacttctgggaggtgggcttccccagcacccagacctgcatggagagaggctacatcaaggaggacctggacccctgccccagacccaagagaagacagccctacaacgccatcttcagccccaagggcaaggagcagaagacctag

SEQ ID NO: 12663 - DNA, 2598 bp, Artificial Sequence
  Description of Artificial Sequence: Synthetic coding sequence
atgaacatcagcggcagcagctgcggcagccccaacagcgccgacaccagcagcgacttcaaggacctgtggaccaagctgaaggagtgccacgacagagaggtgcagggcctgcaggtgaaggtgaccaagctgaagcaggagagaatcctggacgcccagagactggaggagttcttcaccaagaaccagcagctgagagagcagcagaaggtgctgcacgagaccatcaaggtgctggaggacagactgagagccggcctgtgcgacagatgcgccgtgaccgaggagcacatgagaaagaagcagcaggagttcgagaacatcagacagcagaacctgaagctgatcaccgagctgatgaacgagagaaacaccctgcaggaggagaacaagaagctgagcgagcagctgcagcagaagatcgagaacgaccagcagcaccaggccgccgagctggagtgcgaggaggacgtgatccccgacagccccatcaccgccttcagcttcagcggcgtgaacagactgagaagaaaggagaacccccacgtgagatacatcgagcagacccacaccaagctggagcacagcgtgtgcgccaacgagatgagaaaggtgagcaagagcagcacccacccccagcacaaccccaacgagaacgagatcctggtggccgacacctacgaccagagccagagccccatggccaaggcccacggcaccagcagctacacccccgacaagagcagcttcaacctggccaccgtggtggccgagaccctgggcctgggcgtgcaggaggagagcgagacccagggccccatgagccccctgggcgacgagctgtaccactgcctggagggcaaccacaagaagcagcccttcgaggagagcaccagaaacaccgaggacagcctgagattcagcgacagcaccagcaagacccccccccaggaggagctgcccaccagagtgagcagccccgtgttcggcgccaccagcagcatcaagagcggcctggacctgaacaccagcctgagccccagcctgctgcagcccggcaagaagaagcacctgaagaccctgcccttcagcaacacctgcatcagcagactggagaagaccagaagcaagagcgaggacagcgccctgttcacccaccacagcctgggcagcgaggtgaacaagatcatcatccagagcagcaacaagcagatcctgatcaacaagaacatcagcgagagcctgggcgagcagaacagaaccgagtacggcaaggacagcaacaccgacaagcacctggagcccctgaagagcctgggcggcagaaccagcaagagaaagaagaccgaggaggagagcgagcacgaggtgagctgcccccaggccagcttcgacaaggagaacgccttccccttccccatggacaaccagttcagcatgaacggcgactgcgtgatggacaagcccctggacctgagcgacagattcagcgccatccagagacaggagaagagccagggcagcgagaccagcaagaacaagttcagacaggtgaccctgtacgaggccctgaagaccatccccaagggcttcagcagcagcagaaaggccagcgacggcaactgcaccctgcccaaggacagccccggcgagccctgcagccaggagtgcatcatcctgcagcccctgaacaagtgcagccccgacaacaagcccagcctgcagatcaaggaggagaacgccgtgttcaagatccccctgagacccagagagagcctggagaccgagaacgtgctggacgacatcaagagcgccggcagccacgagcccatcaagatccagaccagaagcgaccacggcggctgcgagctggccagcgtgctgcagctgaacccctgcagaaccggcaagatcaagagcctgcagaacaaccaggacgtgagcttcgagaacatccagtggagcatcgaccccggcgccgacctgagccagtacaagatggacgtgaccgtgatcgacaccaaggacggcagccagagcaagctgggcggcgagaccgtggacatggactgcaccctggtgagcgagaccgtgctgctgaagatgaagaagcaggagcagaagggcgagaagagcagcaacgaggagagaaagatgaacgacagcctggaggacatgttcgacagaaccacccacgaggagtacgagagctgcctggccgacagcttcagccaggccgccgacgaggaggaggagctgagcaccgccaccaagaagctgcacacccacggcgacaagcaggacaaggtgaagcagaaggccttcgtggagccctacttcaagggcgacgagagcatcatgcagatctgccagcagaagaaggagaagagaaactggctgcccgcccaggacaccgacagcgccaccttccaccccacccaccagagaatcttcggcaagctggtgttcctgcccctgagactggtgtggaaggaggtgatcctgagaaagatcctgatcctggtgctggtgcagaaggacgtgagcctgaccacccagtacttcctgcagaaggccagaagcagaagacactag

SEQ ID NO: 12664 - DNA, 2694 bp, Artificial Sequence; identical to SEQ ID NO: 12661
  Description of Artificial Sequence: Synthetic coding sequence

SEQ ID NO: 12665 - DNA, 2604 bp, Artificial Sequence
  Description of Artificial Sequence: Synthetic coding sequence
atgaacatcagcggcagcagctgcggcagccccaacagcgccgacaccagcagcgacttcaaggacctgtggaccaagctgaaggagtgccacgacagagaggtgcagggcctgcaggtgaaggtgaccaagctgaagcaggagagaatcctggacgcccagagactggaggagttcttcaccaagaaccagcagctgagagagcagcagaaggtgctgcacgagaccatcaaggtgctggaggacagactgagagccggcctgtgcgacagatgcgccgtgaccgaggagcacatgagaaagaagcagcaggagttcgagaacatcagacagcagaacctgaagctgatcaccgagctgatgaacgagagaaacaccctgcaggaggagaacaagaagctgagcgagcagctgcagcagaagatcgagaacgaccagcagcaccaggccgccgagctggagtgcgaggaggacgtgatccccgacagccccatcaccgccttcagcttcagcggcgtgaacagactgagaagaaaggagaacccccacgtgagatacatcgagcagacccacaccaagctggagcacagcgtgtgcgccaacgagatgagaaaggtgagcaagagcagcacccacccccagcacaaccccaacgagaacgagatcctggtggccgacacctacgaccagagccagagccccatggccaaggcccacggcaccagcagctacacccccgacaagagcagcttcaacctggccaccgtggtggccgagaccctgggcctgggcgtgcaggaggagagcgagacccagggccccatgagccccctgggcgacgagctgtaccactgcctggagggcaaccacaagaagcagcccttcgaggagagcaccagaaacaccgaggacagcctgagattcagcgacagcaccagcaagacccccccccaggaggagctgcccaccagagtgagcagccccgtgttcggcgccaccagcagcatcaagagcggcctggacctgaacaccagcctgagccccagcctgctgcagcccggcaagaagaagcacctgaagaccctgcccttcagcaacacctgcatcagcagactggagaagaccagaagcaagagcgaggacagcgccctgttcacccaccacagcctgggcagcgaggtgaacaagatcatcatccagagcagcaacaagcagatcctgatcaacaagaacatcagcgagagcctgggcgagcagaacagaaccgagtacggcaaggacagcaacaccgacaagcacctggagcccctgaagagcctgggcggcagaaccagcaagagaaagaagaccgaggaggagagcgagcacgaggtgagctgcccccaggccagcttcgacaaggagaacgccttccccttccccatggacaaccagttcagcatgaacggcgactgcgtgatggacaagcccctggacctgagcgacagattcagcgccatccagagacaggagaagagccagggcagcgagaccagcaagaacaagttcagacaggtgaccctgtacgaggccctgaagaccatccccaagggcttcagcagcagcagaaaggccagcgacggcaactgcaccctgcccaaggacagccccggcgagccctgcagccaggagtgcatcatcctgcagcccctgaacaagtgcagccccgacaacaagcccagcctgcagatcaaggaggagaacgccgtgttcaagatccccctgagacccagagagagcctggagaccgagaacgtgctggacgacatcaagagcgccggcagccacgagcccatcaagatccagaccagaagcgaccacggcggctgcgagctggccagcgtgctgcagctgaacccctgcagaaccggcaagatcaagagcctgcagaacaaccaggacgtgagcttcgagaacatccagtggagcatcgaccccggcgccgacctgagccagtacaagatggacgtgaccgtgatcgacaccaaggacggcagccagagcaagctgggcggcgagaccgtggacatggactgcaccctggtgagcgagaccgtgctgctgaagatgaagaagcaggagcagaagggcgagaagagcagcaacgaggagagaaagatgaacgacagcctggaggacatgttcgacagaaccacccacgaggagtacgagagctgcctggccgacagcttcagccaggccgccgacgaggaggaggagctgagcaccgccaccaagaagctgcacacccacggcgacaagcaggacaaggtgaagcagaaggccttcgtggagccctacttcaagggcgacgagagcatcatgcagatctgccagcagaagaaggagaagagaaactggctgcccgcccaggacaccgacagcgccaccttccaccccacccaccagagaatcttcggcaagctggtgttcctgcccctgagactggtgtggaaggaggtgatcctgagaaagatcctgatcctggtgctggtgcagaaggacgtgagcctgaccacccagtacttcctgcagaaggccagaagcagaagacacagaagatag

SEQ ID NO: 12666 - DNA, 3045 bp, Artificial Sequence
  Description of Artificial Sequence: Synthetic coding sequence
atgttcgaggacaagccccacgccgagggcgccgccgtggtggccgccgccggcgaggccctgcaggccctgtgccaggagctgaacctggacgagggcagcgccgccgaggccctggacgacttcaccgccatcagaggcaactacagcctggagggcgaggtgacccactggctggcctgcagcctgtacgtggcctgcagaaagagcatcatccccaccgtgggcaagggcatcatggagggcaactgcgtgagcctgaccagaatcctgagaagcgccaagctgagcctgatccagttcttcagcaagatgaagaagtggatggacatgagcaacctgccccaggagttcagagagagaatcgagagactggagagaaacttcgaggtgagcaccgtgatcttcaagaagtacgagcccatcttcctggacatcttccagaacccctacgaggagccccccaagctgcccagaagcagaaagcagagaagaatcccctgcagcgtgaaggacctgttcaacttctgctggaccctgttcgtgtacaccaagggcaacttcagaatgatcggcgacgacctggtgaacagctaccacctgctgctgtgctgcctggacctgatcttcgccaacgccatcatgtgccccaacagacaggacctgctgaaccccagcttcaagggcctgcccagcgacttccacaccgccgacttcaccgccagcgaggagcccccctgcatcatcgccgtgctgtgcgagctgcacgacggcctgctggtggaggccaagggcatcaaggagcactacttcaagccctacatcagcaagctgttcgacagaaagatcctgaagggcgagtgcctgctggacctgagcagcttcaccgacaacagcaaggccgtgaacaaggagtacgaggagtacgtgctgaccgtgggcgacttcgacgagagaatcttcctgggcgccgacgccgaggaggagatcggcacccccagaaagttcaccagagacacccccctgggcaagctgaccgcccaggccaacgtggagtacaacctgcagcagcacttcgagaagaagagaagcttcgcccccagcacccccctgaccggcagaagatacctgagagagaaggaggccgtgatcacccccgtggccagcgccacccagagcgtgagcagactgcagagcatcgtggccggcctgaagaacgcccccagcgaccagctgatcaacatcttcgagagctgcgtgagaaaccccgtggagaacatcatgaagatcctgaagggcatcggcgagaccttctgccagcactacacccagagcaccgacgagcagcccggcagccacatcgacttcgccgtgaacagactgaagctggccgagatcctgtactacaagatcctggagaccgtgatggtgcaggagaccagaagactgcacggcatggacatgagcgtgctgctggagcaggacatcttccacagaagcctgatggcctgctgcctggagatcgtgctgttcgcctacagcagccccagaaccttcccctggatcatcgaggtgctgaacctgcagcccttctacttctacaaggtgatcgaggtggtgatcagaagcgaggagggcctgagcagagacatggtgaagcacctgaacagcatcgaggagcagatcctggagagcctggcctggagccacgacagcgccctgtgggaggccctgcaggtgagcgccaacaaggtgcccacctgcgaggaggtgatcttccccaacaacttcgagaccggcaacggcggcaacgtgcagggccacctgcccctgatgcccatgagccccctgatgcaccccagagtgaaggaggtgagaaccgacagcggcagcctgagaagagacatgcagcccctgagccccatcagcgtgcacgagagatacagcagccccaccgccggcagcgccaagagaagactgttcggcgaggacccccccaaggagatgctgatggacaagatcatcaccgagggcaccaagctgaagatcgcccccagcagcagcatcaccgccgagaacgtgagcatcctgcccggccagaccctgctgaccatggccaccgcccccgtgaccggcaccaccggccacaaggtgaccatccccctgcacggcgtggccaacgacgccggcgagatcaccctgatccccctgagcatgaacaccaaccaggagagcaaggtgaagagccccgtgagcctgaccgcccacagcctgatcggcgccagccccaagcagaccaacctgaccaaggcccaggaggtgcacagcaccggcatcaacagacccaagagaaccggcagcctggccctgttctacagaaaggtgtaccacctggccagcgtgagactgagagacctgtgcctgaagctggacgtgagcaacgagctgagaagaaagatctggacctgcttcgagttcaccctggtgcactgccccgacctgatgaaggacagacacctggaccagctgctgctgtgcgccttctacatcatggccaaggtgaccaaggaggagagaaccttccaggagatcatgaagagctacagaaaccagccccaggccaacagccacgtgtacagaagcgtgctgctgaagagcatccccagagaggtggtggcctacaacaagaacatcaacgacgacttcgagatgatcgactgcgacctggaggacgccaccaagacccccgactgcagcagcggccccgtgaaggaggagagaggcgacctgatcaagttctacaacaccatctacgtgggcagagtgaagagcttcgccctgaagtacgacctggccaaccaggaccacatgatggacgccccccccctgagccccttcccccacatcaagcagcagcccggcagccccagaagaatcagccagcagcacagcatctacatcagcccccacaagaacggcagcggcctgacccccagaagcgccctgctgtacaagttcaacggcagccccagcaaggtgagatag

SEQ ID NO: 12667 - DNA, 3207 bp, Artificial Sequence
  Description of Artificial Sequence: Synthetic coding sequence
atgttcgaggacaagccccacgccgagggcgccgccgtggtggccgccgccggcgaggccctgcaggccctgtgccaggagctgaacctggacgagggcagcgccgccgaggccctggacgacttcaccgccatcagaggcaactacagcctggagggcgaggtgacccactggctggcctgcagcctgtacgtggcctgcagaaagagcatcatccccaccgtgggcaagggcatcatggagggcaactgcgtgagcctgaccagaatcctgagaagcgccaagctgagcctgatccagttcttcagcaagatgaagaagtggatggacatgagcaacctgccccaggagttcagagagagaatcgagagactggagagaaacttcgaggtgagcaccgtgatcttcaagaagtacgagcccatcttcctggacatcttccagaacccctacgaggagccccccaagctgcccagaagcagaaagcagagaagaatcccctgcagcgtgaaggacctgttcaacttctgctggaccctgttcgtgtacaccaagggcaacttcagaatgatcggcgacgacctggtgaacagctaccacctgctgctgtgctgcctggacctgatcttcgccaacgccatcatgtgccccaacagacaggacctgctgaaccccagcttcaagggcctgcccagcgacttccacaccgccgacttcaccgccagcgaggagcccccctgcatcatcgccgtgctgtgcgagctgcacgacggcctgctggtggaggccaagggcatcaaggagcactacttcaagccctacatcagcaagctgttcgacagaaagatcctgaagggcgagtgcctgctggacctgagcagcttcaccgacaacagcaaggccgtgaacaaggagtacgaggagtacgtgctgaccgtgggcgacttcgacgagagaatcttcctgggcgccgacgccgaggaggagatcggcacccccagaaagttcaccagagacacccccctgggcaagctgaccgcccaggccaacgtggagtacaacctgcagcagcacttcgagaagaagagaagcttcgcccccagcacccccctgaccggcagaagatacctgagagagaaggaggccgtgatcacccccgtggccagcgccacccagagcgtgagcagactgcagagcatcgtggccggcctgaagaacgcccccagcgaccagctgatcaacatcttcgagagctgcgtgagaaaccccgtggagaacatcatgaagatcctgaagggcatcggcgagaccttctgccagcactacacccagagcaccgacgagcagcccggcagccacatcgacttcgccgtgaacagactgaagctggccgagatcctgtactacaagatcctggagaccgtgatggtgcaggagaccagaagactgcacggcatggacatgagcgtgctgctggagcaggacatcttccacagaagcctgatggcctgctgcctggagatcgtgctgttcgcctacagcagccccagaaccttcccctggatcatcgaggtgctgaacctgcagcccttctacttctacaaggtgatcgaggtggtgatcagaagcgaggagggcctgagcagagacatggtgaagcacctgaacagcatcgaggagcagatcctggagagcctggcctggagccacgacagcgccctgtgggaggccctgcaggtgagcgccaacaaggtgcccacctgcgaggaggtgatcttccccaacaacttcgagaccggcaacggcggcaacgtgcagggccacctgcccctgatgcccatgagccccctgatgcaccccagagtgaaggaggtgagaaccgacagcggcagcctgagaagagacatgcagcccctgagccccatcagcgtgcacgagagatacagcagccccaccgccggcagcgccaagagaagactgttcggcgaggacccccccaaggagatgctgatggacaagatcatcaccgagggcaccaagctgaagatcgcccccagcagcagcatcaccgccgagaacgtgagcatcctgcccggccagaccctgctgaccatggccaccgcccccgtgaccggcaccaccggccacaaggtgaccatccccctgcacggcgtggccaacgacgccggcgagatcaccctgatccccctgagcatgaacaccaaccaggagagcaaggtgaagagccccgtgagcctgaccgcccacagcctgatcggcgccagccccaagcagaccaacctgaccaaggcccaggaggtgcacagcaccggcatcaacagacccaagagaaccggcagcctggccctgttctacagaaaggtgtaccacctggccagcgtgagactgagagacctgtgcctgaagctggacgtgagcaacgagctgagaagaaagatctggacctgcttcgagttcaccctggtgcactgccccgacctgatgaaggacagacacctggaccagctgctgctgtgcgccttctacatcatggccaaggtgaccaaggaggagagaaccttccaggagatcatgaagagctacagaaaccagccccaggccaacagccacgtgtacagaagcgtgctgctgaagagcatccccagagaggtggtggcctacaacaagaacatcaacgacgacttcgagatgatcgactgcgacctggaggacgccaccaagacccccgactgcagcagcggccccgtgaaggaggagagaggcgacctgatcaagttctacaacaccatctacgtgggcagagtgaagagcttcgccctgaagtacgacctggccaaccaggaccacatgatggacgccccccccctgagccccttcccccacatcaagcagcagcccggcagccccagaagaatcagccagcagcacagcatctacatcagcccccacaagaacggcagcggcctgacccccagaagcgccctgctgtacaagttcaacggcagccccagcaagagcctgaaggacatcaacaacatgatcagacagggcgagcagagaaccaagaagagagtgatcgccatcgacagcgacgccgagagccccgccaagagagtgtgccaggagaacgacgacgtgctgctgaagagactgcaggacgtggtgagcgagagagccaaccactag

SEQ ID NO: 12668 - DNA, 3420 bp, Artificial Sequence
  Description of Artificial Sequence: Synthetic coding sequence
atgcccagcggcggcgaccagagcccccccccccccccccccccccccgccgccgccgccagcgacgaggaggaggaggacgacggcgaggccgaggacgccgccccccccgccgagagccccaccccccagatccagcagagattcgacgagctgtgcagcagactgaacatggacgaggccgccagagccgaggcctgggacagctacagaagcatgagcgagagctacaccctggagggcaacgacctgcactggctggcctgcgccctgtacgtggcctgcagaaagagcgtgcccaccgtgagcaagggcaccgtggagggcaactacgtgagcctgaccagaatcctgaagtgcagcgagcagagcctgatcgagttcttcaacaagatgaagaagtgggaggacatggccaacctgcccccccacttcagagagagaaccgagagactggagagaaacttcaccgtgagcgccgtgatcttcaagaagtacgagcccatcttccaggacatcttcaagtacccccaggaggagcagcccagacagcagagaggcagaaagcagagaagacagccctgcaccgtgagcgagatcttccacttctgctgggtgctgttcatctacgccaagggcaacttccccatgatcagcgacgacctggtgaacagctaccacctgctgctgtgcgccctggacctggtgtacggcaacgccctgcagtgcagcaacagaaaggagctggtgaaccccaacttcaagggcctgagcgaggacttccacgccaaggacagcaagcccagcagcgaccccccctgcatcatcgagaagctgtgcagcctgcacgacggcctggtgctggaggccaagggcatcaaggagcacttctggaagccctacatcagaaagctgtacgagaagaagctgctgaagggcaaggaggagaacctgaccggcttcctggagcccggcaacttcggcgagagcttcaaggccatcaacaaggcctacgaggagtacgtgctgagcgtgggcaacctggacgagagaatcttcctgggcgaggacgccgaggaggagatcggcaccctgagcagatgcctgaacgccggcagcggcaccgagaccgccgagagagtgcagatgaagaacatcctgcagcagcacttcgacaagagcaaggccctgagaatcagcacccccctgaccggcgtgagatacatcaaggagaacagcccctgcgtgacccccgtgagcaccgccacccacagcctgagcagactgcacaccatgctgaccggcctgagaaacgcccccagcgagaagctggagcagatcctgagaacctgcagcagagaccccacccaggccatcgccaacagactgaaggagatgttcgagatctacagccagcacttccagcccgacgaggacttcagcaactgcgccaaggagatcgccagcaagcacttcagattcgccgagatgctgtactacaaggtgctggagagcgtgatcgagcaggagcagaagagactgggcgacatggacctgagcggcatcctggagcaggacgccttccacagaagcctgctggcctgctgcctggaggtggtgaccttcagctacaagccccccggcaacttccccttcatcaccgagatcttcgacgtgcccctgtaccacttctacaaggtgatcgaggtgttcatcagagccgaggacggcctgtgcagagaggtggtgaagcacctgaaccagatcgaggagcagatcctggaccacctggcctggaagcccgagagccccctgtgggagaagatcagagacaacgagaacagagtgcccacctgcgaggaggtgatgcccccccagaacctggagagagccgacgagatctgcatcgccggcagccccctgacccccagaagagtgaccgaggtgagagccgacaccggcggcctgggcagaagcatcaccagccccaccaccctgtacgacagatacagcagcccccccgccagcaccaccagaagaagactgttcgtggagaacgacagccccagcgacggcggcacccccggcagaatgcccccccagcccctggtgaacgccgtgcccgtgcagaacgtgagcggcgagaccgtgagcgtgacccccgtgcccggccagaccctggtgaccatggccaccgccaccgtgaccgccaacaacggccagaccgtgaccatccccgtgcagggcatcgccaacgagaacggcggcatcaccttcttccccgtgcaggtgaacgtgggcggccaggcccaggccgtgaccggcagcatccagcccctgagcgcccaggccctggccggcagcctgagcagccagcaggtgaccggcaccaccctgcaggtgcccggccaggtggccatccagcagatcagccccggcggccagcagcagaagcagggccagagcgtgaccagcagcagcaacagacccagaaagaccagcagcctgagcctgttcttcagaaaggtgtaccacctggccgccgtgagactgagagacctgtgcgccaagctggacatcagcgacgagctgagaaagaagatctggacctgcttcgagttcagcatcatccagtgccccgagctgatgatggacagacacctggaccagctgctgatgtgcgccatctacgtgatggccaaggtgaccaaggaggacaagagcttccagaacatcatgagatgctacagaacccagccccaggccagaagccaggtgtacagaagcgtgctgatcaagggcaagagaaagagaagaaacagcggcagcagcgacagcagaagccaccagaacagccccaccgagctgaacaaggacagaaccagcagagacagcagccccgtgatgagaagcagcagcaccctgcccgtgccccagcccagcagcgccccccccacccccaccagactgaccggcgccaacagcgacatggaggaggaggagagaggcgacctgatccagttctacaacaacatctacatcaagcagatcaagaccttcgccatgaagtacagccaggccaacatggacgccccccccctgagcccctaccccttcgtgagaaccggcagccccagaagaatccagctgagccagaaccaccccgtgtacatcagcccccacaagaacgagaccatgctgagccccagagagaagatcttctactacttcagcaacagccccagcaagagactgagagagatcaacagcatgatcagaaccggcgagacccccaccaagaagagaggcatcctgctggaggacggcagcgagagccccgccaagagaatctgccccgagaaccacagcgccctgctgagaagactgcaggacgtggccaacgacagaggcagccactag

SEQ ID NO: 12669 - DNA, 2550 bp, Artificial Sequence
  Description of Artificial Sequence: Synthetic coding sequence
atggagagcagatgcgtggcccaggccggcatgcagtggcacgacctgggcagcctgcagcccctgccccccagattcaagagattcttctgcctgagcctgctgagcagctgcgagtacagcaaggccatcaacaaggcctacgaggagtacgtgctgagcgtgggcaacctggacgagagaatcttcctgggcgaggacgccgaggaggagatcggcaccctgagcagatgcctgaacgccggcagcggcaccgagaccgccgagagagtgcagatgaagaacatcctgcagcagcacttcgacaagagcaaggccctgagaatcagcacccccctgaccggcgtgagatacatcaaggagaacagcccctgcgtgacccccgtgagcaccgccacccacagcctgagcagactgcacaccatgctgaccggcctgagaaacgcccccagcgagaagctggagcagatcctgagaacctgcagcagagaccccacccaggccatcgccaacagactgaaggagatgttcgagatctacagccagcacttccagcccgacgaggacttcagcaactgcgccaaggagatcgccagcaagcacttcagattcgccgagatgctgtactacaaggtgctggagagcgtgatcgagcaggagcagaagagactgggcgacatggacctgagcggcatcctggagcaggacgccttccacagaagcctgctggcctgctgcctggaggtggtgaccttcagctacaagccccccggcaacttccccttcatcaccgagatcttcgacgtgcccctgtaccacttctacaaggtgatcgaggtgttcatcagagccgaggacggcctgtgcagagaggtggtgaagcacctgaaccagatcgaggagcagatcctggaccacctggcctggaagcccgagagccccctgtgggagaagatcagagacaacgagaacagagtgcccacctgcgaggaggtgatgcccccccagaacctggagagagccgacgagatctgcatcgccggcagccccctgacccccagaagagtgaccgaggtgagagccgacaccggcggcctgggcagaagcatcaccagccccaccaccctgtacgacagatacagcagcccccccgccagcaccaccagaagaagactgttcgtggagaacgacagccccagcgacggcggcacccccggcagaatgcccccccagcccctggtgaacgccgtgcccgtgcagaacgtgagcggcgagaccgtgagcgtgacccccgtgcccggccagaccctggtgaccatggccaccgccaccgtgaccgccaacaacggccagaccgtgaccatccccgtgcagggcatcgccaacgagaacggcggcatcaccttcttccccgtgcaggtgaacgtgggcggccaggcccaggccgtgaccggcagcatccagcccctgagcgcccaggccctggccggcagcctgagcagccagcaggtgaccggcaccaccctgcaggtgcccggccaggtggccatccagcagatcagccccggcggccagcagcagaagcagggccagagcgtgaccagcagcagcaacagacccagaaagaccagcagcctgagcctgttcttcagaaaggtgtaccacctggccgccgtgagactgagagacctgtgcgccaagctggacatcagcgacgagctgagaaagaagatctggacctgcttcgagttcagcatcatccagtgccccgagctgatgatggacagacacctggaccagctgctgatgtgcgccatctacgtgatggccaaggtgaccaaggaggacaagagcttccagaacatcatgagatgctacagaacccagccccaggccagaagccaggtgtacagaagcgtgctgatcaagggcaagagaaagagaagaaacagcggcagcagcgacagcagaagccaccagaacagccccaccgagctgaacaaggacagaaccagcagagacagcagccccgtgatgagaagcagcagcaccctgcccgtgccccagcccagcagcgccccccccacccccaccagactgaccggcgccaacagcgacatggaggaggaggagagaggcgacctgatccagttctacaacaacatctacatcaagcagatcaagaccttcgccatgaagtacagccaggccaacatggacgccccccccctgagcccctaccccttcgtgagaaccggcagccccagaagaatccagctgagccagaaccaccccgtgtacatcagcccccacaagaacgagaccatgctgagccccagagagaagatcttctactacttcagcaacagccccagcaagagactgagagagatcaacagcatgatcagaaccggcgagacccccaccaagaagagaggcatcctgctggaggacggcagcgagagccccgccaagagaatctgccccgagaaccacagcgccctgctgagaagactgcaggacgtggccaacgacagaggcagccactag

SEQ ID NO: 12670 - DNA, 1668 bp, Artificial Sequence
  Description of Artificial Sequence: Synthetic coding sequence
atgcagagcctgaccaagggcaacgacctgcactggctggcctgcgccctgtacgtggcctgcagaaagagcgtgcccaccgtgagcaagggcaccgtggagggcaactacgtgagcctgaccagaatcctgaagtgcagcgagcagagcctgatcgagttcttcaacaagatgaagaagtgggaggacatggccaacctgcccccccacttcagagagagaaccgagagactggagagaaacttcaccgtgagcgccgtgatcttcaagaagtacgagcccatcttccaggacatcttcaagtacccccaggaggagcagcccagacagcagagaggcagaaagcagagaagacagccctgcaccgtgagcgagatcttccacttctgctgggtgctgttcatctacgccaagggcaacttccccatgatcagcgacgacctggtgaacagctaccacctgctgctgtgcgccctggacctggtgtacggcaacgccctgcagtgcagcaacagaaaggagctggtgaaccccaacttcaagggcctgagcgaggacttccacgccaaggacagcaagcccagcagcgaccccccctgcatcatcgagaagctgtgcagcctgcacgacggcctggtgctggaggccaagggcatcaaggagcacttctggaagccctacatcagaaagctgtacgagaagaagctgctgaagggcaaggaggagaacctgaccggcttcctggagcccggcaacttcggcgagagcttcaaggccatcaacaaggcctacgaggagtacgtgctgagcgtgggcaacctggacgagagaatcttcctgggcgaggacgccgaggaggagatcggcaccctgagcagatgcctgaacgccggcagcggcaccgagaccgccgagagagtgcagatgaagaacatcctgcagcagcacttcgacaagagcaaggccctgagaatcagcacccccctgaccggcgtgagatacatcaaggagaacagcccctgcgtgacccccgtgagcaccgccacccacagcctgagcagactgcacaccatgctgaccggcctgagaaacgcccccagcgagaagctggagcagatcctgagaacctgcagcagagaccccacccaggccatcgccaacagactgaaggagatgttcgagatctacagccagcacttccagcccgacgaggacttcagcaactgcgccaaggagatcgccagcaagcacttcagattcgccgagatgctgtactacaaggtgctggagagcgtgatcgagcaggagcagaagagactgggcgacatggacctgagcggcatcctggagcaggacgccttccacagaagcctgctggcctgctgcctggaggtggtgaccttcagctacaagccccccggcaacttccccttcatcaccgagatcttcgacgtgcccctgtaccacttctacaaggtgatcgaggtgttcatcagagccgaggacggcctgtgcagagaggtggtgaagcacctgaaccagatcgaggagcagatcctggaccacctggcctggaagcccgagagccccctgtgggagaagatcagagacaacgagaacagagtgcccacctgcgaggaggtgatgcccccccagaacctggagtag

SEQ ID NO: 12671 - DNA, 1557 bp, Artificial Sequence
  Description of Artificial Sequence: Synthetic coding sequence
atgatcagcgacgacctggtgaacagctaccacctgctgctgtgcgccctggacctggtgtacggcaacgccctgcagtgcagcaacagaaaggagctggtgaaccccaacttcaagggcctgagcgaggacttccacgccaaggacagcaagcccagcagcgaccccccctgcatcatcgagaagctgtgcagcctgcacgacggcctggtgctggaggccaagggcatcaaggagcacttctggaagccctacatcagaaagctgtacgagaagaagctgctgaagggcaaggaggagaacctgaccggcttcctggagcccggcaacttcggcgagagcttcaaggccatcaacaaggcctacgaggagtacgtgctgagcgtgggcaacctggacgagagaatcttcctgggcgaggacgccgaggaggagatcggcaccctgagcagatgcctgaacgccggcagcggcaccgagaccgccgagagagtgcagatgaagaacatcctgcagcagcacttcgacaagagcaaggccctgagaatcagcacccccctgaccggcgtgagatacatcaaggagaacagcccctgcgtgacccccgtgagcaccgccacccacagcctgagcagactgcacaccatgctgaccggcctgagaaacgcccccagcgagaagctggagcagatcctgagaacctgcagcagagaccccacccaggccatcgccaacagactgaaggagatgttcgagatctacagccagcacttccagcccgacgaggacttcagcaactgcgccaaggagatcgccagcaagcacttcagattcgccgagatgctgtactacaaggtgctggagagcgtgatcgagcaggagcagaagagactgggcgacatggacctgagcggcatcctggagcaggacgccttccacagaagcctgctggcctgctgcctggaggtggtgaccttcagctacaagccccccggcaacttccccttcatcaccgagatcttcgacgtgcccctgtaccacttctacaaggtgatcgaggtgttcatcagagccgaggacggcctgtgcagagaggtggtgaagcacctgaaccagatcgaggagcagatcctggaccacctggcctggaagcccgagagccccctgtgggagaagatcagagacaacgagaacagagtgcccacctgcgaggaggtgatgcccccccagaacctggagagagccgacgagatctgcatcgccggcagccccagaagaatccagctgagccagaaccaccccgtgtacatcagcccccacaagaacgagaccatgctgagccccagagagaagatcttctactacttcagcaacagccccagcaagagactgagagagatcaacagcatgatcagaaccggcgagacccccaccaagaagagaggcatcctgctggaggacggcagcgagagccccgccaagagaatctgccccgagaaccacagcgccctgctgagaagactgcaggacgtggccaacgacagaggcagccactag

SEQ ID NO: 12672 - DNA, 1347 bp, Artificial Sequence
  Description of Artificial Sequence: Synthetic coding sequence
atgttcgactgcatggacgtgctgagcgtgagccccggccagatcctggacttctacaccgccagccccagcagctgcatgctgcaggagaaggccctgaaggcctgcttcagcggcctgacccagaccgagtggcagcacagacacaccgcccagagcatcgagacccagagcaccagcagcgaggagctggtgcccagcccccccagccccctgcccccccccagagtgtacaagccctgcttcgtgtgccaggacaagagcagcggctaccactacggcgtgagcgcctgcgagggctgcaagggcttcttcagaagaagcatccagaagaacatgatctacacctgccacagagacaagaactgcgtgatcaacaaggtgaccagaaacagatgccagtactgcagactgcagaagtgcttcgaggtgggcatgagcaaggagagcgtgagaaacgacagaaacaagaagaagaaggagaccagcaagcaggagtgcaccgagagctacgagatgaccgccgagctggacgacctgaccgagaagatcagaaaggcccaccaggagaccttccccagcctgtgccagctgggcaagtacaccaccaacagcagcgccgaccacagagtgagactggacctgggcctgtgggacaagttcagcgagctggccaccaagtgcatcatcaagatcgtggagttcgccaagagactgcccggcttcaccggcctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcaccttcgccaaccagctgctgcccctggagatggacgacaccgagaccggcctgctgagcgccatctgcctgatctgcggcgacagacaggacctggaggagcccaccaaggtggacaagctgcaggagcccctgctggaggccctgaagatctacatcagaaagagaagacccagcaagccccacatgttccccaagatcctgatgaagatcaccgacctgagaagcatcagcgccaagggcgccgagagagtgatcaccctgaagatggagatccccggcagcatgccccccctgatccaggagatgctggagaacagcgagggccacgagcccctgacccccagcagcagcggcaacaccgccgagcacagccccagcatcagccccagcagcgtggagaacagcggcgtgagccagagccccctggtgcagtag

SEQ ID NO: 12673 - DNA, 1368 bp, Artificial Sequence
  Description of Artificial Sequence: Synthetic coding sequence
atgaccaccagcggccacgcctgccccgtgcccgccgtgaacggccacatgacccactaccccgccaccccctaccccctgctgttcccccccgtgatcggcggcctgagcctgccccccctgcacggcctgcacggccaccccccccccagcggctgcagcacccccagccccgccaccatcgagacccagagcaccagcagcgaggagctggtgcccagcccccccagccccctgcccccccccagagtgtacaagccctgcttcgtgtgccaggacaagagcagcggctaccactacggcgtgagcgcctgcgagggctgcaagggcttcttcagaagaagcatccagaagaacatgatctacacctgccacagagacaagaactgcgtgatcaacaaggtgaccagaaacagatgccagtactgcagactgcagaagtgcttcgaggtgggcatgagcaaggagagcgtgagaaacgacagaaacaagaagaagaaggagaccagcaagcaggagtgcaccgagagctacgagatgaccgccgagctggacgacctgaccgagaagatcagaaaggcccaccaggagaccttccccagcctgtgccagctgggcaagtacaccaccaacagcagcgccgaccacagagtgagactggacctgggcctgtgggacaagttcagcgagctggccaccaagtgcatcatcaagatcgtggagttcgccaagagactgcccggcttcaccggcctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcaccttcgccaaccagctgctgcccctggagatggacgacaccgagaccggcctgctgagcgccatctgcctgatctgcggcgacagacaggacctggaggagcccaccaaggtggacaagctgcaggagcccctgctggaggccctgaagatctacatcagaaagagaagacccagcaagccccacatgttccccaagatcctgatgaagatcaccgacctgagaagcatcagcgccaagggcgccgagagagtgatcaccctgaagatggagatccccggcagcatgccccccctgatccaggagatgctggagaacagcgagggccacgagcccctgacccccagcagcagcggcaacaccgccgagcacagccccagcatcagccccagcagcgtggagaacagcggcgtgagccagagccccctggtgcagtag

SEQ ID NO: 12674 - DNA, 1011 bp, Artificial Sequence
  Description of Artificial Sequence: Synthetic coding sequence
atgatctacacctgccacagagacaagaactgcgtgatcaacaaggtgaccagaaacagatgccagtactgcagactgcagaagtgcttcgaggtgggcatgagcaaggagagcgtgagaaacgacagaaacaagaagaagaaggagaccagcaagcaggagtgcaccgagagctacgagatgaccgccgagctggacgacctgaccgagaagatcagaaaggcccaccaggagaccttccccagcctgtgccagctgggcaagtacaccaccaacagcagcgccgaccacagagtgagactggacctgggcctgtgggacaagttcagcgagctggccaccaagtgcatcatcaagatcgtggagttcgccaagagactgcccggcttcaccggcctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcaccttcgccaaccagctgctgcccctggagatggacgacaccgagaccggcctgctgagcgccatctgcctgatctgcggcgacagacaggacctggaggagcccaccaaggtggacaagctgcaggagcccctgctggaggccctgaagatctacatcagaaagagaagacccagcaagccccacatgttccccaagatcctgatgaagatcaccgacctgagaagcatcagcgccaagggcgccgagagagtgatcaccctgaagatggagatccccggcagcatgccccccctgatccaggagatgctggagaacagcgagggccacgagcccctgacccccagcagcagcggcaacaccgccgagcacagccccagcatcagccccagcagcgtggagaacagcggcgtgagccagagccccctggtgcagtag

SEQ ID NO: 12675 - DNA, 1011 bp, Artificial Sequence; identical to SEQ ID NO: 12674
  Description of Artificial Sequence: Synthetic coding sequence

SEQ ID NO: 12676 - DNA, 1326 bp, Artificial Sequence
  Description of Artificial Sequence: Synthetic coding sequence
atgaccaccagcggccacgcctgccccgtgcccgccgtgaacggccacatgacccactaccccgccaccccctaccccctgctgttcccccccgtgatcggcggcctgagcctgccccccctgcacggcctgcacggccaccccccccccagcggctgcagcacccccagccccgccaccatcgagacccagagcaccagcagcgaggagctggtgcccagcccccccagccccctgcccccccccagagtgtacaagccctgcttcgtgtgccaggacaagagcagcggctaccactacggcgtgagcgcctgcgagggctgcaagggcttcttcagaagaagcatccagaagaacatgatctacacctgccacagagacaagaactgcgtgatcaacaaggtgaccagaaacagatgccagtactgcagactgcagaagtgcttcgaggtgggcatgagcaaggagagcgtgagaaacgacagaaacaagaagaagaaggagaccagcaagcaggagtgcaccgagagctacgagatgaccgccgagctggacgacctgaccgagaagatcagaaaggcccaccaggagaccttccccagcctgtgccagctgggcaagtacaccaccaacagcagcgccgaccacagagtgagactggacctgggcctgtgggacaagttcagcgagctggccaccaagtgcatcatcaagatcgtggagttcgccaagagactgcccggcttcaccggcctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcaccttcgccaaccagctgctgcccctggagatggacgacaccgagaccggcctgctgagcgccatctgcctgatctgcggcgacagacaggacctggaggagcccaccaaggtggacaagctgcaggagcccctgctggaggccctgaagatctacatcagaaagagaagacccagcaagccccacatgttccccaagatcctgatgaagatcaccgacctgagaagcatcagcgccaagggcgccgagagagtgatcaccctgaagatggagatccccgagggccacgagcccctgacccccagcagcagcggcaacaccgccgagcacagccccagcatcagccccagcagcgtggagaacagcggcgtgagccagagccccctggtgcagtag

SEQ ID NO: 12677 - DNA, 462 bp, Artificial Sequence
  Description of Artificial Sequence: Synthetic coding sequence
atggacccccccgccggcttcgtgagagccggcaaccccgccgtggccgccccccagagccccctgagccccgagggcgcccacttcagagccgcccaccaccccagaagcaccggcagcagatgccccggcagcctgcagcccagcagacccctggtggccaactggctgcagagcctgcccgagatgcccgtggacttcaccggctactggaagatgctggtgaacgagaacttcgaggagtacctgagagccctggacgtgaacgtggccctgagaaagatcgccaacctgctgaagcccgacaaggagatcgtgcaggacggcgaccacatgatcatcagaaccctgagcaccttcagaaactacatcatggacttccaggtgggcaaggagttcgaggaggacctgaccggcatcgacgacagaaagtgcatgagcgagaccggcttcagcagctag

SEQ ID NO: 12678 - DNA, 405 bp, Artificial Sequence
  Description of Artificial Sequence: Synthetic coding sequence
atgaccagagaccagaacggcacctgggagatggagagcaacgagaacttcgagggctacatgaaggccctggacatcgacttcgccaccagaaagatcgccgtgagactgacccagaccaaggtgatcgaccaggacggcgacaacttcaagaccaagaccaccagcaccttcagaaactacgacgtggacttcaccgtgggcgtggagttcgacgagtacaccaagagcctggacaacagacacgtgaaggccctggtgacctgggagggcgacgtgctggtgtgcgtgcagaagggcgagaaggagaacagaggctggaagcagtggatcgagggcgacaagctgtacctggagctgacctgcggcgaccaggtgtgcagacaggtgttcaagaagaagtag

SEQ ID NO: 12679 - DNA, 474 bp, Artificial Sequence
  Description of Artificial Sequence: Synthetic coding sequence
atggacccccccgccggcttcgtgagagccggcaaccccgccgtggccgccccccagagccccctgagccccgagggcgcccacttcagagccgcccaccaccccagaagcaccggcagcagatgccccggcagcctgcagcccagcagacccctggtggccaactggctgcagagcctgcccgagatgcccgtggacttcaccggctactggaagatgctggtgaacgagaacttcgaggagtacctgagagccctggacgtgaacgtggccctgagaaagatcgccaacctgctgaagcccgacaaggagatcgtgcaggacggcgaccacatgatcatcagaaccctgagcaccttcagaaactacatcatggacttccaggtgggcaaggagttcgaggaggacctgaccggcatcgacgacagaaagtgcatggccggcgtgcagagcagagacctgagcagcctgtag

SEQ ID NO: 12680 - DNA, 3756 bp, Artificial Sequence
  Description of Artificial Sequence: Synthetic coding sequence
atgagaagaggcggctggagaaagagagccgagaacgacggctgggagacctggggcggctacatggccgccaaggtgcagaagctggaggagcagttcagaagcgacgccgccatgcagaaggacggcaccagcagcaccatcttcagcggcgtggccatctacgtgaacggctacaccgaccccagcgccgaggagctgagaaagctgatgatgctgcacggcggccagtaccacgtgtactacagcagaagcaagaccacccacatcatcgccaccaacctgcccaacgccaagatcaaggagctgaagggcgagaaggtgatcagacccgagtggatcgtggagagcatcaaggccggcagactgctgagctacatcccctaccagctgtacaccaagcagagcagcgtgcagaagggcctgagcttcaaccccgtgtgcagacccgaggaccccctgcccggccccagcaacatcgccaagcagctgaacaacagagtgaaccacatcgtgaagaagatcgagaccgagaacgaggtgaaggtgaacggcatgaacagctggaacgaggaggacgagaacaacgacttcagcttcgtggacctggagcagaccagccccggcagaaagcagaacggcatcccccaccccagaggcagcaccgccatcttcaacggccacacccccagcagcaacggcgccctgaagacccaggactgcctggtgcccatggtgaacagcgtggccagcagactgagccccgccttcagccaggaggaggacaaggccgagaagagcagcaccgacttcagagactgcaccctgcagcagctgcagcagagcaccagaaacaccgacgccctgagaaacccccacagaaccaacagcttcagcctgagccccctgcacagcaacaccaagatcaacggcgcccaccacagcaccgtgcagggccccagcagcaccaagagcaccagcagcgtgagcaccttcagcaaggccgcccccagcgtgcccagcaagcccagcgactgcaacttcatcagcaacttctacagccacagcagactgcaccacatcagcatgtggaagtgcgagctgaccgagttcgtgaacaccctgcagagacagagcaacggcatcttccccggcagagagaagctgaagaagatgaagaccggcagaagcgccctggtggtgaccgacaccggcgacatgagcgtgctgaacagccccagacaccagagctgcatcatgcacgtggacatggactgcttcttcgtgagcgtgggcatcagaaacagacccgacctgaagggcaagcccgtggccgtgaccagcaacagaggcaccggcagagcccccctgagacccggcgccaacccccagctggagtggcagtactaccagaacaagatcctgaagggcaaggccgccgacatccccgacagcagcctgtgggagaaccccgacagcgcccaggccaacggcatcgacagcgtgctgagcagagccgagatcgccagctgcagctacgaggccagacagctgggcatcaagaacggcatgttcttcggccacgccaagcagctgtgccccaacctgcaggccgtgccctacgacttccacgcctacaaggaggtggcccagaccctgtacgagaccctggccagctacacccacaacatcgaggccgtgagctgcgacgaggccctggtggacatcaccgagatcctggccgagaccaagctgacccccgacgagttcgccaacgccgtgagaatggagatcaaggaccagaccaagtgcgccgccagcgtgggcatcggcagcaacatcctgctggccagaatggccaccagaaaggccaagcccgacggccagtaccacctgaagcccgaggaggtggacgacttcatcagaggccagctggtgaccaacctgcccggcgtgggccacagcatggagagcaagctggccagcctgggcatcaagacctgcggcgacctgcagtacatgaccatggccaagctgcagaaggagttcggccccaagaccggccagatgctgtacagattctgcagaggcctggacgacagacccgtgagaaccgagaaggagagaaagagcgtgagcgccgagatcaactacggcatcagattcacccagcccaaggaggccgaggccttcctgctgagcctgagcgaggagatccagagaagactggaggccaccggcatgaagggcaagagactgaccctgaagatcatggtgagaaagcccggcgcccccgtggagaccgccaagttcggcggccacggcatctgcgacaacatcgccagaaccgtgaccctggaccaggccaccgacaacgccaagatcatcggcaaggccatgctgaacatgttccacaccatgaagctgaacatcagcgacatgagaggcgtgggcatccacgtgaaccagctggtgcccaccaacctgaaccccagcacctgccccagcagacccagcgtgcagagcagccacttccccagcggcagctacagcgtgagagacgtgttccaggtgcagaaggccaagaagagcaccgaggaggagcacaaggaggtgttcagagccgccgtggacctggagatcagcagcgccagcagaacctgcaccttcctgccccccttccccgcccacctgcccaccagccccgacaccaacaaggccgagagcagcggcaagtggaacggcctgcacacccccgtgagcgtgcagagcagactgaacctgagcatcgaggtgcccagccccagccagctggaccagagcgtgctggaggccctgccccccgacctgagagagcaggtggagcaggtgtgcgccgtgcagcaggccgagagccacggcgacaagaagaaggagcccgtgaacggctgcaacaccggcatcctgccccagcccgtgggcaccgtgctgctgcagatccccgagccccaggagagcaacagcgacgccggcatcaacctgatcgccctgcccgccttcagccaggtggaccccgaggtgttcgccgccctgcccgccgagctgcagagagagctgaaggccgcctacgaccagagacagagacagggcgagaacagcacccaccagcagagcgccagcgccagcgtgcccaagaaccccctgctgcacctgaaggccgccgtgaaggagaagaagagaaacaagaagaagaagaccatcggcagccccaagagaatccagagccccctgaacaacaagctgctgaacagccccgccaagaccctgcccggcgcctgcggcagcccccagaagctgatcgacggcttcctgaagcacgagggcccccccgccgagaagcccctggaggagctgagcgccagcaccagcggcgtgcccggcctgagcagcctgcagagcgaccccgccggctgcgtgagaccccccgcccccaacctggccggcgccgtggagttcaacgacgtgaagaccctgctgagagagtggatcaccaccatcagcgaccccatggaggaggacatcctgcaggtggtgaagtactgcaccgacctgatcgaggagaaggacctggagaagctggacctggtgatcaagtacatgaagagactgatgcagcagagcgtggagagcgtgtggaacatggccttcgacttcatcctggacaacgtgcaggtggtgctgcagcagacctacggcagcaccctgaaggtgacctag

SEQ ID NO: 12681 - DNA, 3753 bp, Artificial Sequence
  Description of Artificial Sequence: Synthetic coding sequence
atgagaagaggcggctggagaaagagagccgagaacgacggctgggagacctggggcggctacatggccgccaaggtgcagaagctggaggagcagttcagaagcgacgccgccatgcagaaggacggcaccagcagcaccatcttcagcggcgtggccatctacgtgaacggctacaccgaccccagcgccgaggagctgagaaagctgatgatgctgcacggcggccagtaccacgtgtactacagcagaagcaagaccacccacatcatcgccaccaacctgcccaacgccaagatcaaggagctgaagggcgagaaggtgatcagacccgagtggatcgtggagagcatcaaggccggcagactgctgagctacatcccctaccagctgtacaccaagcagagcagcgtgcagaagggcctgagcttcaaccccgtgtgcagacccgaggaccccctgcccggccccagcaacatcgccaagcagctgaacaacagagtgaaccacatcgtgaagaagatcgagaccgagaacgaggtgaaggtgaacggcatgaacagctggaacgaggaggacgagaacaacgacttcagcttcgtggacctggagcagaccagccccggcagaaagcagaacggcatcccccaccccagaggcagcaccgccatcttcaacggccacacccccagcagcaacggcgccctgaagacccaggactgcctggtgcccatggtgaacagcgtggccagcagactgagccccgccttcagccaggaggaggacaaggccgagaagagcagcaccgacttcagagactgcaccctgcagcagctgcagcagagcaccagaaacaccgacgccctgagaaacccccacagaaccaacagcttcagcctgagccccctgcacagcaacaccaagatcaacggcgcccaccacagcaccgtgcagggccccagcagcaccaagagcaccagcagcgtgagcaccttcagcaaggccgcccccagcgtgcccagcaagcccagcgactgcaacttcatcagcaacttctacagccacagcagactgcaccacatcagcatgtggaagtgcgagctgaccgagttcgtgaacaccctgcagagacagagcaacggcatcttccccggcagagagaagctgaagaagatgaagaccggcagaagcgccctggtggtgaccgacaccggcgacatgagcgtgctgaacagccccagacaccagagctgcatcatgcacgtggacatggactgcttcttcgtgagcgtgggcatcagaaacagacccgacctgaagggcaagcccgtggccgtgaccagcaacagaggcaccggcagagcccccctgagacccggcgccaacccccagctggagtggcagtactaccagaacaagatcctgaagggcaaggccgacatccccgacagcagcctgtgggagaaccccgacagcgcccaggccaacggcatcgacagcgtgctgagcagagccgagatcgccagctgcagctacgaggccagacagctgggcatcaagaacggcatgttcttcggccacgccaagcagctgtgccccaacctgcaggccgtgccctacgacttccacgcctacaaggaggtggcccagaccctgtacgagaccctggccagctacacccacaacatcgaggccgtgagctgcgacgaggccctggtggacatcaccgagatcctggccgagaccaagctgacccccgacgagttcgccaacgccgtgagaatggagatcaaggaccagaccaagtgcgccgccagcgtgggcatcggcagcaacatcctgctggccagaatggccaccagaaaggccaagcccgacggccagtaccacctgaagcccgaggaggtggacgacttcatcagaggccagctggtgaccaacctgcccggcgtgggccacagcatggagagcaagctggccagcctgggcatcaagacctgcggcgacctgcagtacatgaccatggccaagctgcagaaggagttcggccccaagaccggccagatgctgtacagattctgcagaggcctggacgacagacccgtgagaaccgagaaggagagaaagagcgtgagcgccgagatcaactacggcatcagattcacccagcccaaggaggccgaggccttcctgctgagcctgagcgaggagatccagagaagactggaggccaccggcatgaagggcaagagactgaccctgaagatcatggtgagaaagcccggcgcccccgtggagaccgccaagttcggcggccacggcatctgcgacaacatcgccagaaccgtgaccctggaccaggccaccgacaacgccaagatcatcggcaaggccatgctgaacatgttccacaccatgaagctgaacatcagcgacatgagaggcgtgggcatccacgtgaaccagctggtgcccaccaacctgaaccccagcacctgccccagcagacccagcgtgcagagcagccacttccccagcggcagctacagcgtgagagacgtgttccaggtgcagaaggccaagaagagcaccgaggaggagcacaaggaggtgttcagagccgccgtggacctggagatcagcagcgccagcagaacctgcaccttcctgccccccttccccgcccacctgcccaccagccccgacaccaacaaggccgagagcagcggcaagtggaacggcctgcacacccccgtgagcgtgcagagcagactgaacctgagcatcgaggtgcccagccccagccagctggaccagagcgtgctggaggccctgccccccgacctgagagagcaggtggagcaggtgtgcgccgtgcagcaggccgagagccacggcgacaagaagaaggagcccgtgaacggctgcaacaccggcatcctgccccagcccgtgggcaccgtgctgctgcagatccccgagccccaggagagcaacagcgacgccggcatcaacctgatcgccctgcccgccttcagccaggtggaccccgaggtgttcgccgccctgcccgccgagctgcagagagagctgaaggccgcctacgaccagagacagagacagggcgagaacagcacccaccagcagagcgccagcgccagcgtgcccaagaaccccctgctgcacctgaaggccgccgtgaaggagaagaagagaaacaagaagaagaagaccatcggcagccccaagagaatccagagccccctgaacaacaagctgctgaacagccccgccaagaccctgcccggcgcctgcggcagcccccagaagctgatcgacggcttcctgaagcacgagggcccccccgccgagaagcccctggaggagctgagcgccagcaccagcggcgtgcccggcctgagcagcctgcagagcgaccccgccggctgcgtgagaccccccgcccccaacctggccggcgccgtggagttcaacgacgtgaagaccctgctgagagagtggatcaccaccatcagcgaccccatggaggaggacatcctgcaggtggtgaagtactgcaccgacctgatcgaggagaaggacctggagaagctggacctggtgatcaagtacatgaagagactgatgcagcagagcgtggagagcgtgtggaacatggccttcgacttcatcctggacaacgtgcaggtggtgctgcagcagacctacggcagcaccctgaaggtgacctag

SEQ ID NO: 12682 - DNA, 2916 bp, Artificial Sequence
  Description of Artificial Sequence: Synthetic coding sequence
atggccaccgtgagagccagcctgagaggcgccctgctgctgctgctggccgtggccggcgtggccgaggtggccggcggcctggcccccggcagcgccggcgccctgtgctgcaaccacagcaaggacaaccagatgtgcagagacgtgtgcgagcagatcttcagcagcaagagcgagagcagactgaagcacctgctgcagagagcccccgactactgccccgagaccatggtggagatctggaactgcatgaacagcagcctgcccggcgtgttcaagaagagcgacggctgggtgggcctgggctgctgcgagctggccatcgccctggagtgcagacaggcctgcaagcaggccagcagcaagaacgacatcagcaaggtgtgcagaaaggagtacgagaacgccctgttcagctgcatcagcagaaacgagatgggcagcgtgtgctgcagctacgccggccaccacaccaactgcagagagtactgccaggccatcttcagaaccgacagcagccccggccccagccagatcaaggccgtggagaactactgcgccagcatcagcccccagctgatccactgcgtgaacaactacacccagagctaccccatgagaaaccccaccgacagcctgtactgctgcgacagagccgaggaccacgcctgccagaacgcctgcaagagaatcctgatgagcaagaagaccgagatggagatcgtggacggcctgatcgagggctgcaagacccagcccctgccccaggaccccctgtggcagtgcttcctggagagcagccagagcgtgcaccccggcgtgaccgtgcaccccccccccagcaccggcctggacggcgccaagctgcactgctgcagcaaggccaacaccagcacctgcagagagctgtgcaccaagctgtacagcatgagctggggcaacacccagagctggcaggagttcgacagattctgcgagtacaaccccgtggaggtgagcatgctgacctgcctggccgacgtgagagagccctgccagctgggctgcagaaacctgacctactgcaccaacttcaacaacagacccaccgagctgttcagaagctgcaacgcccagagcgaccagggcgccatgaacgacatgaagctgtgggagaagggcagcatcaagatgcccttcatcaacatccccgtgctggacatcaagaagtgccagcccgagatgtggaaggccatcgcctgcagcctgcagatcaagccctgccacagcaagagcagaggcagcatcatctgcaagagcgactgcgtggagatcctgaagaagtgcggcgaccagaacaagttccccgaggaccacaccgccgagagcatctgcgagctgctgagccccaccgacgacctgaagaactgcatccccctggacacctacctgagacccagcaccctgggcaacatcgtggaggaggtgacccacccctgcaaccccaacccctgccccgccaacgagctgtgcgaggtgaacagaaagggctgccccagcggcgacccctgcctgccctacttctgcgtgcagggctgcaagctgggcgaggccagcgacttcatcgtgagacagggcaccctgatccaggtgcccagcagcgccggcgaggtgggctgctacaagatctgcagctgcggccagagcggcctgctggagaactgcatggagatgcactgcatcgacctgcagaagagctgcatcgtgggcggcaagagaaagagccacggcaccagcttcagcatcgactgcaacgtgtgcagctgcttcgccggcaacctggtgtgcagcaccagactgtgcctgagcgagcacagcagcgaggacgacagaagaaccttcaccggcctgccctgcaactgcgccgaccagttcgtgcccgtgtgcggccagaacggcagaacctaccccagcgcctgcatcgccagatgcgtgggcctgcaggaccaccagttcgagttcggcagctgcatgagcaaggacccctgcaaccccaacccctgccagaagaaccagagatgcatccccaagccccaggtgtgcctgaccaccttcgacaagttcggctgcagccagtacgagtgcgtgcccagacagctggcctgcgaccaggtgcaggaccccgtgtgcgacaccgaccacatggagcacaacaacctgtgcaccctgtaccagagaggcaagagcctgagctacaagggcccctgccagcccttctgcagagccaccgagcccgtgtgcggccacaacggcgagacctacagcagcgtgtgcgccgcctacagcgacagagtggccgtggactactacggcgactgccaggccgtgggcgtgctgagcgagcacagcagcgtggccgagtgcgccagcgtgaagtgccccagcctgctggccgccggctgcaagcccatcatcccccccggcgcctgctgccccctgtgcgccggcatgctgagagtgctgttcgacaaggagaagctggacaccatcgccaaggtgaccaacaagaagcccatcaccgtgctggagatcctgcagaagatcagaatgcacgtgagcgtgccccagtgcgacgtgttcggctacttcagcatcgagagcgagatcgtgatcctgatcatccccgtggaccactaccccaaggccctgcagatcgaggcctgcaacaaggaggccgagaagatcgagagcctgatcaacagcgacagccccaccctggccagccacgtgcccctgagcgccctgatcatcagccaggtgcaggtgagcagcagcgtgcccagcgccggcgtgagagccagacccagctgccacagcctgctgctgcccctgagcctgggcctggccctgcacctgctgtggacctacaactag

SEQ ID NO: 12683 - DNA, 735 bp, Artificial Sequence
  Description of Artificial Sequence: Synthetic coding sequence
atgaaggagagaagagccagccagaagctgagcagcaagagcatcatggaccccaaccagaacgtgaagtgcaagatcgtggtggtgggcgacagccagtgcggcaagaccgccctgctgcacgtgttcgccaaggactgcttccccgagaactacgtgcccaccgtgttcgagaactacaccgccagcttcgagatcgacacccagagaatcgagctgagcctgtgggacaccagcggcagcccctactacgacaacgtgagacccctgagctaccccgacagcgacgccgtgctgatctgcttcgacatcagcagacccgagaccctggacagcgtgctgaagaagtggaagggcgagatccaggagttctgccccaacaccaagatgctgctggtgggctgcaagagcgacctgagaaccgacgtgagcaccctggtggagctgagcaaccacagacagacccccgtgagctacgaccagggcgccaacatggccaagcagatcggcgccgccacctacatcgagtgcagcgccctgcagagcgagaacagcgtgagagacatcttccacgtggccaccctggcctgcgtgaacaagaccaacaagaacgtgaagagaaacaagagccagagagccaccaagagaatcagccacatgcccagcagacccgagctgagcgccgtggccaccgacctgagaaaggacaaggccaagagctgcaccgtgatgtag

SEQ ID NO: 12684 - DNA, 735 bp, Artificial Sequence; identical to SEQ ID NO: 12683
  Description of Artificial Sequence: Synthetic coding sequence

SEQ ID NO: 12685 - DNA, 348 bp, Artificial Sequence
  Description of Artificial Sequence: Synthetic coding sequence
atgctgctggtgggctgcaagagcgacctgagaaccgacgtgagcaccctggtggagctgagcaaccacagacagacccccgtgagctacgaccagggcgccaacatggccaagcagatcggcgccgccacctacatcgagtgcagcgccctgcagagcgagaacagcgtgagagacatcttccacgtggccaccctggcctgcgtgaacaagaccaacaagaacgtgaagagaaacaagagccagagagccaccaagagaatcagccacatgcccagcagacccgagctgagcgccgtggccaccgacctgagaaaggacaaggccaagagctgcaccgtgatgtag

SEQ ID NO: 12686 - DNA, 351 bp, Artificial Sequence
  Description of Artificial Sequence: Synthetic coding sequence
atgaaggagagaagagccagccagaagctgagcagcaagagcatcatggaccccaaccagaacgtgaagtgcaagatcgtggtggtgggcgacagccagtgcggcaagaccgccctgctgcacgtgttcgccaaggactgcttccccgagaactacgtgcccaccgtgttcgagaactacaccgccagcttcgagatcgacacccagagaatcgagctgagcctgtgggacaccagcggcagcccctactacgacaacgtgagacccctgagctaccccgacagcgacgccgtgctgatctgcttcgacatcagcagacccgagaccctggacagcgtgctgaagaagtag

SEQ ID NO: 12687 - DNA, 351 bp, Artificial Sequence; identical to SEQ ID NO: 12686
  Description of Artificial Sequence: Synthetic coding sequence

SEQ ID NO: 12688 - DNA, 615 bp, Artificial Sequence
  Description of Artificial Sequence: Synthetic coding sequence
atggccgagcaggagcccaccgccgagcagctggcccagatcgccgccgagaacgaggaggacgagcacagcgtgaactacaagccccccgcccagaagagcatccaggagatccaggagctggacaaggacgacgagagcctgagaaagtacaaggaggccctgctgggcagagtggccgtgagcgccgaccccaacgtgcccaacgtggtggtgaccggcctgaccctggtgtgcagcagcgcccccggccccctggagctggacctgaccggcgacctggagagcttcaagaagcagagcttcgtgctgaaggagggcgtggagtacagaatcaagatcagcttcagagtgaacagagagatcgtgagcggcatgaagtacatccagcacacctacagaaagggcgtgaagatcgacaagaccgactacatggtgggcagctacggccccagagccgaggagtacgagttcctgacccccgtggaggaggcccccaagggcatgctggccagaggcagctacagcatcaagagcagattcaccgacgacgacaagaccgaccacctgagctgggagtggaacctgaccatcaagaaggactggaaggactag

SEQ ID NO: 12689 - DNA, 537 bp, Artificial Sequence
  Description of Artificial Sequence: Synthetic coding sequence
atggccgagcaggagcccaccgccgagcagctggcccagatcgccgccgagaacgaggaggacgagcacagcgtgaactacaagccccccgcccagaagagcatccaggagatccaggagctggacaaggacgacgagagcctgagaaagtacaaggaggccctgctgggcagagtggccgtgagcgccgaccccaacgtgcccaacgtggtggtgaccggcctgaccctggtgtgcagcagcgcccccggccccctggagctggacctgaccggcgacctggagagcttcaagaagcagagcttcgtgctgaaggagggcgtggagtacagaatcaagatcagcttcagagtgaacagagagatcgtgagcggcatgaagtacatccagcacacctacagaaagggcgtgaagatcgacaagaccgactacatggtgggcagctacagcatcaagagcagattcaccgacgacgacaagaccgaccacctgagctgggagtggaacctgaccatcaagaaggactggaaggactag

SEQ ID NO: 12690 - DNA, 615 bp, Artificial Sequence; identical to SEQ ID NO: 12688
  Description of Artificial Sequence: Synthetic coding sequence

SEQ ID NO: 12691 - DNA, 3576 bp, Artificial Sequence
  Description of Artificial Sequence: Synthetic coding sequence
atggaggccatgagcccccagcaggagaccctgggcggccagcccggcagaagcagcagcctgaccggcgtgagcagactggccggcggcagctgcaccaagaagaagatgaagaccctggccgagagaagaagaagcgcccccagcctgatcctggacaaggccctgcagaagagacccaccaccagagacagccccagcgccagcgtggacacctgcaccttcctgagcagcctggtgtgcagcaacagaaccctgctgatcgacggcagagccgagctgaagagaggcctgcagagacaggagagacacctgttcctgttcaacgacctgttcgtggtggccaagatcaagtacaacaacaacttcaagatcaagaacaagatcaagctgaccgacatgtggaccgccagctgcgtggacgaggtgggcgagggcaacaccaacgccatgaagagcttcgtgctgggctggcccaccgtgaacttcgtggccaccttcagcagccccgagcagaaggacaagtggctgagcctgctgcagagatacatcaacctggagaaggagaaggactaccccaagagcatccccctgaagatcttcgccaaggacatcggcaactgcgcctacagcaagaccatcaccgtgatgaacagcgacaccgccaacgaggtgatcaacatgagcctgcccatgctgggcatcaccggcagcgagagagactaccagctgtgggtgaacagcggcaaggaggaggccccctaccccctgatcggccacgagtacccctacggcatcaagatgagccacctgagagacagcgccctgctgacccccggcagcaaggacagcaccacccccttcaacctgcaggagcccttcctgatggagcagctgcccagagagatgcagtgccagttcatcctgaagcccagcagactggccgccgcccagcagctgagcgacagcggccacaagaccttcaagagaagaagaagcatcatcaactgggccttctggagaggcagcagcacccacctggacaacctgcccagcagccccaccagccccatgcccggccagctgttcggcatcagcctgcccaacatctgcgagaacgacaacctgcccaagcccgtgctggacatgctgttcttcctgaaccagaagggccccctgaccaagggcatcttcagacagagcgccaacgtgaagagctgcagagagctgaaggagaagctgaacagcggcgtggaggtgcacctggactgcgagagcatcttcgtgatcgccagcgtgctgaaggacttcctgagaaacatccccggcagcatcttcagcagcgacctgtacgaccactgggtgagcgtgatggaccagggcaacgacgaggagaagatcaacaccgtgcagagactgctggaccagctgcccagagccaacgtggtgctgctgagatacctgttcggcgtgctgcacaacatcgagcagcacagcagcagcaaccagatgaccgccttcaacctggccgtgtgcgtggcccccagcatcctgtggccccccgccagcagcagccccgagctggagaacgagttcaccaagaaggtgagcctgctgatccagttcctgatcgagaactgcctgagaatcttcggcgaggagatcaccagcctgttcagagaggtgagcgtgagatgcgacaccagagagaacgccagcgacatcagctgcttccagctgaacgacagcagctacgacagcctggagaacgagctgaacgaggacgtggacgccccctgcagcgacctggtgaagaagctgggccagggcagcagaagcatggacagcgtgctgaccctgagcgactacgacctggaccagcccgaggtggagggcctgctgaccctgagcgacttcgacctggcccacagcaaggacgaggacgtgcagatgaagagacccctggagagcaagcccgtgaacatcctggtgtacaccaagatccccctgagagaccacgccagagcccccagcgccatgtgcacccccagctacctgagcaccgccgccgccaacgccgccaagagcctgagaagacacagaagatgcagcgagcccagcatcgactacctggacagcaagctgagctacctgagagagttctaccagaagaagctgagaaagagcagctgcgacgccatcctgagccagaaggacgaggactacctgaagcagaaccagcccctgcaggaggagggcaagacctgcttcaagcagagcctggtgaccggcaccgacgtgagcaagaagaacgccaccacccagaacaccaagaagaagagcctgagcggcagcgagggcaaccacgtgaagctgttccccaagagcaagcccgtggccatcagcgtggccagctacagccccatgagcagccaggaccacagcaagaaccagcccttcgacgtgaacaccagcggctacagccccccccacaccgccgacgccctgaagggccccagaacccacagaagatgcagcgagcccaacatcgaggaccagaacagaaagctgacctacctgagaggcatctacagcaagaagcagcacaagaccagctgcgaggccggcctgctgcacggcgaggaggactacctgaagagacacaagagcctgcagatggagggccagaagctgatcaaccagagcctggtgatgggcatcgaggtgggcaagagcagcgccaccaaccagaacaccgagaaggtgctgccccccagactgaacctgtgccccagaaccagctacagcagcctgagcagccccggcaccagccccagcggcagcagcgtgagcagccaggacagcgccttcagccagatcagcgagcacagcgtgttcacccccaccgagaccagcagccccatcgactgcaccttccaggcccagagaaagagagaggacctgagccccgacttcagcaacgccagccacgtgagcggcatgcccggccccagcagcggccaggcctgcagcagacccgcctacaccaagaaggacaccatggagtggcacagccagatgcacagcgtgaccctgcaccccagcacctggctgagaaacggcgtggccagcctgaagaactggagcctgaagaagaaggccaaggccgccagacccgaggaggagaagatcgccagccccaagggccccctggagccccccccccacgccagcggcgtgcccgaggccaacagcctgcaggaggagcagaaggacctgcccctgagagccgccgagggcctgagccccgtgcagagcgcccagagatgcagcagcagccccttccaggacagcgagagacactgcagcagccccttcagcctggtggagagcagactgaagctgtgcatgaagagccacgaggagatcgagcccggcagccagagcagcagcggcagcctgccctgggagagagccagcgccagcagctggaccctggaggacgccaccagccccgacagcggccccaccgtggtgtgcgacatcgaggacagatacctgaccaaggacatctag

SEQ ID NO: 12692 - DNA, 3498 bp, Artificial Sequence
  Description of Artificial Sequence: Synthetic coding sequence
atgaccttctggatcatcatcaacaagaagatgaagaccctggccgagagaagaagaagcgcccccagcctgatcctggacaaggccctgcagaagagacccaccaccagagacagccccagcgccagcgtggacacctgcaccttcctgagcagcctggtgtgcagcaacagaaccctgctgatcgacggcagagccgagctgaagagaggcctgcagagacaggagagacacctgttcctgttcaacgacctgttcgtggtggccaagatcaagtacaacaacaacttcaagatcaagaacaagatcaagctgaccgacatgtggaccgccagctgcgtggacgaggtgggcgagggcaacaccaacgccatgaagagcttcgtgctgggctggcccaccgtgaacttcgtggccaccttcagcagccccgagcagaaggacaagtggctgagcctgctgcagagatacatcaacctggagaaggagaaggactaccccaagagcatccccctgaagatcttcgccaaggacatcggcaactgcgcctacagcaagaccatcaccgtgatgaacagcgacaccgccaacgaggtgatcaacatgagcctgcccatgctgggcatcaccggcagcgagagagactaccagctgtgggtgaacagcggcaaggaggaggccccctaccccctgatcggccacgagtacccctacggcatcaagatgagccacctgagagacagcgccctgctgacccccggcagcaaggacagcaccacccccttcaacctgcaggagcccttcctgatggagcagctgcccagagagatgcagtgccagttcatcctgaagcccagcagactggccgccgcccagcagctgagcgacagcggccacaagaccttcaagagaagaagaagcatcatcaactgggccttctggagaggcagcagcacccacctggacaacctgcccagcagccccaccagccccatgcccggccagctgttcggcatcagcctgcccaacatctgcgagaacgacaacctgcccaagcccgtgctggacatgctgttcttcctgaaccagaagggccccctgaccaagggcatcttcagacagagcgccaacgtgaagagctgcagagagctgaaggagaagctgaacagcggcgtggaggtgcacctggactgcgagagcatcttcgtgatcgccagcgtgctgaaggacttcctgagaaacatccccggcagcatcttcagcagcgacctgtacgaccactgggtgagcgtgatggaccagggcaacgacgaggagaagatcaacaccgtgcagagactgctggaccagctgcccagagccaacgtggtgctgctgagatacctgttcggcgtgctgcacaacatcgagcagcacagcagcagcaaccagatgaccgccttcaacctggccgtgtgcgtggcccccagcatcctgtggccccccgccagcagcagccccgagctggagaacgagttcaccaagaaggtgagcctgctgatccagttcctgatcgagaactgcctgagaatcttcggcgaggagatcaccagcctgttcagagaggtgagcgtgagatgcgacaccagagagaacgccagcgacatcagctgcttccagctgaacgacagcagctacgacagcctggagaacgagctgaacgaggacgtggacgccccctgcagcgacctggtgaagaagctgggccagggcagcagaagcatggacagcgtgctgaccctgagcgactacgacctggaccagcccgaggtggagggcctgctgaccctgagcgacttcgacctggcccacagcaaggacgaggacgtgcagatgaagagacccctggagagcaagcccgtgaacatcctggtgtacaccaagatccccctgagagaccacgccagagcccccagcgccatgtgcacccccagctacctgagcaccgccgccgccaacgccgccaagagcctgagaagacacagaagatgcagcgagcccagcatcgactacctggacagcaagctgagctacctgagagagttctaccagaagaagctgagaaagagcagctgcgacgccatcctgagccagaaggacgaggactacctgaagcagaaccagcccctgcaggaggagggcaagacctgcttcaagcagagcctggtgaccggcaccgacgtgagcaagaagaacgccaccacccagaacaccaagaagaagagcctgagcggcagcgagggcaaccacgtgaagctgttccccaagagcaagcccgtggccatcagcgtggccagctacagccccatgagcagccaggaccacagcaagaaccagcccttcgacgtgaacaccagcggctacagccccccccacaccgccgacgccctgaagggccccagaacccacagaagatgcagcgagcccaacatcgaggaccagaacagaaagctgacctacctgagaggcatctacagcaagaagcagcacaagaccagctgcgaggccggcctgctgcacggcgaggaggactacctgaagagacacaagagcctgcagatggagggccagaagctgatcaaccagagcctggtgatgggcatcgaggtgggcaagagcagcgccaccaaccagaacaccgagaaggtgctgccccccagactgaacctgtgccccagaaccagctacagcagcctgagcagccccggcaccagccccagcggcagcagcgtgagcagccaggacagcgccttcagccagatcagcgagcacagcgtgttcacccccaccgagaccagcagccccatcgactgcaccttccaggcccagagaaagagagaggacctgagccccgacttcagcaacgccagccacgtgagcggcatgcccggccccagcagcggccaggcctgcagcagacccgcctacaccaagaaggacaccatggagtggcacagccagatgcacagcgtgaccctgcaccccagcacctggctgagaaacggcgtggccagcctgaagaactggagcctgaagaagaaggccaaggccgccagacccgaggaggagaagatcgccagccccaagggccccctggagccccccccccacgccagcggcgtgcccgaggccaacagcctgcaggaggagcagaaggacctgcccctgagagccgccgagggcctgagccccgtgcagagcgcccagagatgcagcagcagccccttccaggacagcgagagacactgcagcagccccttcagcctggtggagagcagactgaagctgtgcatgaagagccacgaggagatcgagcccggcagccagagcagcagcggcagcctgccctgggagagagccagcgccagcagctggaccctggaggacgccaccagccccgacagcggccccaccgtggtgtgcgacatcgaggacagatacctgaccaaggacatctag

SEQ ID NO: 12693 - DNA, 3507 bp, Artificial Sequence
  Description of Artificial Sequence: Synthetic coding sequence
atgagcgccagagagagacagcccgccctgaagaagaagatgaagaccctggccgagagaagaagaagcgcccccagcctgatcctggacaaggccctgcagaagagacccaccaccagagacagccccagcgccagcgtggacacctgcaccttcctgagcagcctggtgtgcagcaacagaaccctgctgatcgacggcagagccgagctgaagagaggcctgcagagacaggagagacacctgttcctgttcaacgacctgttcgtggtggccaagatcaagtacaacaacaacttcaagatcaagaacaagatcaagctgaccgacatgtggaccgccagctgcgtggacgaggtgggcgagggcaacaccaacgccatgaagagcttcgtgctgggctggcccaccgtgaacttcgtggccaccttcagcagccccgagcagaaggacaagtggctgagcctgctgcagagatacatcaacctggagaaggagaaggactaccccaagagcatccccctgaagatcttcgccaaggacatcggcaactgcgcctacagcaagaccatcaccgtgatgaacagcgacaccgccaacgaggtgatcaacatgagcctgcccatgctgggcatcaccggcagcgagagagactaccagctgtgggtgaacagcggcaaggaggaggccccctaccccctgatcggccacgagtacccctacggcatcaagatgagccacctgagagacagcgccctgctgacccccggcagcaaggacagcaccacccccttcaacctgcaggagcccttcctgatggagcagctgcccagagagatgcagtgccagttcatcctgaagcccagcagactggccgccgcccagcagctgagcgacagcggccacaagaccttcaagagaagaagaagcatcatcaactgggccttctggagaggcagcagcacccacctggacaacctgcccagcagccccaccagccccatgcccggccagctgttcggcatcagcctgcccaacatctgcgagaacgacaacctgcccaagcccgtgctggacatgctgttcttcctgaaccagaagggccccctgaccaagggcatcttcagacagagcgccaacgtgaagagctgcagagagctgaaggagaagctgaacagcggcgtggaggtgcacctggactgcgagagcatcttcgtgatcgccagcgtgctgaaggacttcctgagaaacatccccggcagcatcttcagcagcgacctgtacgaccactgggtgagcgtgatggaccagggcaacgacgaggagaagatcaacaccgtgcagagactgctggaccagctgcccagagccaacgtggtgctgctgagatacctgttcggcgtgctgcacaacatcgagcagcacagcagcagcaaccagatgaccgccttcaacctggccgtgtgcgtggcccccagcatcctgtggccccccgccagcagcagccccgagctggagaacgagttcaccaagaaggtgagcctgctgatccagttcctgatcgagaactgcctgagaatcttcggcgaggagatcaccagcctgttcagagaggtgagcgtgagatgcgacaccagagagaacgccagcgacatcagctgcttccagctgaacgacagcagctacgacagcctggagaacgagctgaacgaggacgtggacgccccctgcagcgacctggtgaagaagctgggccagggcagcagaagcatggacagcgtgctgaccctgagcgactacgacctggaccagcccgaggtggagggcctgctgaccctgagcgacttcgacctggcccacagcaaggacgaggacgtgcagatgaagagacccctggagagcaagcccgtgaacatcctggtgtacaccaagatccccctgagagaccacgccagagcccccagcgccatgtgcacccccagctacctgagcaccgccgccgccaacgccgccaagagcctgagaagacacagaagatgcagcgagcccagcatcgactacctggacagcaagctgagctacctgagagagttctaccagaagaagctgagaaagagcagctgcgacgccatcctgagccagaaggacgaggactacctgaagcagaaccagcccctgcaggaggagggcaagacctgcttcaagcagagcctggtgaccggcaccgacgtgagcaagaagaacgccaccacccagaacaccaagaagaagagcctgagcggcagcgagggcaaccacgtgaagctgttccccaagagcaagcccgtggccatcagcgtggccagctacagccccatgagcagccaggaccacagcaagaaccagcccttcgacgtgaacaccagcggctacagccccccccacaccgccgacgccctgaagggccccagaacccacagaagatgcagcgagcccaacatcgaggaccagaacagaaagctgacctacctgagaggcatctacagcaagaagcagcacaagaccagctgcgaggccggcctgctgcacggcgaggaggactacctgaagagacacaagagcctgcagatggagggccagaagctgatcaaccagagcctggtgatgggcatcgaggtgggcaagagcagcgccaccaaccagaacaccgagaaggtgctgccccccagactgaacctgtgccccagaaccagctacagcagcctgagcagccccggcaccagccccagcggcagcagcgtgagcagccaggacagcgccttcagccagatcagcgagcacagcgtgttcacccccaccgagaccagcagccccatcgactgcaccttccaggcccagagaaagagagaggacctgagccccgacttcagcaacgccagccacgtgagcggcatgcccggccccagcagcggccaggcctgcagcagacccgcctacaccaagaaggacaccatggagtggcacagccagatgcacagcgtgaccctgcaccccagcacctggctgagaaacggcgtggccagcctgaagaactggagcctgaagaagaaggccaaggccgccagacccgaggaggagaagatcgccagccccaagggccccctggagccccccccccacgccagcggcgtgcccgaggccaacagcctgcaggaggagcagaaggacctgcccctgagagccgccgagggcctgagccccgtgcagagcgcccagagatgcagcagcagccccttccaggacagcgagagacactgcagcagccccttcagcctggtggagagcagactgaagctgtgcatgaagagccacgaggagatcgagcccggcagccagagcagcagcggcagcctgccctgggagagagccagcgccagcagctggaccctggaggacgccaccagccccgacagcggccccaccgtggtgtgcgacatcgaggacagatacctgaccaaggacatctag

SEQ ID NO: 12694 - DNA, 3468 bp, Artificial Sequence
  Description of Artificial Sequence: Synthetic coding sequence
atgaagaccctggccgagagaagaagaagcgcccccagcctgatcctggacaaggccctgcagaagagacccaccaccagagacagccccagcgccagcgtggacacctgcaccttcctgagcagcctggtgtgcagcaacagaaccctgctgatcgacggcagagccgagctgaagagaggcctgcagagacaggagagacacctgttcctgttcaacgacctgttcgtggtggccaagatcaagtacaacaacaacttcaagatcaagaacaagatcaagctgaccgacatgtggaccgccagctgcgtggacgaggtgggcgagggcaacaccaacgccatgaagagcttcgtgctgggctggcccaccgtgaacttcgtggccaccttcagcagccccgagcagaaggacaagtggctgagcctgctgcagagatacatcaacctggagaaggagaaggactaccccaagagcatccccctgaagatcttcgccaaggacatcggcaactgcgcctacagcaagaccatcaccgtgatgaacagcgacaccgccaacgaggtgatcaacatgagcctgcccatgctgggcatcaccggcagcgagagagactaccagctgtgggtgaacagcggcaaggaggaggccccctaccccctgatcggccacgagtacccctacggcatcaagatgagccacctgagagacagcgccctgctgacccccggcagcaaggacagcaccacccccttcaacctgcaggagcccttcctgatggagcagctgcccagagagatgcagtgccagttcatcctgaagcccagcagactggccgccgcccagcagctgagcgacagcggccacaagaccttcaagagaagaagaagcatcatcaactgggccttctggagaggcagcagcacccacctggacaacctgcccagcagccccaccagccccatgcccggccagctgttcggcatcagcctgcccaacatctgcgagaacgacaacctgcccaagcccgtgctggacatgctgttcttcctgaaccagaagggccccctgaccaagggcatcttcagacagagcgccaacgtgaagagctgcagagagctgaaggagaagctgaacagcggcgtggaggtgcacctggactgcgagagcatcttcgtgatcgccagcgtgctgaaggacttcctgagaaacatccccggcagcatcttcagcagcgacctgtacgaccactgggtgagcgtgatggaccagggcaacgacgaggagaagatcaacaccgtgcagagactgctggaccagctgcccagagccaacgtggtgctgctgagatacctgttcggcgtgctgcacaacatcgagcagcacagcagcagcaaccagatgaccgccttcaacctggccgtgtgcgtggcccccagcatcctgtggccccccgccagcagcagccccgagctggagaacgagttcaccaagaaggtgagcctgctgatccagttcctgatcgagaactgcctgagaatcttcggcgaggagatcaccagcctgttcagagaggtgagcgtgagatgcgacaccagagagaacgccagcgacatcagctgcttccagctgaacgacagcagctacgacagcctggagaacgagctgaacgaggacgtggacgccccctgcagcgacctggtgaagaagctgggccagggcagcagaagcatggacagcgtgctgaccctgagcgactacgacctggaccagcccgaggtggagggcctgctgaccctgagcgacttcgacctggcccacagcaaggacgaggacgtgcagatgaagagacccctggagagcaagcccgtgaacatcctggtgtacaccaagatccccctgagagaccacgccagagcccccagcgccatgtgcacccccagctacctgagcaccgccgccgccaacgccgccaagagcctgagaagacacagaagatgcagcgagcccagcatcgactacctggacagcaagctgagctacctgagagagttctaccagaagaagctgagaaagagcagctgcgacgccatcctgagccagaaggacgaggactacctgaagcagaaccagcccctgcaggaggagggcaagacctgcttcaagcagagcctggtgaccggcaccgacgtgagcaagaagaacgccaccacccagaacaccaagaagaagagcctgagcggcagcgagggcaaccacgtgaagctgttccccaagagcaagcccgtggccatcagcgtggccagctacagccccatgagcagccaggaccacagcaagaaccagcccttcgacgtgaacaccagcggctacagccccccccacaccgccgacgccctgaagggccccagaacccacagaagatgcagcgagcccaacatcgaggaccagaacagaaagctgacctacctgagaggcatctacagcaagaagcagcacaagaccagctgcgaggccggcctgctgcacggcgaggaggactacctgaagagacacaagagcctgcagatggagggccagaagctgatcaaccagagcctggtgatgggcatcgaggtgggcaagagcagcgccaccaaccagaacaccgagaaggtgctgccccccagactgaacctgtgccccagaaccagctacagcagcctgagcagccccggcaccagccccagcggcagcagcgtgagcagccaggacagcgccttcagccagatcagcgagcacagcgtgttcacccccaccgagaccagcagccccatcgactgcaccttccaggcccagagaaagagagaggacctgagccccgacttcagcaacgccagccacgtgagcggcatgcccggccccagcagcggccaggcctgcagcagacccgcctacaccaagaaggacaccatggagtggcacagccagatgcacagcgtgaccctgcaccccagcacctggctgagaaacggcgtggccagcctgaagaactggagcctgaagaagaaggccaaggccgccagacccgaggaggagaagatcgccagccccaagggccccctggagccccccccccacgccagcggcgtgcccgaggccaacagcctgcaggaggagcagaaggacctgcccctgagagccgccgagggcctgagccccgtgcagagcgcccagagatgcagcagcagccccttccaggacagcgagagacactgcagcagccccttcagcctggtggagagcagactgaagctgtgcatgaagagccacgaggagatcgagcccggcagccagagcagcagcggcagcctgccctgggagagagccagcgccagcagctggaccctggaggacgccaccagccccgacagcggccccaccgtggtgtgcgacatcgaggacagatacctgaccaaggacatctag

SEQ ID NO: 12695 - DNA, 3468 bp, Artificial Sequence; identical to SEQ ID NO: 12694
  Description of Artificial Sequence: Synthetic coding sequence

SEQ ID NO: 12696 - DNA, 2196 bp, Artificial Sequence
  Description of Artificial Sequence: Synthetic coding sequence
atggaccagggcaacgacgaggagaagatcaacaccgtgcagagactgctggaccagctgcccagagccaacgtggtgctgctgagatacctgttcggcgtgctgcacaacatcgagcagcacagcagcagcaaccagatgaccgccttcaacctggccgtgtgcgtggcccccagcatcctgtggccccccgccagcagcagccccgagctggagaacgagttcaccaagaaggtgagcctgctgatccagttcctgatcgagaactgcctgagaatcttcggcgaggagatcaccagcctgttcagagaggtgagcgtgagatgcgacaccagagagaacgccagcgacatcagctgcttccagctgaacgacagcagctacgacagcctggagaacgagctgaacgaggacgtggacgccccctgcagcgacctggtgaagaagctgggccagggcagcagaagcatggacagcgtgctgaccctgagcgactacgacctggaccagcccgaggtggagggcctgctgaccctgagcgacttcgacctggcccacagcaaggacgaggacgtgcagatgaagagacccctggagagcaagcccgtgaacatcctggtgtacaccaagatccccctgagagaccacgccagagcccccagcgccatgtgcacccccagctacctgagcaccgccgccgccaacgccgccaagagcctgagaagacacagaagatgcagcgagcccagcatcgactacctggacagcaagctgagctacctgagagagttctaccagaagaagctgagaaagagcagctgcgacgccatcctgagccagaaggacgaggactacctgaagcagaaccagcccctgcaggaggagggcaagacctgcttcaagcagagcctggtgaccggcaccgacgtgagcaagaagaacgccaccacccagaacaccaagaagaagagcctgagcggcagcgagggcaaccacgtgaagctgttccccaagagcaagcccgtggccatcagcgtggccagctacagccccatgagcagccaggaccacagcaagaaccagcccttcgacgtgaacaccagcggctacagccccccccacaccgccgacgccctgaagggccccagaacccacagaagatgcagcgagcccaacatcgaggaccagaacagaaagctgacctacctgagaggcatctacagcaagaagcagcacaagaccagctgcgaggccggcctgctgcacggcgaggaggactacctgaagagacacaagagcctgcagatggagggccagaagctgatcaaccagagcctggtgatgggcatcgaggtgggcaagagcagcgccaccaaccagaacaccgagaaggtgctgccccccagactgaacctgtgccccagaaccagctacagcagcctgagcagccccggcaccagccccagcggcagcagcgtgagcagccaggacagcgccttcagccagatcagcgagcacagcgtgttcacccccaccgagaccagcagccccatcgactgcaccttccaggcccagagaaagagagaggacctgagccccgacttcagcaacgccagccacgtgagcggcatgcccggccccagcagcggccaggcctgcagcagacccgcctacaccaagaaggacaccatggagtggcacagccagatgcacagcgtgaccctgcaccccagcacctggctgagaaacggcgtggccagcctgaagaactggagcctgaagaagaaggccaaggccgccagacccgaggaggagaagatcgccagccccaagggccccctggagccccccccccacgccagcggcgtgcccgaggccaacagcctgcaggaggagcagaaggacctgcccctgagagccgccgagggcctgagccccgtgcagagcgcccagagatgcagcagcagccccttccaggacagcgagagacactgcagcagccccttcagcctggtggagagcagactgaagctgtgcatgaagagccacgaggagatcgagcccggcagccagagcagcagcggcagcctgccctgggagagagccagcgccagcagctggaccctggaggacgccaccagccccgacagcggccccaccgtggtgtgcgacatcgaggacagaaactgctgctag

SEQ ID NO: 12697 - DNA, 3498 bp, Artificial Sequence; identical to SEQ ID NO: 12692
  Description of Artificial Sequence: Synthetic coding sequence

SEQ ID NO: 12698 - DNA, 4542 bp, Artificial Sequence
  Description of Artificial Sequence: Synthetic coding sequence
atgatgatggccagaaagcaggacgtgagaatccccacctacaacatcagcgtggtgggcctgagcggcaccgagaaggagaagggccagtgcggcatcggcaagagctgcctgtgcaacagattcgtgagacccagcgccgacgagttccacctggaccacaccagcgtgctgagcaccagcgacttcggcggcagagtggtgaacaacgaccacttcctgtactggggcgaggtgagcagaagcctggaggactgcgtggagtgcaagatgcacatcgtggagcagaccgagttcatcgacgaccagaccttccagccccacagaagcaccgccctgcagccctacatcaagagagccgccgccaccaagctggccagcgccgagaagctgatgtacttctgcaccgaccagctgggcctggagcaggacttcgagcagaagcagatgcccgacggcaagctgctggtggacggcttcctgctgggcatcgacgtgagcagaggcatgaacagaaacttcgacgaccagctgaagttcgtgagcaacctgtacaaccagctggccaagaccaagaagcccatcgtggtggtgctgaccaagtgcgacgagggcgtggagagatacatcagagacgcccacaccttcgccctgagcaagaagaacctgcaggtggtggagaccagcgccagaagcaacgtgaacgtggacctggccttcagcaccctggtgcagctgatcgacaagagcagaggcaagaccaagatcatcccctacttcgaggccctgaagcagcagagccagcagatcgccaccgccaaggacaagtacgagtggctggtgagcagaatcgtgaagaaccacaacgagaactggctgagcgtgagcagaaagatgcaggccagccccgagtaccaggactacgtgtacctggagggcacccagaaggccaagaagctgttcctgcagcacatccacagactgaagcacgagcacatcgagagaagaagaaagctgtacctggccgccctgcccctggccttcgaggccctgatccccaacctggacgagatcgaccacctgagctgcatcaaggccaagaagctgctggagaccaagcccgagttcctgaagtggttcgtggtgctggaggagaccccctgggacgccaccagccacatcgacaacatggagaacgagagaatccccttcgacctgatggacaccgtgcccgccgagcagctgtacgaggcccacctggagaagctgagaaacgagagaaagagagtggagatgagaagagccttcaaggagaacctggagaccagccccttcatcacccccggcaagccctgggaggaggccagaagcttcatcatgaacgaggacttctaccagtggctggaggagagcgtgtacatggacatctacggcaagcaccagaagcagatcatcgacaaggccaaggaggagttccaggagctgctgctggagtacagcgagctgttctacgagctggagctggacgccaagcccagcaaggagaagatgggcgtgatccaggacgtgctgggcgaggagcagagattcaaggccctgcagaagctgcaggccgagagagacgccctgatcctgaagcacatccacttcgtgtaccaccccaccaaggagacctgccccagctgccccgcctgcgtggacgccaagatcgagcacctgatcagcagcagattcatcagacccagcgacagaaaccagaagaacagcctgagcgaccccaacatcgacagaatcaacctggtgatcctgggcaaggacggcctggccagagagctggccaacgagatcagagccctgtgcaccaacgacgacaagtacgtgatcgacggcaagatgtacgagctgagcctgagacccatcgagggcaacgtgagactgcccgtgaacagcttccagacccccaccttccagccccacggctgcctgtgcctgtacaacagcaaggagagcctgagctacgtggtggagagcatcgagaagagcagagagagcaccctgggcagaagagacaaccacctggtgcacctgcccctgaccctgatcctggtgaacaagagaggcgacaccagcggcgagaccctgcacagcctgatccagcagggccagcagatcgccagcaagctgcagtgcgtgttcctggaccccgccagcgccggcatcggctacggcagaaacatcaacgagaagcagatcagccaggtgctgaagggcctgctggacagcaagagaaacctgaacctggtgagcagcaccgccagcatcaaggacctggccgacgtggacctgagaatcgtgatgtgcctgatgtgcggcgaccccttcagcgccgacgacatcctgttccccgtgctgcagagccagacctgcaagagcagccactgcggcagcaacaacagcgtgctgctggagctgcccatcggcctgcacaagaagagaatcgagctgagcgtgctgagctaccacagcagcttcagcatcagaaagagcagactggtgcacggctacatcgtgttctacagcgccaagagaaaggccagcctggccatgctgagagccttcctgtgcgaggtgcaggacatcatccccatccagctggtggccctgaccgacggcgccgtggacgtgctggacaacgacctgagcagagagcagctgaccgagggcgaggagatcgcccaggagatcgacggcagattcaccagcatcccctgcagccagccccagcacaagctggagatcttccaccccttcttcaaggacgtggtggagaagaagaacatcatcgaggccacccacatgtacgacaacgccgccgaggcctgcagcaccaccgaggaggtgttcaacagccccagagccggcagccccctgtgcaacagcaacctgcaggacagcgaggaggacatcgagcccagctacagcctgttcagagaggacaccagcctgcccagcctgagcaaggaccacagcaagctgagcatggagctggagggcaacgacggcctgagcttcatcatgagcaacttcgagagcaagctgaacaacaaggtgcccccccccgtgaagcccaagccccccgtgcacttcgagatcaccaagggcgacctgagctacctggaccagggccacagagacggccagagaaagagcgtgagcagcagcccctggctgccccaggacggcttcgaccccagcgactacgccgagcccatggacgccgtggtgaagcccagaaacgaggaggagaacatctacagcgtgccccacgacagcacccagggcaagatcatcaccatcagaaacatcaacaaggcccagagcaacggcagcggcaacggcagcgacagcgagatggacaccagcagcctggagagaggcagaaaggtgagcatcgtgagcaagcccgtgctgtacagaaccagatgcaccagactgggcagattcgccagctacagaaccagcttcagcgtgggcagcgacgacgagctgggccccatcagaaagaaggaggaggaccaggccagccagggctacaagggcgacaacgccgtgatcccctacgagaccgacgaggaccccagaagaagaaacatcctgagaagcctgagaagaaacaccaagaagcccaagcccaagcccagacccagcatcaccaaggccacctgggagagcaactacttcggcgtgcccctgaccaccgtggtgacccccgagaagcccatccccatcttcatcgagagatgcatcgagtacatcgaggccaccggcctgagcaccgagggcatctacagagtgagcggcaacaagagcgagatggagagcctgcagagacagttcgaccaggaccacaacctggacctggccgagaaggacttcaccgtgaacaccgtggccggcgccatgaagagcttcttcagcgagctgcccgaccccctggtgccctacaacatgcagatcgacctggtggaggcccacaagatcaacgacagagagcagaagctgcacgccctgaaggaggtgctgaagaagttccccaaggagaaccacgaggtgttcaagtacgtgatcagccacctgaacaaggtgagccacaacaacaaggtgaacctgatgaccagcgagaacctgagcatctgcttctggcccaccctgatgagacccgacttcagcaccatggacgccctgaccgccaccagaacctaccagaccatcatcgagctgttcatccagcagtgccccttcttcttctacaacagacccatcaccgagccccccggcgccagacccagcagccccagcgccgtggccagcaccgtgcccttcctgaccagcacccccgtgaccagccagcccagccccccccagagccccccccccaccccccagagccccatgcagcccctgctgcccagccccctgcacccccacagacccaccccccagcccagcagaaacatcccctggcagaccaaggagcactag

SEQ ID NO: 12699 - DNA, 4500 bp, Artificial Sequence
  Description of Artificial Sequence: Synthetic coding sequence
atgatgatggccagaaagcaggacgtgagaatccccacctacaacatcagcgtggtgggcctgagcggcaccgagaaggagaagggccagtgcggcatcggcaagagctgcctgtgcaacagattcgtgagacccagcgccgacgagttccacctggaccacaccagcgtgctgagcaccagcgacttcggcggcagagtggtgaacaacgaccacttcctgtactggggcgaggtgagcagaagcctggaggactgcgtggagtgcaagatgcacatcgtggagcagaccgagttcatcgacgaccagaccttccagccccacagaagcaccgccctgcagccctacatcaagagagccgccgccaccaagctggccagcgccgagaagctgatgtacttctgcaccgaccagctgggcctggagcaggacttcgagcagaagcagatgcccgacggcaagctgctggtggacggcttcctgctgggcatcgacgtgagcagaggcatgaacagaaacttcgacgaccagctgaagttcgtgagcaacctgtacaaccagctggccaagaccaagaagcccatcgtggtggtgctgaccaagtgcgacgagggcgtggagagatacatcagagacgcccacaccttcgccctgagcaagaagaacctgcaggtggtggagaccagcgccagaagcaacgtgaacgtggacctggccttcagcaccctggtgcagctgatcgacaagagcagaggcaagaccaagatcatcccctacttcgaggccctgaagcagcagagccagcagatcgccaccgccaaggacaagtacgagtggctggtgagcagaatcgtgaagaaccacaacgagaactggctgagcgtgagcagaaagatgcaggccagccccgagtaccaggactacgtgtacctggagggcacccagaaggccaagaagctgttcctgcagcacatccacagactgaagcacgagcacatcgagagaagaagaaagctgtacctggccgccctgcccctggccttcgaggccctgatccccaacctggacgagatcgaccacctgagctgcatcaaggccaagaagctgctggagaccaagcccgagttcctgaagtggttcgtggtgctggaggagaccccctgggacgccaccagccacatcgacaacatggagaacgagagaatccccttcgacctgatggacaccgtgcccgccgagcagctgtacgaggcccacctggagaagctgagaaacgagagaaagagagtggagatgagaagagccttcaaggagaacctggagaccagccccttcatcacccccggcaagccctgggaggaggccagaagcttcatcatgaacgaggacttctaccagtggctggaggagagcgtgtacatggacatctacggcaagcaccagaagcagatcatcgacaaggccaaggaggagttccaggagctgctgctggagtacagcgagctgttctacgagctggagctggacgccaagcccagcaaggagaagatgggcgtgatccaggacgtgctgggcgaggagcagagattcaaggccctgcagaagctgcaggccgagagagacgccctgatcctgaagcacatccacttcgtgtaccaccccaccaaggagacctgccccagctgccccgcctgcgtggacgccaagatcgagcacctgatcagcagcagattcatcagacccagcgacagaaaccagaagaacagcctgagcgaccccaacatcgacagaatcaacctggtgatcctgggcaaggacggcctggccagagagctggccaacgagatcagagccctgtgcaccaacgacgacaagtacgtgatcgacggcaagatgtacgagctgagcctgagacccatcgagggcaacgtgagactgcccgtgaacagcttccagacccccaccttccagccccacggctgcctgtgcctgtacaacagcaaggagagcctgagctacgtggtggagagcatcgagaagagcagagagagcaccctgggcagaagagacaaccacctggtgcacctgcccctgaccctgatcctggtgaacaagagaggcgacaccagcggcgagaccctgcacagcctgatccagcagggccagcagatcgccagcaagctgcagtgcgtgttcctggaccccgccagcgccggcatcggctacggcagaaacatcaacgagaagcagatcagccaggtgctgaagggcctgctggacagcaagagaaacctgaacctggtgagcagcaccgccagcatcaaggacctggccgacgtggacctgagaatcgtgatgtgcctgatgtgcggcgaccccttcagcgccgacgacatcctgttccccgtgctgcagagccagacctgcaagagcagccactgcggcagcaacaacagcgtgctgctggagctgcccatcggcctgcacaagaagagaatcgagctgagcgtgctgagctaccacagcagcttcagcatcagaaagagcagactggtgcacggctacatcgtgttctacagcgccaagagaaaggccagcctggccatgctgagagccttcctgtgcgaggtgcaggacatcatccccatccagctggtggccctgaccgacggcgccgtggacgtgctggacaacgacctgagcagagagcagctgaccgagggcgaggagatcgcccaggagatcgacggcagattcaccagcatcccctgcagccagccccagcacaagctggagatcttccaccccttcttcaaggacgtggtggagaagaagaacatcatcgaggccacccacatgtacgacaacgccgccgaggcctgcagcaccaccgaggaggtgttcaacagccccagagccggcagccccctgtgcaacagcaacctgcaggacagcgaggaggacatcgagcccagctacagcctgttcagagaggacaccagcctgcccagcctgagcaaggaccacagcaagctgagcatggagctggagggcaacgacggcctgagcttcatcatgagcaacttcgagagcaagctgaacaacaaggtgcccccccccgtgaagcccaagccccccgtgcacttcgagatcaccaagggcgacctgagctacctggaccagggccacagagacggccagagaaagagcgtgagcagcagcccctggctgccccaggacggcttcgaccccagcgactacgccgagcccatggacgccgtggtgaagcccagaaacgaggaggagaacatctacagcgtgccccacgacagcacccagggcaagatcatcaccatcagaaacatcaacaaggcccagagcaacggcagcggcaacggcagcgacagcgagatggacaccagcagcctggagagaggcagaaaggtgagcatcgtgagcaagcccgtgctgtacagaaccagatgcaccagactgggcagattcgccagctacagaaccagcttcagcgtgggcagcgacgacgagctgggccccatcagaaagaaggaggaggaccaggccagccagggctacaagggcgacaacgccgtgatcccctacgagaccgacgaggaccccagaagaagaaacatcctgagaagcctgagaagaaacaccaagaagcccaagcccaagcccagacccagcatcaccaaggccacctgggagagcaactacttcggcgtgcccctgaccaccgtggtgacccccgagaagcccatccccatcttcatcgagagatgcatcgagtacatcgaggccaccggcctgagcaccgagggcatctacagagtgagcggcaacaagagcgagatggagagcctgcagagacagttcgaccaggaccacaacctggacctggccgagaaggacttcaccgtgaacaccgtggccggcgccatgaagagcttcttcagcgagctgcccgaccccctggtgccctacaacatgcagatcgacctggtggaggcccacaagatcaacgacagagagcagaagctgcacgccctgaaggaggtgctgaagaagttccccaaggagaaccacgaggtgttcaagtacgtgatcagccacctgaacaaggtgagccacaacaacaaggtgaacctgatgaccagcgagaacctgagcatctgcttctggcccaccctgatgagacccgacttcagcaccatggacgccctgaccgccaccagaacctaccagaccatcatcgagctgttcatccagcagtgccccttcttcttctacaacagacccatcaccgagccccccggcgccagacccagcagccccagcgccgtggccagcaccgtgcccttcctgaccagcacccccgtgaccagccagcccagccccccccagagccccccccccaccccccagagccccatgcagcccctgctgcccagccagctgcaggccgagcacaccctgtag

SEQ ID NO: 12700 - DNA, 2250 bp, Artificial Sequence
  Description of Artificial Sequence: Synthetic coding sequence
atgatgatggccagaaagcaggacgtgagaatccccacctacaacatcagcgtggtgggcctgagcggcaccgagaaggagaagggccagtgcggcatcggcaagagctgcctgtgcaacagattcgtgagacccagcgccgacgagttccacctggaccacaccagcgtgctgagcaccagcgacttcggcggcagagtggtgaacaacgaccacttcctgtactggggcgaggtgagcagaagcctggaggactgcgtggagtgcaagatgcacatcgtggagcagaccgagttcatcgacgaccagaccttccagccccacagaagcaccgccctgcagccctacatcaagagagccgccgccaccaagctggccagcgccgagaagctgatgtacttctgcaccgaccagctgggcctggagcaggacttcgagcagaagcagatgcccgacggcaagctgctggtggacggcttcctgctgggcatcgacgtgagcagaggcatgaacagaaacttcgacgaccagctgaagttcgtgagcaacctgtacaaccagctggccaagaccaagaagcccatcgtggtggtgctgaccaagtgcgacgagggcgtggagagatacatcagagacgcccacaccttcgccctgagcaagaagaacctgcaggtggtggagaccagcgccagaagcaacgtgaacgtggacctggccttcagcaccctggtgcagctgatcgacaagagcagaggcaagaccaagatcatcccctacttcgaggccctgaagcagcagagccagcagatcgccaccgccaaggacaagtacgagtggctggtgagcagaatcgtgaagaaccacaacgagaactggctgagcgtgagcagaaagatgcaggccagccccgagtaccaggactacgtgtacctggagggcacccagaaggccaagaagctgttcctgcagcacatccacagactgaagcacgagcacatcgagagaagaagaaagctgtacctggccgccctgcccctggccttcgaggccctgatccccaacctggacgagatcgaccacctgagctgcatcaaggccaagaagctgctggagaccaagcccgagttcctgaagtggttcgtggtgctggaggagaccccctgggacgccaccagccacatcgacaacatggagaacgagagaatccccttcgacctgatggacaccgtgcccgccgagcagctgtacgaggcccacctggagaagctgagaaacgagagaaagagagtggagatgagaagagccttcaaggagaacctggagaccagccccttcatcacccccggcaagccctgggaggaggccagaagcttcatcatgaacgaggacttctaccagtggctggaggagagcgtgtacatggacatctacggcaagcaccagaagcagatcatcgacaaggccaaggaggagttccaggagctgctgctggagtacagcgagctgttctacgagctggagctggacgccaagcccagcaaggagaagatgggcgtgatccaggacgtgctgggcgaggagcagagattcaaggccctgcagaagctgcaggccgagagagacgccctgatcctgaagcacatccacttcgtgtaccaccccaccaaggagacctgccccagctgccccgcctgcgtggacgccaagatcgagcacctgatcagcagcagattcatcagacccagcgacagaaaccagaagaacagcctgagcgaccccaacatcgacagaatcaacctggtgatcctgggcaaggacggcctggccagagagctggccaacgagatcagagccctgtgcaccaacgacgacaagtacgtgatcgacggcaagatgtacgagctgagcctgagacccatcgagggcaacgtgagactgcccgtgaacagcttccagacccccaccttccagccccacggctgcctgtgcctgtacaacagcaaggagagcctgagctacgtggtggagagcatcgagaagagcagagagagcaccctgggcagaagagacaaccacctggtgcacctgcccctgaccctgatcctggtgaacaagagaggcgacaccagcggcgagaccctgcacagcctgatccagcagggccagcagatcgccagcaagctgcagtgcgtgttcctggaccccgccagcgccggcgccgccgacctgagctggctgggccccatctag

SEQ ID NO: 12701 - DNA, 978 bp, Artificial Sequence
  Description of Artificial Sequence: Synthetic coding sequence
atggacatgtggaccgccctgctgatcctgcaggccctgctgctgcccagcctggccgacggcgccacccccgccctgagattcgtggccgtgggcgactggggcggcgtgcccaacgcccccttccacaccgccagagagatggccaacgccaaggagatcgccagaaccgtgcagatcctgggcgccgacttcatcctgagcctgggcgacaacttctacttcaccggcgtgcaggacatcaacgacaagagattccaggagaccttcgaggacgtgttcagcgacagaagcctgagaaaggtgccctggtacgtgctggccggcaaccacgaccacctgggcaacgtgagcgcccagatcgcctacagcaagatcagcaagagatggaacttccccagccccttctacagactgcacttcaagatcccccagaccaacgtgagcgtggccatcttcatgctggacaccgtgaccctgtgcggcaacagcgacgacttcctgagccagcagcccgagagacccagagacgtgaagctggccagaacccagctgagctggctgaagaagcagctggccgccgccagagaggactacgtgctggtggccggccactaccccgtgtggagcatcgccgagcacggccccacccactgcctggtgaagcagctgagacccctgctggccacctacggcgtgaccgcctacctgtgcggccacgaccacaacctgcagtacctgcaggacgagaacggcgtgggctacgtgctgagcggcgccggcaacttcatggaccccagcaagagacaccagagaaaggtgcccaacggctacctgagattccactacggcaccgaggacagcctgggcggcttcgcctacgtggagatcagcagcaaggagatgaccgtgacctacatcgaggccagcggcaagagcctgttcaagaccagactgcccagaagagccagaccctag

SEQ ID NO: 12702 - DNA, 2349 bp, Artificial Sequence
  Description of Artificial Sequence: Synthetic coding sequence
atgaacagcgccgagcagaccgtgacctggctgatcaccctgggcgtgctggagagccccaagaagaccatcagcgaccccgagggcttcctgcaggccagcctgaaggacggcgtggtgctgtgcagactgctggagagactgctgcccggcaccatcgagaaggtgtaccccgagcccagaagcgagagcgagtgcctgagcaacatcagagagttcctgagaggctgcggcgccagcctgagactggagaccttcgacgccaacgacctgtaccagggccagaacttcaacaaggtgctgagcagcctggtgaccctgaacaaggtgaccgccgacatcggcctgggcagcgacagcgtgtgcgccagacccagcagccacagaatcaagagcttcgacagcctgggcagccagagcctgcacaccagaaccagcaagctgttccagggccagtacagaagcctggacatgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccagcgacgaggagttcgccagcagaaagagcaccgccgccctggaggaggacgcccagatcctgaaggtgatcgaggcctactgcaccagcgccaagaccagacagaccctgaacagcacctggcagggcaccgacctgatgcacaaccacgtgctggccgacgacgaccagcccagcctggacagcctgggcagaagaagcagcctgagcagactggagcccagcgacctgagcgaggacagcgactacgacagcatctggaccgcccacagctacagaatgggcagcaccagcagaaagagctgctgcagctacatcagccaccagaactag

SEQ ID NO: 12703 - DNA, 2196 bp, Artificial Sequence
  Description of Artificial Sequence: Synthetic coding sequence
atgaacagcgccgagcagaccgtgacctggctgatcaccctgggcgtgctggagagccccaagaagaccatcagcgaccccgagggcttcctgcaggccagcctgaaggacggcgtggtgctgtgcagactgctggagagactgctgcccggcaccatcgagaaggtgtaccccgagcccagaagcgagagcgagtgcctgagcaacatcagagagttcctgagaggctgcggcgccagcctgagactggaggacatgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccagcgacgaggagttcgccagcagaaagagcaccgccgccctggaggaggacgcccagatcctgaaggtgatcgaggcctactgcaccagcgccaagaccagacagaccctgaacagcagcagcagaaaggagagcgccccccaggtgctgctgcccgaggaggagaagatcatcgtggaggagaccaagagcaacggccagaccgtgatcgaggagaagagcctggtggacaccgtgtacgccctgaaggacgaggtgcaggagctgagacaggacaacaagaagatgaagaagagcctggaggaggagcagagagccagaaaggacctggagaagctggtgagaaaggtgctgaagaacatgaacgaccccgcctgggacgagaccaacctgtag

SEQ ID NO: 12704 - DNA, 1878 bp, Artificial Sequence
  Description of Artificial Sequence: Synthetic coding sequence
atgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccagcgacgaggagttcgccagcagaaagagcaccgccgccctggaggaggacgcccagatcctgaaggtgatcgaggcctactgcaccagcgccaagaccagacagaccctgaacagcacctggcagggcaccgacctgatgcacaaccacgtgctggccgacgacgaccagcccagcctggacagcctgggcagaagaagcagcctgagcagactggagcccagcgacctgagcgaggacagcgactacgacagcatctggaccgcccacagctacagaatgggcagcaccagcagaaagagctgctgcagctacatcagccaccagaactag

SEQ ID NO: 12705 - DNA, 1941 bp, Artificial Sequence
  Description of Artificial Sequence: Synthetic coding sequence
atgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccagcgacgaggagttcgccagcagaaagagcaccgccgccctggaggaggacgcccagatcctgaaggtgatcgaggcctactgcaccagcgccaagaccagacagaccctgaacagcagcagcagaaaggagagcgccccccaggtgctgctgcccgaggaggagaagatcatcgtggaggagaccaagagcaacggccagaccgtgatcgaggagaagagcctggtggacaccgtgtacgccctgaaggacgaggtgcaggagctgagacaggacaacaagaagatgaagaagagcctggaggaggagcagagagccagaaaggacctggagaagctggtgagaaaggtgctgaagaacatgaacgaccccgcctgggacgagaccaacctgtag

SEQ ID NO: 12706 - DNA, 2166 bp, Artificial Sequence
  Description of Artificial Sequence: Synthetic coding sequence
atgaagaccttcgacgccaacgacctgtaccagggccagaacttcaacaaggtgctgagcagcctggtgaccctgaacaaggtgaccgccgacatcggcctgggcagcgacagcgtgtgcgccagacccagcagccacagaatcaagagcttcgacagcctgggcagccagagcctgcacaccagaaccagcaagctgttccagggccagtacagaagcctggacatgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccagcgacgaggagttcgccagcagaaagagcaccgccgccctggaggaggacgcccagatcctgaaggtgatcgaggcctactgcaccagcgccaagaccagacagaccctgaacagcagcagcagaaaggagagcgccccccaggtgctgctgcccgaggaggagaagatcatcgtggaggagaccaagagcaacggccagaccgtgatcgaggagaagagcctggtggacaccgtgtacgccctgaaggacgaggtgcaggagctgagacaggacaacaagaagatgaagaagagcctggaggaggagcagagagccagaaaggacctggagaagctggtgagaaaggtgctgaagaacatgaacgaccccgcctgggacgagaccaacctgtag

SEQ ID NO: 12707 - DNA, 2262 bp, Artificial Sequence
  Description of Artificial Sequence: Synthetic coding sequence
atgaacagcgccgagcagaccgtgacctggctgatcaccctgggcgtgctggagagccccaagaagaccatcagcgaccccgagggcttcctgcaggccagcctgaaggacggcgtggtgctgtgcagactgctggagagactgctgcccggcaccatcgagaagaccttcgacgccaacgacctgtaccagggccagaacttcaacaaggtgctgagcagcctggtgaccctgaacaaggtgaccgccgacatcggcctgggcagcgacagcgtgtgcgccagacccagcagccacagaatcaagagcttcgacagcctgggcagccagagcctgcacaccagaaccagcaagctgttccagggccagtacagaagcctggacatgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccagcgacgaggagttcgccagcagaaagagcaccgccgccctggaggaggacgcccagatcctgaaggtgatcgaggcctactgcaccagcgccaagaccagacagaccctgaacagcacctggcagggcaccgacctgatgcacaaccacgtgctggccgacgacgaccagcccagcctggacagcctgggcagaagaagcagcctgagcagactggagcccagcgacctgagcgaggacagcgactacgacagcatctggaccgcccacagctacagaatgggcagcaccagcagaaagagctgctgcagctacatcagccaccagaactag

SEQ ID NO: 12708 - DNA, 2412 bp, Artificial Sequence
  Description of Artificial Sequence: Synthetic coding sequence
atgaacagcgccgagcagaccgtgacctggctgatcaccctgggcgtgctggagagccccaagaagaccatcagcgaccccgagggcttcctgcaggccagcctgaaggacggcgtggtgctgtgcagactgctggagagactgctgcccggcaccatcgagaaggtgtaccccgagcccagaagcgagagcgagtgcctgagcaacatcagagagttcctgagaggctgcggcgccagcctgagactggagctgctgttcccccccagccagcccccccagcacctggtgaccaccatcctgctgagcgccagcaccttcgacgccaacgacctgtaccagggccagaacttcaacaaggtgctgagcagcctggtgaccctgaacaaggtgaccgccgacatcggcctgggcagcgacagcgtgtgcgccagacccagcagccacagaatcaagagcttcgacagcctgggcagccagagcctgcacaccagaaccagcaagctgttccagggccagtacagaagcctggacatgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccagcgacgaggagttcgccagcagaaagagcaccgccgccctggaggaggacgcccagatcctgaaggtgatcgaggcctactgcaccagcgccaagaccagacagaccctgaacagcacctggcagggcaccgacctgatgcacaaccacgtgctggccgacgacgaccagcccagcctggacagcctgggcagaagaagcagcctgagcagactggagcccagcgacctgagcgaggacagcgactacgacagcatctggaccgcccacagctacagaatgggcagcaccagcagaaagagctgctgcagctacatcagccaccagaactag

SEQ ID NO: 12709 - DNA, 1941 bp, Artificial Sequence; identical to SEQ ID NO: 12705
  Description of Artificial Sequence: Synthetic coding sequence

SEQ ID NO: 12710 - DNA, 201 bp, Artificial Sequence
  Description of Artificial Sequence: Synthetic coding sequence
atgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagctag

SEQ ID NO: 12711 - DNA, 1344 bp, Artificial Sequence
  Description of Artificial Sequence: Synthetic coding sequence
atgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccactag

SEQ ID NO: 12712 - DNA, 186 bp, Artificial Sequence
  Description of Artificial Sequence: Synthetic coding sequence
atgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagatag

SEQ ID NO: 12713 - DNA, 120 bp, Artificial Sequence
  Description of Artificial Sequence: Synthetic coding sequence
atgaccgacaacagcaacaaccagctggtggtgagagccaagttcaacttccagcagaccaacgaggacgagctgagcttcagcaagggcgacgtgatccacgtgaccagagtggagtag

SEQ ID NO: 12714 - DNA, 546 bp, Artificial Sequence
  Description of Artificial Sequence: Synthetic coding sequence
atgtgcttccccagaagcagcgtgaccaccgacgaccaccagctggacggcatcaagagcaccagagcccccgcccccggctgctgctgctgccccagcgagaccctgagaagcggcgaggtggccagaagcagcgccgagagcagaagactgctgttcaagcccgacgccaccgacgagaaccccgtgccccacgtgctgtgccagagccccttctgcagcgagtgcccccacggcacccaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcgcctag

SEQ ID NO: 12715 - DNA, 2070 bp, Artificial Sequence
  Description of Artificial Sequence: Synthetic coding sequence
atcccccccagcaagcccctgagaggcagcagcctgtggggctgctggagcagacccaagaccatcagcgaccccgagggcttcctgcaggccagcctgaaggacggcgtggtgctgtgcagactgctggagagactgctgcccggcaccatcgagaaggtgtaccccgagcccagaagcgagagcgagtgcctgagcaacatcagagagttcctgagaggctgcggcgccagcctgagactggagaccttcgacgccaacgacctgtaccagggccagaacttcaacaaggtgctgagcagcctggtgaccctgaacaaggtgaccgccgacatcggcctgggcagcgacagcgtgtgcgccagacccagcagccacagaatcaagagcttcgacagcctgggcagccagagcctgcacaccagaaccagcaagctgttccagggccagtacagaagcctggacatgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccatgagaagcagcagacccggcaaggcccagctgctgtggaagaagatgctgagattctag

SEQ ID NO: 12716 - DNA, 4065 bp, Artificial Sequence
  Description of Artificial Sequence: Synthetic coding sequence
atgagcaccggcgacagcttcgagaccagattcgagaagatggacaacctgctgagagaccccaagagcgaggtgaacagcgactgcctgctggacggcctggacgccctggtgtacgacctggacttccccgccctgagaaagaacaagaacatcgacaacttcctgagcagatacaaggacaccatcaacaagatcagagacctgagaatgaaggccgaggactacgaggtggtgaaggtgatcggcagaggcgccttcggcgaggtgcagctggtgagacacaagagcaccagaaaggtgtacgccatgaagctgctgagcaagttcgagatgatcaagagaagcgacagcgccttcttctgggaggagagagacatcatggccttcgccaacagcccctgggtggtgcagctgttctacgccttccaggacgacagatacctgtacatggtgatggagtacatgcccggcggcgacctggtgaacctgatgagcaactacgacgtgcccgagaagtgggccagattctacaccgccgaggtggtgctggccctggacgccatccacagcatgggcttcatccacagagacgtgaagcccgacaacatgctgctggacaagagcggccacctgaagctggccgacttcggcacctgcatgaagatgaacaaggagggcatggtgagatgcgacaccgccgtgggcacccccgactacatcagccccgaggtgctgaagagccagggcggcgacggctactacggcagagagtgcgactggtggagcgtgggcgtgttcctgtacgagatgctggtgggcgacacccccttctacgccgacagcctggtgggcacctacagcaagatcatgaaccacaagaacagcctgaccttccccgacgacaacgacatcagcaaggaggccaagaacctgatctgcgccttcctgaccgacagagaggtgagactgggcagaaacggcgtggaggagatcaagagacacctgttcttcaagaacgaccagtgggcctgggagaccctgagagacaccgtggcccccgtggtgcccgacctgagcagcgacatcgacaccagcaacttcgacgacctggaggaggacaagggcgaggaggagaccttccccatccccaaggccttcgtgggcaaccagctgcccttcgtgggcttcacctactacagcaacagaagatacctgagcagcgccaaccccaacgacaacagaaccagcagcaacgccgacaagagcctgcaggagagcctgcagaagaccatctacaagctggaggagcagctgcacaacgagatgcagctgaaggacgagatggagcagaagtgcagaaccagcaacatcaagctggacaagatcatgaaggagctggacgaggagggcaaccagagaagaaacctggagagcaccgtgagccagatcgagaaggagaagatgctgctgcagcacagaatcaacgagtaccagagaaaggccgagcaggagaacgagaagagaagaaacgtggagaacgaggtgagcaccctgaaggaccagctggaggacctgaagaaggtgagccagaacagccagctggccaacgagaagctgagccagctgcagaagcagctggaggaggccaacgacctgctgagaaccgagagcgacaccgccgtgagactgagaaagagccacaccgagatgagcaagagcatcagccagctggagagcctgaacagagagctgcaggagagaaacagaatcctggagaacagcaagagccagaccgacaaggactactaccagctgcaggccatcctggaggccgagagaagagacagaggccacgacagcgagatgatcggcgacctgcaggccagaatcaccagcctgcaggaggaggtgaagcacctgaagcacaacctggagaaggtggagggcgagagaaaggaggcccaggacatgctgaaccacagcgagaaggagaagaacaacctggagatcgacctgaactacaagctgaagagcctgcagcagagactggagcaggaggtgaacgagcacaaggtgaccaaggccagactgaccgacaagcaccagagcatcgaggaggccaagagcgtggccatgtgcgagatggagaagaagctgaaggaggagagagaggccagagagaaggccgagaacagagtggtgcagatcgagaagcagtgcagcatgctggacgtggacctgaagcagagccagcagaagctggagcacctgaccggcaacaaggagagaatggaggacgaggtgaagaacctgaccctgcagctggagcaggagagcaacaagagactgctgctgcagaacgagctgaagacccaggccttcgaggccgacaacctgaagggcctggagaagcagatgaagcaggagatcaacaccctgctggaggccaagagactgctggagttcgagctggcccagctgaccaagcagtacagaggcaacgagggccagatgagagagctgcaggaccagctggaggccgagcagtacttcagcaccctgtacaagacccaggtgaaggagctgaaggaggagatcgaggagaagaacagagagaacctgaagaagatccaggagctgcagaacgagaaggagaccctggccacccagctggacctggccgagaccaaggccgagagcgagcagctggccagaggcctgctggaggagcagtacttcgagctgacccaggagagcaagaaggccgccagcagaaacagacaggagatcaccgacaaggaccacaccgtgagcagactggaggaggccaacagcatgctgaccaaggacatcgagatcctgagaagagagaacgaggagctgaccgagaagatgaagaaggccgaggaggagtacaagctggagaaggaggaggagatcagcaacctgaaggccgccttcgagaagaacatcaacaccgagagaaccctgaagacccaggccgtgaacaagctggccgagatcatgaacagaaaggacttcaagatcgacagaaagaaggccaacacccaggacctgagaaagaaggagaaggagaacagaaagctgcagctggagctgaaccaggagagagagaagttcaaccagatggtggtgaagcaccagaaggagctgaacgacatgcaggcccagctggtggaggagtgcgcccacagaaacgagctgcagatgcagctggccagcaaggagagcgacatcgagcagctgagagccaagctgctggacctgagcgacagcaccagcgtggccagcttccccagcgccgacgagaccgacggcaacctgcccgagagcagaatcgagggctggctgagcgtgcccaacagaggcaacatcaagagatacggctggaagaagcagtacgtggtggtgagcagcaagaagatcctgttctacaacgacgagcaggacaaggagcagagcaaccccagcatggtgctggacatcgacaagctgttccacgtgagacccgtgacccagggcgacgtgtacagagccgagaccgaggagatccccaagatcttccagatcctgtacgccaacgagggcgagtgcagaaaggacgtggagatggagcccgtgcagcaggccgagaagaccaacttccagaaccacaagggccacgagttcatccccaccctgtaccacttccccgccaactgcgacgcctgcgccaagcccctgtggcacgtgttcaagcccccccccgccctggagtgcagaagatgccacgtgaagtgccacagagaccacctggacaagaaggaggacctgatctgcccctgcaaggtgagctacgacgtgaccagcgccagagacatgctgctgctggcctgcagccaggacgagcagaagaagtgggtgacccacctggtgaagaagatccccaagaacccccccagcggcttcgtgagagccagccccagaaccctgagcaccagaagcaccgccaaccagagcttcagaaaggtggtgaagaacaccagcggcaagaccagctag

SEQ ID NO: 12717 - DNA, 471 bp, Artificial Sequence
  Description of Artificial Sequence: Synthetic coding sequence
atggcccccgccagagccggcttctgccccctgctgctgctgctgctgctgggcctgtgggtggccgagatccccgtgagcgccaagcccaagggcatgaccagcagccagtggttcaagatccagcacatgcagcccagcccccaggcctgcaacagcgccatgaagaacatcaacaagcacaccaagagatgcaaggacctgaacaccttcctgcacgagcccttcagcagcgtggccgccacctgccagacccccaagatcgcctgcaagaacggcgacaagaactgccaccagagccacggcgccgtgagcctgaccatgtgcaagctgaccagcggcaagcaccccaactgcagatacaaggagaagagacagaacaagagctacgtggtggcctgcaagcccccccagaagaaggacagccagcagttccacctggtgcccgtgcacctggacagagtgctgtag

SEQ ID NO: 12718 - DNA, 471 bp, Artificial Sequence; identical to SEQ ID NO: 12717
  Description of Artificial Sequence: Synthetic coding sequence

SEQ ID NO: 12719 - DNA, 831 bp, Artificial Sequence
  Description of Artificial Sequence: Synthetic coding sequence
atgctgcagcaggacagcaacgacgacaccgaggacgtgagcctgttcgacgccgaggaggagaccaccaacagacccagaaaggccaagatcagacaccccgtggccagcttcttccacctgttcttcagagtgagcgccatcatcgtgtgcctgctgtgcgagctgctgagcagcagcttcatcacctgcatggtgaccatcatcctgctgctgagctgcgacttctgggccgtgaagaacgtgaccggcagactgatggtgggcctgagatggtggaaccacatcgacgaggacggcaagagccactgggtgttcgagagcagaaaggagagcagccaggagaacaagaccgtgagcgaggccgagagcagaatcttctggctgggcctgatcgcctgcagcgtgctgtgggtgatcttcgccttcagcgccctgttcagcttcaccgtgaagtggctgagaagaagcagacacatcgcccagaccggcctgaaggtgctgggcagcagagacccccccgccagcgccttccagagcgccggcatcaccggcgtgagcagatgccccggccaccccagcagaaagttccaccaggtggacatcaacagcttcaccagaatcaccgacagagccctgtactggaagcccgcccccagactgagcagcccccccctgagagccgcccccggcaactgccagcagatggcccccgccagactgttcctgagcctgagactgtgggcctggagaggcggcggcgagagccccaacagcagaggcaccggcgagcccggccccaagttccacctggccagcggcatgcactag

SEQ ID NO: 12720 - DNA, 1419 bp, Artificial Sequence
  Description of Artificial Sequence: Synthetic coding sequence
atggaccacggcggcgtgggcccctacgagctgggcatggagcactgcgagaagttcgagatcagcgagaccagcgtgaacagaggccccgagaagatcagacccgagtgcttcgagctgctgagagtgctgggcaagggcggctacggcaaggtgttccaggtgagaaaggtgaccggcgccaacaccggcaagatcttcgccatgaaggtgctgaagaaggccatgatcgtgagaaacgccaaggacaccgcccacaccaaggccgagagaaacatcctggaggaggtgaagcaccccttcatcgtggacctgatctacgccttccagaccggcggcaagctgtacctgatcctggagtacctgagcggcggcgagctgttcatgcagctggagagagagggcatcttcatggaggacaccgcctgcttctacctggccgagatcagcatggccctgggccacctgcaccagaagggcatcatctacagagacctgaagcccgagaacatcatgctgaaccaccagggccacgtgaagctgaccgacttcggcctgtgcaaggagagcatccacgacggcaccgtgacccacaccttctgcggcaccatcgagtacatggcccccgagatcctgatgagaagcggccacaacagagccgtggactggtggagcctgggcgccctgatgtacgacatgctgaccggcgccccccccttcaccggcgagaacagaaagaagaccatcgacaagatcctgaagtgcaagctgaacctgcccccctacctgacccaggaggccagagacctgctgaagaagctgctgaagagaaacgccgccagcagactgggcgccggccccggcgacgccggcgaggtgcaggcccaccccttcttcagacacatcaactgggaggagctgctggccagaaaggtggagccccccttcaagcccctgctgcagagcgaggaggacgtgagccagttcgacagcaagttcaccagacagacccccgtggacagccccgacgacagcaccctgagcgagagcgccaaccaggtgttcctgggcttcacctacgtggcccccagcgtgctggagagcgtgaaggagaagttcagcttcgagcccaagatcagaagccccagaagattcatcggcagccccagaacccccgtgagccccgtgaagttcagccccggcgacttctggggcagaggcgccagcgccagcaccgccaacccccagacccccgtggagtaccccatggagaccagcggcatcgagcagatggacgtgaccatgagcggcgaggccagcgcccccctgcccatcagacagcccaacagcggcccctacaagaagcaggccttccccatgatcagcaagagacccgagcacctgagaatgaacctgtag

SEQ ID NO: 12721 - DNA, 1356 bp, Artificial Sequence
  Description of Artificial Sequence: Synthetic coding sequence
atgagaagaagaagaagaagagacggcttctaccccgcccccgacttcagagacagagaggccgaggacatggccggcgtgttcgacatcgacctggaccagcccgaggacgccggcagcgaggacgagctggaggagggcggccagctgaacgagagcatggaccacggcggcgtgggcccctacgagctgggcatggagcactgcgagaagttcgagatcagcgagaccagcgtgaacagaggccccgagaagatcagacccgagtgcttcgagctgctgagagtgctgggcaagggcggctacggcaaggtgttccaggtgagaaaggtgaccggcgccaacaccggcaagatcttcgccatgaaggtgctgaagaaggccatgatcgtgagaaacgccaaggacaccgcccacaccaaggccgagagaaacatcctggaggaggtgaagcaccccttcatcgtggacctgatctacgccttccagaccggcggcaagctgtacctgatcctggagtacctgagcggcggcgagctgttcatgcagctggagagagagggcatcttcatggaggacaccgcctgcttctacctggccgagatcagcatggccctgggccacctgcaccagaagggcatcatctacagagacctgaagcccgagaacatcatgctgaaccaccagggccacgtgaagctgaccgacttcggcctgtgcaaggagagcatccacgacggcaccgtgacccacaccttctgcggcaccatcgagtacatggcccccgagatcctgatgagaagcggccacaacagagccgtggactggtggagcctgggcgccctgatgtacgacatgctgaccggcgccccccccttcaccggcgagaacagaaagaagaccatcgacaagatcctgaagtgcaagctgaacctgcccccctacctgacccaggaggccagagacctgctgaagaagctgctgaagagaaacgccgccagcagactgggcgccggccccggcgacgccggcgaggtgcaggcccaccccttcttcagacacatcaactgggaggagctgctggccagaaaggtggagccccccttcaagcccctgctgcagagcgaggaggacgtgagccagttcgacagcaagttcaccagacagacccccgtggacagccccgacgacagcaccctgagcgagagcgccaaccaggtgttcctgggcttcacctacgtggcccccagcgtgctggagagcgtgaaggagaagttcagcttcgagcccaagatcagaagccccagaagattcatcggcagccccagaacccccgtgagcaccgccatgtgctag

SEQ ID NO: 12722 - DNA, 1509 bp, Artificial Sequence
  Description of Artificial Sequence: Synthetic coding sequence
atgagaagaagaagaagaagagacggcttctaccccgcccccgacttcagagacagagaggccgaggacatggccggcgtgttcgacatcgacctggaccagcccgaggacgccggcagcgaggacgagctggaggagggcggccagctgaacgagagcatggaccacggcggcgtgggcccctacgagctgggcatggagcactgcgagaagttcgagatcagcgagaccagcgtgaacagaggccccgagaagatcagacccgagtgcttcgagctgctgagagtgctgggcaagggcggctacggcaaggccatgatcgtgagaaacgccaaggacaccgcccacaccaaggccgagagaaacatcctggaggaggtgaagcaccccttcatcgtggacctgatctacgccttccagaccggcggcaagctgtacctgatcctggagtacctgagcggcggcgagctgttcatgcagctggagagagagggcatcttcatggaggacaccgcctgcttctacctggccgagatcagcatggccctgggccacctgcaccagaagggcatcatctacagagacctgaagcccgagaacatcatgctgaaccaccagggccacgtgaagctgaccgacttcggcctgtgcaaggagagcatccacgacggcaccgtgacccacaccttctgcggcaccatcgagtacatggcccccgagatcctgatgagaagcggccacaacagagccgtggactggtggagcctgggcgccctgatgtacgacatgctgaccggcgccccccccttcaccggcgagaacagaaagaagaccatcgacaagatcctgaagtgcaagctgaacctgcccccctacctgacccaggaggccagagacctgctgaagaagctgctgaagagaaacgccgccagcagactgggcgccggccccggcgacgccggcgaggtgcaggcccaccccttcttcagacacatcaactgggaggagctgctggccagaaaggtggagccccccttcaagcccctgctgcagagcgaggaggacgtgagccagttcgacagcaagttcaccagacagacccccgtggacagccccgacgacagcaccctgagcgagagcgccaaccaggtgttcctgggcttcacctacgtggcccccagcgtgctggagagcgtgaaggagaagttcagcttcgagcccaagatcagaagccccagaagattcatcggcagccccagaacccccgtgagccccgtgaagttcagccccggcgacttctggggcagaggcgccagcgccagcaccgccaacccccagacccccgtggagtaccccatggagaccagcggcatcgagcagatggacgtgaccatgagcggcgaggccagcgcccccctgcccatcagacagcccaacagcggcccctacaagaagcaggccttccccatgatcagcaagagacccgagcacctgagaatgaacctgtag

SEQ ID NO: 12723 - DNA, 1932 bp, Artificial Sequence
  Description of Artificial Sequence: Synthetic coding sequence
atgaaggtgctgaagaaggccaccctgaaggtgagagacagagtgagaaccaagatggagagagacatcctggccgacgtgaaccaccccttcgtggtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctgggcctggaccacctgcacagcctgggcatcatctacagagacctgaagcccgagaacatcctgctggacgaggagggccacatcaagctgaccgacttcggcctgagcaaggaggccatcgaccacgagaagaaggcctacagcttctgcggcaccgtggagtacatggcccccgaggtggtgaacagacagggccacagccacagcgccgactggtggagctacggcgtgctgatgttcgagatgctgaccggcagcctgcccttccagggcaaggacagaaaggagaccatgaccctgatcctgaaggccaagctgggcatgccccagttcctgagcaccgaggcccagagcctgctgagagccctgttcaagagaaaccccgccaacagactgggcagcggccccgacggcgccgaggagatcaagagacacgtgttctacagcaccatcgactggaacaagctgtacagaagagagatcaagccccccttcaagcccgccgtggcccagcccgacgacaccttctacttcgacaccgagttcaccagcagaacccccaaggacagccccggcatcccccccagcgccggcgcccaccagctgttcagaggcttcagcttcgtggccaccggcctgatggaggacgacggcaagcccagagccccccaggcccccctgcacagcgtggtgcagcagctgcacggcaagaacctggtgttcagcgacggctacgtggtgaaggagaccatcggcgtgggcagctacagcgagtgcaagagatgcgtgcacaaggccaccaacatggagtacgccgtgaaggtgatcgacaagagcaagagagaccccagcgaggagatcgagatcctgctgagatacggccagcaccccaacatcatcaccctgaaggacgtgtacgacgacggcaagcacgtgtacctggtgaccgagctgatgagaggcggcgagctgctggacaagatcctgagacagaagttcttcagcgagagagaggccagcttcgtgctgcacaccatcggcaagaccgtggagtacctgcacagccagggcgtggtgcacagagacctgaagcccagcaacatcctgtacgtggacgagagcggcaaccccgagtgcctgagaatctgcgacttcggcttcgccaagcagctgagagccgagaacggcctgctgatgaccccctgctacaccgccaacttcgtggcccccgaggtgctgaagagacagggctacgacgagggctgcgacatctggagcctgggcatcctgctgtacaccatgctggccggctacacccccttcgccaacggccccagcgacacccccgaggagatcctgaccagaatcggcagcggcaagttcaccctgagcggcggcaactggaacaccgtgagcgagaccgccaaggacctggtgagcaagatgctgcacgtggacccccaccagagactgaccgccaagcaggtgctgcagcacccctgggtgacccagaaggacaagctgccccagagccagctgagccaccaggacctgcagctggtgaagggcgccatggccgccacctacagcgccctgaacagcagcaagcccaccccccagctgaagcccatcgagagcagcatcctggcccagagaagagtgagaaagctgcccagcaccaccctgtag

SEQ ID NO: 12724 - DNA, 687 bp, Artificial Sequence
  Description of Artificial Sequence: Synthetic coding sequence
atgccccagttcctgagcaccgaggcccagagcctgctgagagccctgttcaagagaaaccccgccaacagactgggcagcggccccgacggcgccgaggagatcaagagacacgtgttctacagcaccatcgactggaacaagctgtacagaagagagatcaagccccccttcaagcccgccgtggcccagcccgacgacaccttctacttcgacaccgagttcaccagcagaacccccaaggacagccccggcatcccccccagcgccggcgcccaccagctgttcagaggcttcagcttcgtggccaccggcctgatggaggacgacggcaagcccagagccccccaggcccccctgcacagcgtggtgcaggtgatcgacaagagcaagagagaccccagcgaggagatcgagatcctgctgagatacggccagcaccccaacatcatcaccctgaaggacgtgtacgacgacggcaagcacgtgtacctggtgaccgagctgatgagaggcggcgagctgctggacaagatcctgagacagaagttcttcagcgagagagaggccagcttcgtgctgcacaccatcggcaagaccgtggagtacctgcacagccagggcgtggtgcacagagacctgaagcccagcaacatcctgtacgtggacgagagcggcaacccctag

SEQ ID NO: 12725 - DNA, 2208 bp, Artificial Sequence
  Description of Artificial Sequence: Synthetic coding sequence
atgcccctggcccagctgaaggagccctggcccctgatggagctggtgcccctggaccccgagaacggccagaccagcggcgaggaggccggcctgcagcccagcaaggacgagggcgtgctgaaggagatcagcatcacccaccacgtgaaggccggcagcgagaaggccgaccccagccacttcgagctgctgaaggtgctgggccagggcagcttcggcaaggtgttcctggtgagaaaggtgaccagacccgacagcggccacctgtacgccatgaaggtgctgaagaaggccaccctgaaggtgagagacagagtgagaaccaagatggagagagacatcctggccgacgtgaaccaccccttcgtggtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctgggcctggaccacctgcacagcctgggcatcatctacagagacctgaagcccgagaacatcctgctggacgaggagggccacatcaagctgaccgacttcggcctgagcaaggaggccatcgaccacgagaagaaggcctacagcttctgcggcaccgtggagtacatggcccccgaggtggtgaacagacagggccacagccacagcgccgactggtggagctacggcgtgctgatgttcgagatgctgaccggcagcctgcccttccagggcaaggacagaaaggagaccatgaccctgatcctgaaggccaagctgggcatgccccagttcctgagcaccgaggcccagagcctgctgagagccctgttcaagagaaaccccgccaacagactgggcagcggccccgacggcgccgaggagatcaagagacacgtgttctacagcaccatcgactggaacaagctgtacagaagagagatcaagccccccttcaagcccgccgtggcccagcccgacgacaccttctacttcgacaccgagttcaccagcagaacccccaaggacagccccggcatcccccccagcgccggcgcccaccagctgttcagaggcttcagcttcgtggccaccggcctgatggaggacgacggcaagcccagagccccccaggcccccctgcacagcgtggtgcagcagctgcacggcaagaacctggtgttcagcgacggctacgtggtgaaggagaccatcggcgtgggcagctacagcgagtgcaagagatgcgtgcacaaggccaccaacatggagtacgccgtgaaggtgatcgacaagagcaagagagaccccagcgaggagatcgagatcctgctgagatacggccagcaccccaacatcatcaccctgaaggacgtgtacgacgacggcaagcacgtgtacctggtgaccgagctgatgagaggcggcgagctgctggacaagatcctgagacagaagttcttcagcgagagagaggccagcttcgtgctgcacaccatcggcaagaccgtggagtacctgcacagccagggcgtggtgcacagagacctgaagcccagcaacatcctgtacgtggacgagagcggcaaccccgagtgcctgagaatctgcgacttcggcttcgccaagcagctgagagccgagaacggcctgctgatgaccccctgctacaccgccaacttcgtggcccccgaggtgctgaagagacagggctacgacgagggctgcgacatctggagcctgggcatcctgctgtacaccatgctggccggctacacccccttcgccaacggccccagcgacacccccgaggagatcctgaccagaatcggcagcggcaagttcaccctgagcggcggcaactggaacaccgtgagcgagaccgccaaggacctggtgagcaagatgctgcacgtggacccccaccagagactgaccgccaagcaggtgctgcagcacccctgggtgacccagaaggacaagctgccccagagccagctgagccaccaggacctgcagctggtgaagggcgccatggccgccacctacagcgccctgaacagcagcaagcccaccccccagctgaagcccatcgagagcagcatcctggcccagagaagagtgagaaagctgcccagcaccaccctgtag

SEQ ID NO: 12726 - DNA, 501 bp, Artificial Sequence
  Description of Artificial Sequence: Synthetic coding sequence
gcccagcccgacgacaccttctacttcgacaccgagttcaccagcagaacccccaaggacagccccggcatcccccccagcgccggcgcccaccagctgttcagaggcttcagcttcgtggccaccggcctgatggaggacgacggcaagcccagagccccccaggcccccctgcacagcgtggtgcaggtgatcgacaagagcaagagagaccccagcgaggagatcgagatcctgctgagatacggccagcaccccaacatcatcaccctgaaggacgtgtacgacgacggcaagcacgtgtacctggtgaccgagctgatgagaggcggcgagctgctggacaagatcctgagacagaagttcttcagcgagagagaggccagcttcgtgctgcacaccatcggcaagaccgtggagtacctgcacagccagggcgtggtgcacagagacctgaagcccagcaacatcctgtacgtggacgagagcggcaacccctag

SEQ ID NO: 12727 - DNA, 2160 bp, Artificial Sequence
  Description of Artificial Sequence: Synthetic coding sequence
atgcagacccccgccgacttccccagagtggagagagacctggtgccctgccccagaaaggacgagggcgtgctgaaggagatcagcatcacccaccacgtgaaggccggcagcgagaaggccgaccccagccacttcgagctgctgaaggtgctgggccagggcagcttcggcaaggtgttcctggtgagaaaggtgaccagacccgacagcggccacctgtacgccatgaaggtgctgaagaaggccaccctgaaggtgagagacagagtgagaaccaagatggagagagacatcctggccgacgtgaaccaccccttcgtggtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctgggcctggaccacctgcacagcctgggcatcatctacagagacctgaagcccgagaacatcctgctggacgaggagggccacatcaagctgaccgacttcggcctgagcaaggaggccatcgaccacgagaagaaggcctacagcttctgcggcaccgtggagtacatggcccccgaggtggtgaacagacagggccacagccacagcgccgactggtggagctacggcgtgctgatgttcgagatgctgaccggcagcctgcccttccagggcaaggacagaaaggagaccatgaccctgatcctgaaggccaagctgggcatgccccagttcctgagcaccgaggcccagagcctgctgagagccctgttcaagagaaaccccgccaacagactgggcagcggccccgacggcgccgaggagatcaagagacacgtgttctacagcaccatcgactggaacaagctgtacagaagagagatcaagccccccttcaagcccgccgtggcccagcccgacgacaccttctacttcgacaccgagttcaccagcagaacccccaaggacagccccggcatcccccccagcgccggcgcccaccagctgttcagaggcttcagcttcgtggccaccggcctgatggaggacgacggcaagcccagagccccccaggcccccctgcacagcgtggtgcagcagctgcacggcaagaacctggtgttcagcgacggctacgtggtgaaggagaccatcggcgtgggcagctacagcgagtgcaagagatgcgtgcacaaggccaccaacatggagtacgccgtgaaggtgatcgacaagagcaagagagaccccagcgaggagatcgagatcctgctgagatacggccagcaccccaacatcatcaccctgaaggacgtgtacgacgacggcaagcacgtgtacctggtgaccgagctgatgagaggcggcgagctgctggacaagatcctgagacagaagttcttcagcgagagagaggccagcttcgtgctgcacaccatcggcaagaccgtggagtacctgcacagccagggcgtggtgcacagagacctgaagcccagcaacatcctgtacgtggacgagagcggcaaccccgagtgcctgagaatctgcgacttcggcttcgccaagcagctgagagccgagaacggcctgctgatgaccccctgctacaccgccaacttcgtggcccccgaggtgctgaagagacagggctacgacgagggctgcgacatctggagcctgggcatcctgctgtacaccatgctggccggctacacccccttcgccaacggccccagcgacacccccgaggagatcctgaccagaatcggcagcggcaagttcaccctgagcggcggcaactggaacaccgtgagcgagaccgccaaggacctggtgagcaagatgctgcacgtggacccccaccagagactgaccgccaagcaggtgctgcagcacccctgggtgacccagaaggacaagctgccccagagccagctgagccaccaggacctgcagctggtgaagggcgccatggccgccacctacagcgccctgaacagcagcaagcccaccccccagctgaagcccatcgagagcagcatcctggcccagagaagagtgagaaagctgcccagcaccaccctgtag

SEQ ID NO: 12728 - DNA, 2202 bp, Artificial Sequence
  Description of Artificial Sequence: Synthetic coding sequence
atggacctgagcatgaagaagttcgccgtgagaagattcttcagcgtgtacctgagaagaaagagcagaagcaagagcagcagcctgagcagactggaggaggagggcgtggtgaaggagatcgacatcagccaccacgtgaaggagggcttcgagaaggccgaccccagccagttcgagctgctgaaggtgctgggccagggcagctacggcaaggtgttcctggtgagaaaggtgaagggcagcgacgccggccagctgtacgccatgaaggtgctgaagaaggccaccctgaaggtgagagacagagtgagaagcaagatggagagagacatcctggccgaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagatcaccgacttcggcctgagcaaggaggccatcgaccacgacaagagagcctacagcttctgcggcaccatcgagtacatggcccccgaggtggtgaacagaagaggccacacccagagcgccgactggtggagcttcggcgtgctgatgttcgagatgctgaccggcagcctgcccttccagggcaaggacagaaaggagaccatggccctgatcctgaaggccaagctgggcatgccccagttcctgagcggcgaggcccagagcctgctgagagccctgttcaagagaaacccctgcaacagactgggcgccggcatcgacggcgtggaggagatcaagagacaccccttcttcgtgaccatcgactggaacaccctgtacagaaaggagatcaagccccccttcaagcccgccgtgggcagacccgaggacaccttccacttcgaccccgagttcaccgccagaacccccaccgacagccccggcgtgccccccagcgccaacgcccaccacctgttcagaggcttcagcttcgtggccagcagcctgatccaggagcccagccagcaggacctgcacaaggtgcccgtgcaccccatcgtgcagcagctgcacggcaacaacatccacttcaccgacggctacgagatcaaggaggacatcggcgtgggcagctacagcgtgtgcaagagatgcgtgcacaaggccaccgacaccgagtacgccgtgaagatcatcgacaagagcaagagagaccccagcgaggagatcgagatcctgctgagatacggccagcaccccaacatcatcaccctgaaggacgtgtacgacgacggcaagttcgtgtacctggtgatggagctgatgagaggcggcgagctgctggacagaatcctgagacagagatacttcagcgagagagaggccagcgacgtgctgtgcaccatcaccaagaccatggactacctgcacagccagggcgtggtgcacagagacctgaagcccagcaacatcctgtacagagacgagagcggcagccccgagagcatcagagtgtgcgacttcggcttcgccaagcagctgagagccggcaacggcctgctgatgaccccctgctacaccgccaacttcgtggcccccgaggtgctgaagagacagggctacgacgccgcctgcgacatctggagcctgggcatcctgctgtacaccatgctggccggcttcacccccttcgccaacggccccgacgacacccccgaggagatcctggccagaatcggcagcggcaagtacgccctgagcggcggcaactgggacagcatcagcgacgccgccaaggacgtggtgagcaagatgctgcacgtggacccccaccagagactgaccgccatgcaggtgctgaagcacccctgggtggtgaacagagagtacctgagccccaaccagctgagcagacaggacgtgcacctggtgaagggcgccatggccgccacctacttcgccctgaacagaaccccccaggcccccagactggagcccgtgctgagcagcaacctggcccagagaagaggcatgaagagactgaccagcaccagactgtag

SEQ ID NO: 12729 - DNA, 501 bp, Artificial Sequence
  Description of Artificial Sequence: Synthetic coding sequence
atgttcaccgaggaggacgtgaagttctacctggccgagctggccctggccctggaccacctgcacagcctgggcatcatctacagagacctgaagcccgagaacatcctgctggacgaggagggccacatcaagatcaccgacttcggcctgagcaaggaggccatcgaccacgacaagagagcctacagcttctgcggcaccatcgagtacatggcccccgaggtggtgaacagaagaggccacacccagagcgccgactggtggagcttcggcgtgctgatgttcgagatgctgaccggcagcctgcccttccagggcaaggacagaaaggagaccatggccctgatcctgaaggccaagctgggcatgccccagttcctgagcggcgaggcccagagcctgctgagagccctgttcaagagaaacccctgcaacagactgggcgagaagaccgccctgtgccccagagtgagctgcagcagactgctgggcttctag

SEQ ID NO: 12730 - DNA, 1935 bp, Artificial Sequence
  Description of Artificial Sequence: Synthetic coding sequence
atgaaggtgctgaagaaggccaccctgaaggtgagagacagagtgagaagcaagatggagagagacatcctggccgaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagatcaccgacttcggcctgagcaaggaggccatcgaccacgacaagagagcctacagcttctgcggcaccatcgagtacatggcccccgaggtggtgaacagaagaggccacacccagagcgccgactggtggagcttcggcgtgctgatgttcgagatgctgaccggcagcctgcccttccagggcaaggacagaaaggagaccatggccctgatcctgaaggccaagctgggcatgccccagttcctgagcggcgaggcccagagcctgctgagagccctgttcaagagaaacccctgcaacagactgggcgccggcatcgacggcgtggaggagatcaagagacaccccttcttcgtgaccatcgactggaacaccctgtacagaaaggagatcaagccccccttcaagcccgccgtgggcagacccgaggacaccttccacttcgaccccgagttcaccgccagaacccccaccgacagccccggcgtgccccccagcgccaacgcccaccacctgttcagaggcttcagcttcgtggccagcagcctgatccaggagcccagccagcaggacctgcacaaggtgcccgtgcaccccatcgtgcagcagctgcacggcaacaacatccacttcaccgacggctacgagatcaaggaggacatcggcgtgggcagctacagcgtgtgcaagagatgcgtgcacaaggccaccgacaccgagtacgccgtgaagatcatcgacaagagcaagagagaccccagcgaggagatcgagatcctgctgagatacggccagcaccccaacatcatcaccctgaaggacgtgtacgacgacggcaagttcgtgtacctggtgatggagctgatgagaggcggcgagctgctggacagaatcctgagacagagatacttcagcgagagagaggccagcgacgtgctgtgcaccatcaccaagaccatggactacctgcacagccagggcgtggtgcacagagacctgaagcccagcaacatcctgtacagagacgagagcggcagccccgagagcatcagagtgtgcgacttcggcttcgccaagcagctgagagccggcaacggcctgctgatgaccccctgctacaccgccaacttcgtggcccccgaggtgctgaagagacagggctacgacgccgcctgcgacatctggagcctgggcatcctgctgtacaccatgctggccggcttcacccccttcgccaacggccccgacgacacccccgaggagatcctggccagaatcggcagcggcaagtacgccctgagcggcggcaactgggacagcatcagcgacgccgccaaggacgtggtgagcaagatgctgcacgtggacccccaccagagactgaccgccatgcaggtgctgaagcacccctgggtggtgaacagagagtacctgagccccaaccagctgagcagacaggacgtgcacctggtgaagggcgccatggccgccacctacttcgccctgaacagaaccccccaggcccccagactggagcccgtgctgagcagcaacctggcccagagaagaggcatgaagagactgaccagcaccagactgtag

SEQ ID NO: 12731 - DNA, 1935 bp, Artificial Sequence; identical to SEQ ID NO: 12730
  Description of Artificial Sequence: Synthetic coding sequence

SEQ ID NO: 12732 - DNA, 2226 bp, Artificial Sequence
  Description of Artificial Sequence: Synthetic coding sequence
atgcccatcgcccagctgctggagctgtggaagaagatcgaggtggagcccatggagatcgagaccaccgaggaggacctgaacctggacgtggagcccaccaccgaggacaccgccgaggaggaggagggcgtggtgaaggagatcgacatcagccaccacgtgaaggagggcttcgagaaggccgaccccagccagttcgagctgctgaaggtgctgggccagggcagctacggcaaggtgttcctggtgagaaaggtgaagggcagcgacgccggccagctgtacgccatgaaggtgctgaagaaggccaccctgaaggtgagagacagagtgagaagcaagatggagagagacatcctggccgaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagatcaccgacttcggcctgagcaaggaggccatcgaccacgacaagagagcctacagcttctgcggcaccatcgagtacatggcccccgaggtggtgaacagaagaggccacacccagagcgccgactggtggagcttcggcgtgctgatgttcgagatgctgaccggcagcctgcccttccagggcaaggacagaaaggagaccatggccctgatcctgaaggccaagctgggcatgccccagttcctgagcggcgaggcccagagcctgctgagagccctgttcaagagaaacccctgcaacagactgggcgccggcatcgacggcgtggaggagatcaagagacaccccttcttcgtgaccatcgactggaacaccctgtacagaaaggagatcaagccccccttcaagcccgccgtgggcagacccgaggacaccttccacttcgaccccgagttcaccgccagaacccccaccgacagccccggcgtgccccccagcgccaacgcccaccacctgttcagaggcttcagcttcgtggccagcagcctgatccaggagcccagccagcaggacctgcacaaggtgcccgtgcaccccatcgtgcagcagctgcacggcaacaacatccacttcaccgacggctacgagatcaaggaggacatcggcgtgggcagctacagcgtgtgcaagagatgcgtgcacaaggccaccgacaccgagtacgccgtgaagatcatcgacaagagcaagagagaccccagcgaggagatcgagatcctgctgagatacggccagcaccccaacatcatcaccctgaaggacgtgtacgacgacggcaagttcgtgtacctggtgatggagctgatgagaggcggcgagctgctggacagaatcctgagacagagatacttcagcgagagagaggccagcgacgtgctgtgcaccatcaccaagaccatggactacctgcacagccagggcgtggtgcacagagacctgaagcccagcaacatcctgtacagagacgagagcggcagccccgagagcatcagagtgtgcgacttcggcttcgccaagcagctgagagccggcaacggcctgctgatgaccccctgctacaccgccaacttcgtggcccccgaggtgctgaagagacagggctacgacgccgcctgcgacatctggagcctgggcatcctgctgtacaccatgctggccggcttcacccccttcgccaacggccccgacgacacccccgaggagatcctggccagaatcggcagcggcaagtacgccctgagcggcggcaactgggacagcatcagcgacgccgccaaggacgtggtgagcaagatgctgcacgtggacccccaccagagactgaccgccatgcaggtgctgaagcacccctgggtggtgaacagagagtacctgagccccaaccagctgagcagacaggacgtgcacctggtgaagggcgccatggccgccacctacttcgccctgaacagaaccccccaggcccccagactggagcccgtgctgagcagcaacctggcccagagaagaggcatgaagagactgaccagcaccagactgtag

SEQ ID NO: 12733 - DNA, 516 bp, Artificial Sequence
  Description of Artificial Sequence: Synthetic coding sequence
atgcccatcgcccagctgctggagctgtggaagaagatcgaggtggagcccatggagatcgagaccaccgaggaggacctgaacctggacgtggagcccaccaccgaggacaccgccgaggagggcaagagcgacagcgccgcctgcaagaccaaggtggccggcagcgtggaggaggagggcgtggtgaaggagatcgacatcagccaccacgtgaaggagggcttcgagaaggccgaccccagccagttcgagctgctgaaggtgctgggccagggcagctacggcaaggtgttcctggtgagaaaggtgaagggcagcgacgccggccagctgtacgccatgaaggtgctgaagaaggccaccctgaaggtgagagacagagtgagaagcaagatggagagagacatcctggccgaggtgaaccaccccttcatcgtgaagctgcactacgccttccagaccgagggcaagctgtacctgatcctggacttcctgagaggcggcgacctgtag

SEQ ID NO: 12734 - DNA, 2277 bp, Artificial Sequence
  Description of Artificial Sequence: Synthetic coding sequence
atgcccatcgcccagctgctggagctgtggaagaagatcgaggtggagcccatggagatcgagaccaccgaggaggacctgaacctggacgtggagcccaccaccgaggacaccgccgaggagggcaagagcgacagcgccgcctgcaagaccaaggtggccggcagcgtggaggaggagggcgtggtgaaggagatcgacatcagccaccacgtgaaggagggcttcgagaaggccgaccccagccagttcgagctgctgaaggtgctgggccagggcagctacggcaaggtgttcctggtgagaaaggtgaagggcagcgacgccggccagctgtacgccatgaaggtgctgaagaaggccaccctgaaggtgagagacagagtgagaagcaagatggagagagacatcctggccgaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagatcaccgacttcggcctgagcaaggaggccatcgaccacgacaagagagcctacagcttctgcggcaccatcgagtacatggcccccgaggtggtgaacagaagaggccacacccagagcgccgactggtggagcttcggcgtgctgatgttcgagatgctgaccggcagcctgcccttccagggcaaggacagaaaggagaccatggccctgatcctgaaggccaagctgggcatgccccagttcctgagcggcgaggcccagagcctgctgagagccctgttcaagagaaacccctgcaacagactgggcgccggcatcgacggcgtggaggagatcaagagacaccccttcttcgtgaccatcgactggaacaccctgtacagaaaggagatcaagccccccttcaagcccgccgtgggcagacccgaggacaccttccacttcgaccccgagttcaccgccagaacccccaccgacagccccggcgtgccccccagcgccaacgcccaccacctgttcagaggcttcagcttcgtggccagcagcctgatccaggagcccagccagcaggacctgcacaaggtgcccgtgcaccccatcgtgcagcagctgcacggcaacaacatccacttcaccgacggctacgagatcaaggaggacatcggcgtgggcagctacagcgtgtgcaagagatgcgtgcacaaggccaccgacaccgagtacgccgtgaagatcatcgacaagagcaagagagaccccagcgaggagatcgagatcctgctgagatacggccagcaccccaacatcatcaccctgaaggacgtgtacgacgacggcaagttcgtgtacctggtgatggagctgatgagaggcggcgagctgctggacagaatcctgagacagagatacttcagcgagagagaggccagcgacgtgctgtgcaccatcaccaagaccatggactacctgcacagccagggcgtggtgcacagagacctgaagcccagcaacatcctgtacagagacgagagcggcagccccgagagcatcagagtgtgcgacttcggcttcgccaagcagctgagagccggcaacggcctgctgatgaccccctgctacaccgccaacttcgtggcccccgaggtgctgaagagacagggctacgacgccgcctgcgacatctggagcctgggcatcctgctgtacaccatgctggccggcttcacccccttcgccaacggccccgacgacacccccgaggagatcctggccagaatcggcagcggcaagtacgccctgagcggcggcaactgggacagcatcagcgacgccgccaaggacgtggtgagcaagatgctgcacgtggacccccaccagagactgaccgccatgcaggtgctgaagcacccctgggtggtgaacagagagtacctgagccccaaccagctgagcagacaggacgtgcacctggtgaagggcgccatggccgccacctacttcgccctgaacagaaccccccaggcccccagactggagcccgtgctgagcagcaacctggcccagagaagaggcatgaagagactgaccagcaccagactgtag

SEQ ID NO: 12735 - DNA, 888 bp, Artificial Sequence
  Description of Artificial Sequence: Synthetic coding sequence
atgagcggcgccctggacgtgctgcagatgaaggaggaggacgtgctgaagttcctggccgccggcacccacctgggcggcaccaacctggacttccagatggagcagtacatctacaagagaaagagcgacggcatctacatcatcaacctgaagagaacctgggagaagctgctgctggccgccagagccatcgtggccatcgagaaccccgccgacgtgagcgtgatcagcagcagaaacaccggccagagagccgtgctgaagttcgccgccgccaccggcgccacccccatcgccggcagattcacccccggcaccttcaccaaccagatccaggccgccttcagagagcccagactgctggtggtgaccgaccccagagccgaccaccagcccctgaccgaggccagctacgtgaacctgcccaccatcgccctgtgcaacaccgacagccccctgagatacgtggacatcgccatcccctgcaacaacaagggcgcccacagcgtgggcctgatgtggtggatgctggccagagaggtgctgagaatgagaggcaccatcagcagagagcacccctgggaggtgatgcccgacctgtacttctacagagaccccgaggagatcgagaaggaggagcaggccgccgccgagaaggccgtgaccaaggaggagttccagggcgagtggaccgcccccgcccccgagttcaccgccacccagcccgaggtggccgactggagcgagggcgtgcaggtgcccagcgtgcccatccagcagttccccaccgaggactggagcgcccagcccgccaccgaggactggagcgccgcccccaccgcccaggccaccgagtgggtgggcgccaccaccgactggagctag

SEQ ID NO: 12736 - DNA, 795 bp, Artificial Sequence
  Description of Artificial Sequence: Synthetic coding sequence
atgagcggcgccctggacgtgctgcagatgaaggaggaggacgtgctgaagttcctggccgccggcacccacctgggcggcaccaacctggacttccagatggagcagtacatctacaagagaaagagcgacggcatctacatcatcaacctgaagagaacctgggagaagctgctgctggccgccagagccatcgtggccatcgagaaccccgccgacgtgagcgtgatcagcagcagaaacaccggccagagagccgtgctgaagttcgccgccgccaccggcgccacccccatcgccggcagattcacccccggcaccttcaccaaccagatccaggccgccttcagagagcccagactgctggtggtgaccgaccccagagccgaccaccagcccctgaccgaggccagctacgtgaacctgcccaccatcgccctgtgcaacaccgacagccccctgagatacgtggacatcgccatcccctgcaacaacaagggcgcccacagcgtgggcctgatgtggtggatgctggccagagaggtgctgagaatgagaggcaccatcagcagagagcacccctgggaggtgatgcccgacctgtacttctacagagaccccgaggagatcgagaaggaggagcaggccgccgccgagaaggccgtgaccaaggaggagttccagggcgagtggaccgcccccgcccccgagttcaccgccacccagcccgaggtggccgactggagcgagggcgtgcaggtgcccagcgtgcccatccagcagttccccacctag

SEQ ID NO: 12737 - DNA, 1458 bp, Artificial Sequence
  Description of Artificial Sequence: Synthetic coding sequence
atgggcgagcccggcttcttcgtgaccggcgacagagccggcggcagaagctggtgcctgagaagagtgggcatgagcgccggctggctgctgctggaggacggctgcgaggtgaccgtgggcagaggcttcggcgtgacctaccagctggtgagcaagatctgccccctgatgatcagcagaaaccactgcgtgctgaagcagaaccccgagggccagtggaccatcatggacaacaagagcctgaacggcgtgtggctgaacagagccagactggagcccctgagagtgtacagcatccaccagggcgactacatccagctgggcgtgcccctggagaacaaggagaacgccgagtacgagtacgaggtgaccgaggaggactgggagaccatctacccctgcctgagccccaagaacgaccagatgatcgagaagaacaaggagctgagaaccaagagaaagttcagcctggacgagctggccggccccggcgccgagggccccagcaacctgaagagcaagatcaacaaggtgagctgcgagagcggccagcccgtgaagagccagggcaagggcgaggtggccagcacccccagcgacaacctggaccccaagctgaccgccctggagcccagcaagaccaccggcgcccccatctaccccggcttccccaaggtgaccgaggtgcaccacgagcagaaggccagcaacagcagcgccagccagagaagcctgcagatgttcaaggtgaccatgagcagaatcctgagactgaagatccagatgcaggagaagcacgaggccgtgatgaacgtgaagaagcagacccagaagggcaacagcaagaaggtggtgcagatggagcaggagctgcaggacctgcagagccagctgtgcgccgagcaggcccagcagcaggccagagtggagcagctggagaagaccttccaggaggaggagcagcacctgcagggcctggagatcgcccagggcgagaaggacctgaagcagcagctggcccaggccctgcaggagcactgggccctgatggaggagctgaacagaagcaagaaggacttcgaggccatcatccaggccaagaacaaggagctggagcagaccaaggaggagaaggagaagatgcaggcccagaaggaggaggtgctgagccacatgaacgacgtgctggagaacgagctgcagtgcatcatctgcagcgagtacttcatcgaggccgtgaccctgaactgcgcccacagcttctgcagctactgcatcaacgagtggatgaagagaaagatcgagtgccccatctgcagaaaggacatcaagagcaagacctacagcctggtgctggacaactgcatcaacaagatggtgaacaacctgagcagcgaggtgaaggagagaagaatcgtgctgatcagagagagaaaggccaagagactgttctag

SEQ ID NO: 12738 - DNA, 297 bp, Artificial Sequence
  Description of Artificial Sequence: Synthetic coding sequence
atgggcgagcccggcttcttcgtgaccggcgacagagccggcggcagaagctggtgcctgagaagagtgggcatgagcgccggctggctgctgctggaggacggctgcgaggtgaccgtgggcagaggcttcggcgtgacctaccagctggtgagcaagatctgccccctgatgatcagcagaaaccactgcgtgctgaagcagaaccccgagggccagtggaccatcatggacaacaagagcttccccagcgagaaggccgaggacttcaccgccgccggcgagagattcctgtag

SEQ ID NO: 12739 - DNA, 1347 bp, Artificial Sequence
  Description of Artificial Sequence: Synthetic coding sequence
atgggcgagcccggcttcttcgtgaccggcgacagagccggcggcagaagctggtgcctgagaagagtgggcatgagcgccggctggctgctgctggaggacggctgcgaggtgaccgtgggcagaggcttcggcgtgacctaccagctggtgagcaagatctgccccctgatgatcagcagaaaccactgcgtgctgaagcagaaccccgagggccagtggaccatcatggacaacaagagcctgaacggcgtgtggctgaacagagccagactggagcccctgagagtgtacagcatccaccagggcgactacatccagctgggcgtgcccctggagaacaaggagaacgccgagtacgagtacgaggtgaccgaggaggactgggagaccatctacccctgcctgagccccaagaacgaccagatgatcgagaagaacaaggagctgagaaccaagagaaagttcagcctggacgagctggccggccccggcgccgagggccccagcaacctgaagagcaagatcaacaaggtgagctgcgagagcggccagcccgtgaagagccagggcaagggcgaggtggccagcacccccagcgacaacctggaccccaagctgaccgccctggagcccagcaagaccaccggcgcccccatctaccccggcttccccaaggtgaccgaggtgcaccacgagcagaaggccagcaacagcagcgccagccagagaagcctgcagatgttcaaggtgaccatgagcagaatcctgagactgaagatccagatgcaggagaagcacgaggccgtgatgaacgtgaagaagcagacccagaagggcaacagcaagaaggtggtgcagatggagcaggagctgcaggacctgcagagccagctgtgcgccgagcaggcccagcagcaggccagagtggagcagctggagaagaccttccaggaggaggagcagcacctgcagggcctggagatcgcccagggcgagaaggacctgaagcagcagctggcccaggccctgcaggagcactgggccctgatggaggagctgaacagaagcaagaaggacttcgaggccatcatccaggccaagaacaaggagctggagcagaccaaggaggagaaggagaagatgcaggcccagaaggaggaggtgctgagccacatgaacgacgtgctggagaacgagctgcagtgcatcatctgcagcgagtacttcatcgagcagagagactgcagcgaggacagagccctgagagccttcgagagactgcccggcagcgccagcctgagatggagcggcggcttcagcctggccgtgacccccctgctgtag

SEQ ID NO: 12740 - DNA, 1593 bp, Artificial Sequence
  Description of Artificial Sequence: Synthetic coding sequence
atggccgacgacatcgacatcgaggccatgctggaggccccctacaagaaggacgagaacaagctgagcagcgccaacggccacgaggagagaagcaagaagagaaagaagagcaagagcagaagcagaagccacgagagaaagagaagcaagagcaaggagagaaagagaagcagagacagagagagaaagaagagcaagagcagagagagaaagagaagcagaagcaaggagagaagaagaagcagaagcagaagcagagacagaagattcagaggcagatacagaagcccctacagcggccccaagttcaacagcgccatcagaggcaagatcggcctgccccacagcatcaagctgagcagaagaagaagcagaagcaagagccccttcagaaaggacaagagccccgtgagagagcccatcgacaacctgacccccgaggagagagacgccagaaccgtgttctgcatgcagctggccgccagaatcagacccagagacctggaggagttcttcagcaccgtgggcaaggtgagagacgtgagaatgatcagcgacagaaacagcagaagaagcaagggcatcgcctacgtggagttcgtggacgtgagcagcgtgcccctggccatcggcctgaccggccagagagtgctgggcgtgcccatcatcgtgcaggccagccaggccgagaagaacagagccgccgccatggccaacaacctgcagaagggcagcgccggccccatgagactgtacgtgggcagcctgcacttcaacatcaccgaggacatgctgagaggcatcttcgagcccttcggcagaatcgagagcatccagctgatgatggacagcgagaccggcagaagcaagggctacggcttcatcaccttcagcgacagcgagtgcgccaagaaggccctggagcagctgaacggcttcgagctggccggcagacccatgaaggtgggccacgtgaccgagagaaccgacgccagcagcgccagcagcttcctggacagcgacgagctggagagaaccggcatcgacctgggcaccaccggcagactgcagctgatggccagactggccgagggcaccggcctgcagatcccccccgccgcccagcaggccctgcagatgagcggcagcctggccttcggcgccgtggccgagttcagcttcgtgatcgacctgcagaccagactgagccagcagaccgaggccagcgccctggccgccgccgccagcgtgcagcccctggccacccagtgcttccagctgagcaacatgttcaacccccagaccgaggaggaggtgggctgggacaccgagatcaaggacgacgtgatcgaggagtgcaacaagcacggcggcgtgatccacatctacgtggacaagaacagcgcccagggcaacgtgtacgtgaagtgccccagcatcgccgccgccatcgccgccgtgaacgccctgcacggcagatggttcgccggcaagatgatcaccgccgcctacgtgcccctgcccacctaccacaacctgttccccgacagcatgaccgccacccagctgctggtgcccagcagaagatag

SEQ ID NO: 12741 - DNA, 1272 bp, Artificial Sequence
  Description of Artificial Sequence: Synthetic coding sequence
atggccgacgacatcgacatcgaggccatgctggaggccccctacaagaaggacgagaacaagctgagcagcgccaacggccacgaggagagaagcaagaagagaaagaagagcaagagcagaagcagaagccacgagagaaagagaagcaagagcaaggagagaaagagaagcagagacagagagagaaagaagagcaagagcagagagagaaagagaagcagaagcaaggagagaagaagaagcagaagcagaagcagagacagaagattcagaggcagatacagaagcccctacagcggccccaagttcaacagcgccatcagaggcaagatcggcctgccccacagcatcaagctgagcagaagaagaagcagaagcaagagccccttcagaaaggacaagagccccgtgagagagcccatcgacaacctgacccccgaggagagagacgccagaaccgtgttctgcatgcagctggccgccagaatcagacccagagacctggaggagttcttcagcaccgtgggcaaggtgagagacgtgagaatgatcagcgacagaaacagcagaagaagcaagggcatcgcctacgtggagttcgtggacgtgagcagcgtgcccctggccatcggcctgaccggccagagagtgctgggcgtgcccatcatcgtgcaggccagccaggccgagaagaacagagccgccgccatggccaacaacctgcagaagggcagcgccggccccatgagactgtacgtgggcagcctgcacttcaacatcaccgaggacatgctgagaggcatcttcgagcccttcggcagaatcgagagcatccagctgatgatggacagcgagaccggcagaagcaagggctacggcttcatcaccttcagcgacagcgagtgcgccaagaaggccctggagcagctgaacggcttcgagctggccggcagacccatgaaggtgggccacgtgaccgagagaaccgacgccagcagcgccagcagcttcctggacagcgacgagctggagagaaccggcatcgacctgggcaccaccggcagactgcagctgatggccagactggccgagggcaccggcctgcagatcccccccgccgcccagcaggccctgcagatgagcggcagcctggccttcggcgccgtggccgacctgcagaccagactgagccagcagaccgaggccctgttcgtgatcatgttctggaacgagatctggagcgacaacatgatcaccctgcagctgtag

SEQ ID NO: 12742 - DNA, 1575 bp, Artificial Sequence
  Description of Artificial Sequence: Synthetic coding sequence
atggccgacgacatcgacatcgaggccatgctggaggccccctacaagaaggacgagaacaagctgagcagcgccaacggccacgaggagagaagcaagaagagaaagaagagcaagagcagaagcagaagccacgagagaaagagaagcaagagcaaggagagaaagagaagcagagacagagagagaaagaagagcaagagcagagagagaaagagaagcagaagcaaggagagaagaagaagcagaagcagaagcagagacagaagattcagaggcagatacagaagcccctacagcggccccaagttcaacagcgccatcagaggcaagatcggcctgccccacagcatcaagctgagcagaagaagaagcagaagcaagagccccttcagaaaggacaagagccccgtgagagagcccatcgacaacctgacccccgaggagagagacgccagaaccgtgttctgcatgcagctggccgccagaatcagacccagagacctggaggagttcttcagcaccgtgggcaaggtgagagacgtgagaatgatcagcgacagaaacagcagaagaagcaagggcatcgcctacgtggagttcgtggacgtgagcagcgtgcccctggccatcggcctgaccggccagagagtgctgggcgtgcccatcatcgtgcaggccagccaggccgagaagaacagagccgccgccatggccaacaacctgcagaagggcagcgccggccccatgagactgtacgtgggcagcctgcacttcaacatcaccgaggacatgctgagaggcatcttcgagcccttcggcagaatcgagagcatccagctgatgatggacagcgagaccggcagaagcaagggctacggcttcatcaccttcagcgacagcgagtgcgccaagaaggccctggagcagctgaacggcttcgagctggccggcagacccatgaaggtgggccacgtgaccgagagaaccgacgccagcagcgccagcagcttcctggacagcgacgagctggagagaaccggcatcgacctgggcaccaccggcagactgcagctgatggccagactggccgagggcaccggcctgcagatcccccccgccgcccagcaggccctgcagatgagcggcagcctggccttcggcgccgtggccgacctgcagaccagactgagccagcagaccgaggccagcgccctggccgccgccgccagcgtgcagcccctggccacccagtgcttccagctgagcaacatgttcaacccccagaccgaggaggaggtgggctgggacaccgagatcaaggacgacgtgatcgaggagtgcaacaagcacggcggcgtgatccacatctacgtggacaagaacagcgcccagggcaacgtgtacgtgaagtgccccagcatcgccgccgccatcgccgccgtgaacgccctgcacggcagatggttcgccggcaagatgatcaccgccgcctacgtgcccctgcccacctaccacaacctgttccccgacagcatgaccgccacccagctgctggtgcccagcagaagatag

SEQ ID NO: 12743 - DNA, 696 bp, Artificial Sequence
  Description of Artificial Sequence: Synthetic coding sequence
atggccgacgacatcgacatcgaggccatgctggaggccccctacaagaaggacgagaacaagctgagcagcgccaacggccacgaggagagaagcaagaagagaaagaagagcaagagcagaagcagaagccacgagagaaagagaagcaagagcaaggagagaaagagaagcagagacagagagagaaagaagagcaagagcagagagagaaagagaagcagaagcaaggagagaagaagaagcagaagcagaagcagagacagaagattcagaggcagatacagaagcccctacagcggccccaagttcaacagcgccatcagaggcaagatcggcctgccccacagcatcaagctgagaagaagaagcagaagcaagagccccttcagaaaggacaagagccccgtgagagagcccatcgacaacctgacccccgaggagagagacgccagaaccgtgttctgcatgcagctggccgccagaatcagacccagagacctggaggagttcttcagcaccgtgggcaaggtgagagacgtgagaatgatcagcgacagaaacagcagaagaagcaagggcatcgcctacgtggagttcgtggacgtgagcagcgtgcccctggccatcggcctgaccggccagagagtgctgggcgtgcccatcatcgtgcaggccagccaggccgagaagtag

SEQ ID NO: 12744 - DNA, 1122 bp, Artificial Sequence
  Description of Artificial Sequence: Synthetic coding sequence
atgcagctggccgccagaatcagacccagagacctggaggagttcttcagcaccgtgggcaaggtgagagacgtgagaatgatcagcgacagaaacagcagaagaagcaagggcatcgcctacgtggagttcgtggacgtgagcagcgtgcccctggccatcggcctgaccggccagagagtgctgggcgtgcccatcatcgtgcaggccagccaggccgagaagaacagagccgccgccatggccaacaacctgcagaagggcagcgccggccccatgagactgtacgtgggcagcctgcacttcaacatcaccgaggacatgctgagaggcatcttcgagcccttcggcagaatcgagagcatccagctgatgatggacagcgagaccggcagaagcaagggctacggcttcatcaccttcagcgacagcgagtgcgccaagaaggccctggagcagctgaacggcttcgagctggccggcagacccatgaaggtgggccacgtgaccgagagaaccgacgccagcagcgccagcagcttcctggacagcgacgagctggagagaaccggcatcgacctgggcaccaccggcagactgcagctgatggccagactggccgagggcaccggcctgcagatcccccccgccgcccagcaggccctgcagatgagcggcagcctggccttcggcgccgtggccgagttcagcttcgtgatcgacctgcagaccagactgagccagcagaccgaggccagcgccctggccgccgccgccagcgtgcagcccctggccacccagtgcttccagctgagcaacatgttcaacccccagaccgaggaggaggtgggctgggacaccgagatcaaggacgacgtgatcgaggagtgcaacaagcacggcggcgtgatccacatctacgtggacaagaacagcgcccagggcaacgtgtacgtgaagtgccccagcatcgccgccgccatcgccgccgtgaacgccctgcacggcagatggttcgccggcaagatgatcaccgccgcctacgtgcccctgcccacctaccacaacctgttccccgacagcatgaccgccacccagctgctggtgcccagcagaagatag

SEQ ID NO: 12745 - DNA, 582 bp, Artificial Sequence
  Description of Artificial Sequence: Synthetic coding sequence
atggccgacgacatcgacatcgaggccatgctggaggccccctacaagaaggacgagaacaagctgagcagcgccaacggccacgaggagagaagcaagaagagaaagaagagcaagagcagaagcagaagccacgagagaaagagaagcaagagcaaggagagaaagagaagcagagacagagagagaaagaagagcaagagcagagagagaaagagaagcagaagcaaggagagaagaagaagcagaagcagaagcagagacagaagattcagaggcagatacagaagcccctacagcggccccaagttcaacagcgccatcagaggcaagatcggcctgccccacagcatcaagctgagcagaagaagaagcagaagcaagagccccttcagaaaggacaagagccccgtgagagagcccatcgacaacctgacccccgaggagagagacgccagaaccgtgttctgcatgcagctggccgccagaatcagacccagagacctggaggagttcttcagcaccgtgggcaaggtgagagacgtgagaatgatcagcgacagaaacagcagaagaagctag

SEQ ID NO: 12746 - DNA, 1014 bp, Artificial Sequence
  Description of Artificial Sequence: Synthetic coding sequence
tgaagccccttcagaaaggacaagagccccgtgagagagcccatcgacaacctgacccccgaggagagagacgccagaaccgtgttctgcatgcagctggccgccagaatcagacccagagacctggaggagttcttcagcaccgtgggcaaggtgagagacgtgagaatgatcagcgacagaaacagcagaagaagcaagggcatcgcctacgtggagttcgtggacgtgagcagcgtgcccctggccatcggcctgaccggccagagagtgctgggcgtgcccatcatcgtgcaggccagccaggccgagaagaacagagccgccgccatggccaacaacctgcagaagggcagcgccggccccatgagactgtacgtgggcagcctgcacttcaacatcaccgaggacatgctgagaggcatcttcgagcccttcggcagattcagcgacagcgagtgcgccaagaaggccctggagcagctgaacggcttcgagctggccggcagacccatgaaggtgggccacgtgaccgagagaaccgacgccagcagcgccagcagcttcctggacagcgacgagctggagagaaccggcatcgacctgggcaccaccggcagactgcagctgatggccagactggccgagggcaccggcctgcagatcccccccgccgcccagcaggccctgcagatgagcggcagcctggccttcggcgccgtggccgagttcagcttcgtgatcgacctgcagaccagactgagccagcagaccgaggccagcgccctggccgccgccgccagcgtgcagcccctggccacccagtgcttccagctgagcaacatgttcaacccccagaccgaggaggaggtgggctgggacaccgagatcaaggacgacgtgatcgaggagtgcaacaagcacggcggcgtgatccacatctacgtggacaagaacagcgcccagggcaacgtgtacgtgaagtgccccagcatcgccgccgccatcgcctag

SEQ ID NO: 12747 - DNA, 1527 bp, Artificial Sequence
  Description of Artificial Sequence: Synthetic coding sequence
atggccgacgacatcgacatcgaggccatgctggaggccccctacaagaaggacgagaacaagctgagcagcgccaacggccacgaggagagaagcaagaagagaaagaagagcaagagcagaagcagaagccacgagagaaagagaagcaagagcaaggagagaaagagaagcagagacagagagagaaagaagagcaagagcagagagagaaagagaagcagaagcaaggagagaagaagaagcagaagcagaagcagagacagaagattcagaggcagatacagaagcccctacagaagaagaagcagaagcaagagccccttcagaaaggacaagagccccgtgagagagcccatcgacaacctgacccccgaggagagagacgccagaaccgtgttctgcatgcagctggccgccagaatcagacccagagacctggaggagttcttcagcaccgtgggcaaggtgagagacgtgagaatgatcagcgacagaaacagcagaagaagcaagggcatcgcctacgtggagttcgtggacgtgagcagcgtgcccctggccatcggcctgaccggccagagagtgctgggcgtgcccatcatcgtgcaggccagccaggccgagaagaacagagccgccgccatggccaacaacctgcagaagggcagcgccggccccatgagactgtacgtgggcagcctgcacttcaacatcaccgaggacatgctgagaggcatcttcgagcccttcggcagaatcgagagcatccagctgatgatggacagcgagaccggcagaagcaagggctacggcttcatcaccttcagcgacagcgagtgcgccaagaaggccctggagcagctgaacggcttcgagctggccggcagacccatgaaggtgggccacgtgaccgagagaaccgacgccagcagcgccagcagcttcctggacagcgacgagctggagagaaccggcatcgacctgggcaccaccggcagactgcagctgatggccagactggccgagggcaccggcctgcagatcccccccgccgcccagcaggccctgcagatgagcggcagcctggccttcggcgccgtggccgagttcagcttcgtgatcgacctgcagaccagactgagccagcagaccgaggccagcgccctggccgccgccgccagcgtgcagcccctggccacccagtgcttccagctgagcaacatgttcaacccccagaccgaggaggaggtgggctgggacaccgagatcaaggacgacgtgatcgaggagtgcaacaagcacggcggcgtgatccacatctacgtggacaagaacagcgcccagggcaacgtgtacgtgaagtgccccagcatcgccgccgccatcgccgccgtgaacgccctgcacggcagatggttcgccggcaagatgatcaccgccgcctacgtgcccctgcccacctaccacaacctgttccccgacagcatgaccgccacccagctgctggtgcccagcagaagatag

SEQ ID NO: 12748 - DNA, 1176 bp, Artificial Sequence
  Description of Artificial Sequence: Synthetic coding sequence
atggtggaggccgacagacccggcaagctgttcatcggcggcctgaacaccgagaccaacgagaaggccctggaggccgtgttcggcaagtacggcagaatcgtggaggtgctgctgatgaaggacagagagaccaacaagagcagaggcttcgccttcgtgaccttcgagagccccgccgacgccaaggacgccgccagagacatgaacggcaagagcctggacggcaaggccatcaaggtggagcaggccaccaagcccagcttcgagagcggcagaagaggccccccccccccccccagaagcagaggcccccccagaggcctgagaggcggcagaggcggcagcggcggcaccagaggcccccccagcagaggcggccacatggacgacggcggctacagcatgaacttcaacatgagcagcagcagaggccccctgcccgtgaagagaggccccccccccagaagcggcggccccccccccaagagaagcgcccccagcggccccgtgagaagcagcagcggcatgggcggcagagcccccgtgagcagaggcagagacagctacggcggcccccccagaagagagcccctgcccagcagaagagacgtgtacctgagccccagagacgacggctacagcaccaaggacagctacagcagcagagactaccccagcagcagagacaccagagactacgcccccccccccagagactacacctacagagactacggccacagcagcagcagagacgactaccccagcagaggctacagcgacagagacggctacggcagagacagagactacagcgaccaccccagcggcggcagctacagagacagctacgagagctacggcaacagcagaagcgccccccccaccagaggccccccccccagctacggcggcagcagcagatacgacgactacagcagcagcagagacggctacggcggcagcagagacagctacagcagcagcagaagcgacctgtacagcagcggcagagacagagtgggcagacaggagagaggcctgccccccagcatggagagaggctaccccccccccagagacagctacagcagcagcagcagaggcgcccccagaggcggcggcagaggcggcagcagaagcgacagaggcggcggcagaagcagatactag

SEQ ID NO: 12749 - DNA, 309 bp, Artificial Sequence
  Description of Artificial Sequence: Synthetic coding sequence
tgaatgttcatctgcccccaggagatgatgggcatcctgctgaagaccgccatccaggccgagatcacccaggtgctggtgatcctggagatcatgcaccaccaccacgagatcatcctgaccgtgatcatggtgatccccgtgcacgtgatgaccatccaccaggaggacatcgccatcgagatggacatggtggtgatcgtgaccatccagatcatccaggtggaggtgcccaccgagatccacatgagagtgatggtgggcgacttcgcccactacggcagaggcgtgctgatcgacagccagtag

SEQ ID NO: 12750 - DNA, 591 bp, Artificial Sequence
  Description of Artificial Sequence: Synthetic coding sequence
atggtggaggccgacagacccggcaagctgttcatcggcggcctgaacaccgagaccaacgagaaggccctggaggccgtgttcggcaagtacggcagaatcgtggaggtgctgctgatgaaggacagagagaccaacaagagcagaggcttcgccttcgtgaccttcgagagccccgccgacgccaaggacgccgccagagacatgaacggcaagctgctgtaccacgtggaggagatcgtgatggaggtgcacctggagggcaacagatgccccctggtggagatgttcatctgcccccaggagatgatgggcatcctgctgaagaccgccatccaggccgagatcacccaggtgctggtgatcctggagatcatgcaccaccaccacgagatcatcctgaccgtgatcatggtgatccccgtgcacgtgatgaccatccaccaggaggacatcgccatcgagatggacatggtggtgatcgtgaccatccagatcatccaggtggaggtgcccaccgagatccacatgagagtgatggtgggcgacttcgcccactacggcagaggcgtgctgatcgacagccagtag

SEQ ID NO: 12751 - DNA, 1137 bp, Artificial Sequence
  Description of Artificial Sequence: Synthetic coding sequence
atggtggaggccgacagacccggcaagctgttcatcggcggcctgaacaccgagaccaacgagaaggccctggaggccgtgttcggcaagtacggcagaatcgtggaggtgctgctgatgaaggacagagagagccccgccgacgccaaggacgccgccagagacatgaacggcaagagcctggacggcaaggccatcaaggtggagcaggccaccaagcccagcttcgagagcggcagaagaggccccccccccccccccagaagcagaggcccccccagaggcctgagaggcggcagaggcggcagcggcggcaccagaggcccccccagcagaggcggccacatggacgacggcggctacagcatgaacttcaacatgagcagcagcagaggccccctgcccgtgaagagaggccccccccccagaagcggcggccccccccccaagagaagcgcccccagcggccccgtgagaagcagcagcggcatgggcggcagagcccccgtgagcagaggcagagacagctacggcggcccccccagaagagagcccctgcccagcagaagagacgtgtacctgagccccagagacgacggctacagcaccaaggacagctacagcagcagagactaccccagcagcagagacaccagagactacgcccccccccccagagactacacctacagagactacggccacagcagcagcagagacgactaccccagcagaggctacagcgacagagacggctacggcagagacagagactacagcgaccaccccagcggcggcagctacagagacagctacgagagctacggcaacagcagaagcgccccccccaccagaggccccccccccagctacggcggcagcagcagatacgacgactacagcagcagcagagacggctacggcggcagcagagacagctacagcagcagcagaagcgacctgtacagcagcggcagagacagagtgggcagacaggagagaggcctgccccccagcatggagagaggctaccccccccccagagacagctacagcagcagcagcagaggcgcccccagaggcggcggcagaggcggcagcagaagcgacagaggcggcggcagaagcagatactag

SEQ ID NO: 12752 - DNA, 1443 bp, Artificial Sequence
  Description of Artificial Sequence: Synthetic coding sequence
atggccagcgacagcatcttcgagagcttccccagctacccccagtgcttcatgagagagtgcatcctgggcatgaaccccagcagagacgtgcacgacgccagcaccagcagaagattcaccccccccagcaccgccctgagccccggcaagatgagcgaggccctgcccctgggcgcccccgacgccggcgccgccctggccggcaagctgagaagcggcgacagaagcatggtggaggtgctggccgaccaccccggcgagctggtgagaaccgacagccccaacttcctgtgcagcgtgctgcccacccactggagatgcaacaagaccctgcccatcgccttcaaggtggtggccctgggcgacgtgcccgacggcaccctggtgaccgtgatggccggcaacgacgagaactacagcgccgagctgagaaacgccaccgccgccatgaagaaccaggtggccagattcaacgacctgagattcgtgggcagaagcggcagaggcaagagcttcaccctgaccatcaccgtgttcaccaaccccccccaggtggccacctaccacagagccatcaagatcaccgtggacggccccagagagcccagaagacacagacagaagctggacgaccagaccaagcccggcagcctgagcttcagcgagagactgagcgagctggagcagctgagaagaaccgccatgagagtgagcccccaccaccccgcccccacccccaaccccagagccagcctgaaccacagcaccgccttcaacccccagccccagagccagatgcaggacaccagacagatccagcccagccccccctggagctacgaccagagctaccagtacctgggcagcatcgccagccccagcgtgcaccccgccacccccatcagccccggcagagccagcggcatgaccaccctgagcgccgagctgagcagcagactgagcaccgcccccgacctgaccgccttcagcgaccccagacagttccccgccctgcccagcatcagcgaccccagaatgcactaccccggcgccttcacctacagccccacccccgtgaccagcggcatcggcatcggcatgagcgccatgggcagcgccaccagataccacacctacctgccccccccctaccccggcagcagccaggcccagggcggccccttccaggccagcagccccagctaccacctgtactacggcgccagcgccggcagctaccagttcagcatggtgggcggcgagagaagcccccccagaatcctgcccccctgcaccaacgccagcaccggcagcgccctgctgaaccccagcctgcccaaccagagcgacgtggtggaggccgagggcagccacagcaacagccccaccaacatggcccccagcgccagactggaggaggccgtgtggagaccctactag

SEQ ID NO: 12753 - DNA, 1407 bp, Artificial Sequence
  Description of Artificial Sequence: Synthetic coding sequence
atgcccgccgcccccagaggccccgcccagggcgaggccgccgccagaaccagaagcagagacgccagcaccagcagaagattcaccccccccagcaccgccctgagccccggcaagatgagcgaggccctgcccctgggcgcccccgacgccggcgccgccctggccggcaagctgagaagcggcgacagaagcatggtggaggtgctggccgaccaccccggcgagctggtgagaaccgacagccccaacttcctgtgcagcgtgctgcccacccactggagatgcaacaagaccctgcccatcgccttcaaggtggtggccctgggcgacgtgcccgacggcaccctggtgaccgtgatggccggcaacgacgagaactacagcgccgagctgagaaacgccaccgccgccatgaagaaccaggtggccagattcaacgacctgagattcgtgggcagaagcggcagaggcaagagcttcaccctgaccatcaccgtgttcaccaaccccccccaggtggccacctaccacagagccatcaagatcaccgtggacggccccagagagcccagaagacacagacagaagctggacgaccagaccaagcccggcagcctgagcttcagcgagagactgagcgagctggagcagctgagaagaaccgccatgagagtgagcccccaccaccccgcccccacccccaaccccagagccagcctgaaccacagcaccgccttcaacccccagccccagagccagatgcaggacaccagacagatccagcccagccccccctggagctacgaccagagctaccagtacctgggcagcatcgccagccccagcgtgcaccccgccacccccatcagccccggcagagccagcggcatgaccaccctgagcgccgagctgagcagcagactgagcaccgcccccgacctgaccgccttcagcgaccccagacagttccccgccctgcccagcatcagcgaccccagaatgcactaccccggcgccttcacctacagccccacccccgtgaccagcggcatcggcatcggcatgagcgccatgggcagcgccaccagataccacacctacctgccccccccctaccccggcagcagccaggcccagggcggccccttccaggccagcagccccagctaccacctgtactacggcgccagcgccggcagctaccagttcagcatggtgggcggcgagagaagcccccccagaatcctgcccccctgcaccaacgccagcaccggcagcgccctgctgaaccccagcctgcccaaccagagcgacgtggtggaggccgagggcagccacagcaacagccccaccaacatggcccccagcgccagactggaggaggccgtgtggagaccctactag

SEQ ID NO: 12754 - DNA, 1362 bp, Artificial Sequence
  Description of Artificial Sequence: Synthetic coding sequence
atgagaatccccgtggacgccagcaccagcagaagattcaccccccccagcaccgccctgagccccggcaagatgagcgaggccctgcccctgggcgcccccgacgccggcgccgccctggccggcaagctgagaagcggcgacagaagcatggtggaggtgctggccgaccaccccggcgagctggtgagaaccgacagccccaacttcctgtgcagcgtgctgcccacccactggagatgcaacaagaccctgcccatcgccttcaaggtggtggccctgggcgacgtgcccgacggcaccctggtgaccgtgatggccggcaacgacgagaactacagcgccgagctgagaaacgccaccgccgccatgaagaaccaggtggccagattcaacgacctgagattcgtgggcagaagcggcagaggcaagagcttcaccctgaccatcaccgtgttcaccaaccccccccaggtggccacctaccacagagccatcaagatcaccgtggacggccccagagagcccagaagacacagacagaagctggacgaccagaccaagcccggcagcctgagcttcagcgagagactgagcgagctggagcagctgagaagaaccgccatgagagtgagcccccaccaccccgcccccacccccaaccccagagccagcctgaaccacagcaccgccttcaacccccagccccagagccagatgcaggacaccagacagatccagcccagccccccctggagctacgaccagagctaccagtacctgggcagcatcgccagccccagcgtgcaccccgccacccccatcagccccggcagagccagcggcatgaccaccctgagcgccgagctgagcagcagactgagcaccgcccccgacctgaccgccttcagcgaccccagacagttccccgccctgcccagcatcagcgaccccagaatgcactaccccggcgccttcacctacagccccacccccgtgaccagcggcatcggcatcggcatgagcgccatgggcagcgccaccagataccacacctacctgccccccccctaccccggcagcagccaggcccagggcggccccttccaggccagcagccccagctaccacctgtactacggcgccagcgccggcagctaccagttcagcatggtgggcggcgagagaagcccccccagaatcctgcccccctgcaccaacgccagcaccggcagcgccctgctgaaccccagcctgcccaaccagagcgacgtggtggaggccgagggcagccacagcaacagccccaccaacatggcccccagcgccagactggaggaggccgtgtggagaccctactag

SEQ ID NO: 12755 - DNA, 1428 bp, Artificial Sequence
  Description of Artificial Sequence: Synthetic coding sequence
atgaaccccagcagagacgtgcacgacgccagcaccagcagaagattcaccccccccagcaccgccctgagccccggcaagatgagcgaggccctgcccctgggcgcccccgacgccggcgccgccctggccggcaagctgagaagcggcgacagaagcatggtggaggtgctggccgaccaccccggcgagctggtgagaaccgacagccccaacttcctgtgcagcgtgctgcccacccactggagatgcaacaagaccctgcccatcgccttcaaggtggtggccctgggcgacgtgcccgacggcaccctggtgaccgtgatggccggcaacgacgagaactacagcgccgagctgagaaacgccaccgccgccatgaagaaccaggtggccagattcaacgacctgagattcgtgggcagaagcggcagaggcaagagcttcaccctgaccatcaccgtgttcaccaaccccccccaggtggccacctaccacagagccatcaagatcaccgtggacggccccagagagcccagaagacacagacagaagctggacgaccagaccaagcccggcagcctgagcttcagcgagagactgagcgagctggagcagctgagaagaaccgccatgagagtgagcccccaccaccccgcccccacccccaaccccagagccagcctgaaccacagcaccgccttcaacccccagccccagagccagatgcaggacaccagacagatccagcccagccccccctggagctacgaccagagctaccagtacctgggcagcatcgccagccccagcgtgcaccccgccacccccatcagccccggcagagccagcggcatgaccaccctgagcgccgagctgagcagcagactgagcaccgcccccgacctgaccgccttcagcgaccccagacagttccccgccctgcccagcatcagcgaccccagaatgcactaccccggcgccttcacctacagccccacccccgtgaccagcggcatcggcatcggcatgagcgccatgggcagcgccaccagataccacacctacctgccccccccctaccccggcagcagccaggcccagggcggccccttccaggccagcagccccagctaccacctgtactacggcgccagcgccggcagctaccagttcagcatggtgggcggcgagagaagcccccccagaatcctgcccccctgcaccaacgccagcaccggcagcgccctgctgaaccccagcctgcccaaccagagcgacgtggtggaggccgagggcagccacagcaacagccccaccaacatggccagagccagctgcagcagacaggccagaagagaccccggcccctgggccagaccccccagctggggcagaggcagacccaccgccagaatcagcctgtag

SEQ ID NO: 12756 - DNA, 99 bp, Artificial Sequence
  Description of Artificial Sequence: Synthetic coding sequence
atggccagcgacagcatcttcgagagcttccccagctacccccagtgcttcatgagagagtgcatcctgggcatgaaccccagcagagacgtgcactag

SEQ ID NO: 12757 - DNA, 414 bp, Artificial Sequence
  Description of Artificial Sequence: Synthetic coding sequence
atgcaggacaccagacagatccagcccagccccccctggagctacgaccagagctaccagtacctgggcagcatcgccagccccagcgtgcaccccgccacccccatcagccccggcagagccagcggcatgaccaccctgagcgccgagctgagcagcagactgagcaccgcccccgacctgaccgccttcagcgaccccagacagttccccgccctgcccagcatcagcgaccccagaatgcactaccccggcgccttcacctacagccccacccccgtgaccagcggcatcggcatcggcatgagcgccatgggcagcgccaccagataccacacctacctgccccccccctaccccggcagcagccaggcccagggcggccccttccaggccagcagccccagctactag

SEQ ID NO: 12758 - DNA, 1443 bp, Artificial Sequence; identical to SEQ ID NO: 12752
  Description of Artificial Sequence: Synthetic coding sequence

SEQ ID NO: 12759 - DNA, 576 bp, Artificial Sequence
  Description of Artificial Sequence: Synthetic coding sequence
atgaaccccagcagagacgtgcacgacgccagcaccagcagaagattcaccccccccagcaccgccctgagccccggcaagatgagcgaggccctgcccctgggcgcccccgacgccggcgccgccctggccggcaagctgagaagcggcgacagaagcatggtggaggtgctggccgaccaccccggcgagctggtgagaaccgacagccccaacttcctgtgcagcgtgctgcccacccactggagatgcaacaagaccctgcccatcgccttcaaggtggtggccctgggcgacgtgcccgacggcaccctggtgaccgtgatggccggcaacgacgagaactacagcgccgagctgagaaacgccaccgccgccatgaagaaccaggtggccagattcaacgacctgagattcgtgggcagaagcggcagaggcaagagcttcaccctgaccatcaccgtgttcaccaaccccccccaggtggccacctaccacagagccatcaagatcaccgtggacggccccagagagcccagaaacagcctgacctggcccagatacccccacatctag

SEQ ID NO: 12760 - DNA, 753 bp, Artificial Sequence
  Description of Artificial Sequence: Synthetic coding sequence
atgagaatccccgtggacgccagcaccagcagaagattcaccccccccagcaccgccctgagccccggcaagatgagcgaggccctgcccctgggcgcccccgacgccggcgccgccctggccggcaagctgagaagcggcgacagaagcatggtggaggtgctggccgaccaccccggcgagctggtgagaaccgacagccccaacttcctgtgcagcgtgctgcccacccactggagatgcaacaagaccctgcccatcgccttcaaggtggtggccctgggcgacgtgcccgacggcaccctggtgaccgtgatggccggcaacgacgagaactacagcgccgagctgagaaacgccaccgccgccatgaagaaccaggtggccagattcaacgacctgagattcgtgggcagaagcggcagaggcaagagcttcaccctgaccatcaccgtgttcaccaaccccccccaggtggccacctaccacagagccatcaagatcaccgtggacggccccagagagcccagaagacacagacagaagctggacgaccagaccaagcccggcagcctgagcttcagcgagagactgagcgagctggagcagctgagaagaaccgccatgagagtgagcccccaccaccccgcccccacccccaaccccagagccagcctgaaccacagcaccgccttcaacccccagccccagagccagatgcaggaggaggacaccgccccctggagatgctag

SEQ ID NO: 12761 - DNA, 1770 bp, Artificial Sequence
  Description of Artificial Sequence: Synthetic coding sequence
atgctgcacagcccccacaagcagccccagaaccacaagtgcggcgccaacttcctgcaggaggacagcaagaagagcctggtgttcaagtggctgatcagcgccggccactaccagccccccagacccaccgagagcttcaaggccgccagcagcatctacaacagaggctacaagttctacctgaagaagaagggcggcaccatggccagcaacagcctgttcagcaccgtgaccccctgccagcagaacttcttctgggaccccagcaccagcagaagattcagcccccccagcagcagcctgcagcccggcaagatgagcgacgtgagccccgtggtggccgcccagcagcagcagcagcagcagcagcagcagcagcagcagcagcagcagcagcagcagcagcagcagcaggaggccgccgccgccgccgccgccgccgccgccgccgccgccgccgccgccgccgtgcccagactgagacccccccacgacaacagaaccatggtggagatcatcgccgaccaccccgccgagctggtgagaaccgacagccccaacttcctgtgcagcgtgctgcccagccactggagatgcaacaagaccctgcccgtggccttcaaggtggtggccctgggcgaggtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccccccaggtggccacctaccacagagccatcaaggtgaccgtggacggccccagagagcccagaagacacagacagaagctggacgacagcaagcccagcctgttcagcgacagactgagcgacctgggcagaatcccccaccccagcatgagagtgggcgtgcccccccagaaccccagacccagcctgaacagcgcccccagccccttcaacccccagggccagagccagatcaccgaccccagacaggcccagagcagccccccctggagctacgaccagagctaccccagctacctgagccagatgaccagccccagcatccacagcaccacccccctgagcagcaccagaggcaccggcctgcccgccatcaccgacgtgcccagaagaatcagcgacgacgacaccgccaccagcgacttctgcctgtggcccagcaccctgagcaagaagagccaggccggcgccagcgagctgggccccttcagcgaccccagacagttccccagcatcagcagcctgaccgagagcagattcagcaaccccagaatgcactaccccgccaccttcacctacaccccccccgtgaccagcggcatgagcctgggcatgagcgccaccacccactaccacacctacctgccccccccctaccccggcagcagccagagccagagcggccccttccagaccagcagcaccccctacctgtactacggcaccagcagcggcagctaccagttccccatggtgcccggcggcgacagaagccccagcagaatgctgcccccctgcaccaccaccagcaacggcagcaccctgctgaaccccaacctgcccaaccagaacgacggcgtggacgccgacggcagccacagcagcagccccaccgtgctgaacagcagcggcagaatggacgagagcgtgtggagaccctactag

SEQ ID NO: 12762 - DNA, 1524 bp, Artificial Sequence
  Description of Artificial Sequence: Synthetic coding sequence
atgagaatccccgtggaccccagcaccagcagaagattcagcccccccagcagcagcctgcagcccggcaagatgagcgacgtgagccccgtggtggccgcccagcagcagcagcagcagcagcagcagcagcagcagcagcagcagcagcagcagcagcagcagcagcaggaggccgccgccgccgccgccgccgccgccgccgccgccgccgccgccgccgccgtgcccagactgagacccccccacgacaacagaaccatggtggagatcatcgccgaccaccccgccgagctggtgagaaccgacagccccaacttcctgtgcagcgtgctgcccagccactggagatgcaacaagaccctgcccgtggccttcaaggtggtggccctgggcgaggtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccccccaggtggccacctaccacagagccatcaaggtgaccgtggacggccccagagagcccagaagacacagacagaagctggacgacagcaagcccagcctgttcagcgacagactgagcgacctgggcagaatcccccaccccagcatgagagtgggcgtgcccccccagaaccccagacccagcctgaacagcgcccccagccccttcaacccccagggccagagccagatcaccgaccccagacaggcccagagcagccccccctggagctacgaccagagctaccccagctacctgagccagatgaccagccccagcatccacagcaccacccccctgagcagcaccagaggcaccggcctgcccgccatcaccgacgtgcccagaagaatcagcgacgacgacaccgccaccagcgacttctgcctgtggcccagcaccctgagcaagaagagccaggccggcgccagcgagctgggccccttcagcgaccccagacagttccccagcatcagcagcctgaccgagagcagattcagcaaccccagaatgcactaccccgccaccttcacctacaccccccccgtgaccagcggcatgagcctgggcatgagcgccaccacccactaccacacctacctgccccccccctaccccggcagcagccagagccagagcggccccttccagaccagcagcaccccctacctgtactacggcaccagcagcggcagctaccagttccccatggtgcccggcggcgacagaagccccagcagaatgctgcccccctgcaccaccaccagcaacggcagcaccctgctgaaccccaacctgcccaaccagaacgacggcgtggacgccgacggcagccacagcagcagccccaccgtgctgaacagcagcggcagaatggacgagagcgtgtggagaccctactag

SEQ ID NO: 12763 - DNA, 1458 bp, Artificial Sequence
  Description of Artificial Sequence: Synthetic coding sequence
atgagaatccccgtggaccccagcaccagcagaagattcagcccccccagcagcagcctgcagcccggcaagatgagcgacgtgagccccgtggtggccgcccagcagcagcagcagcagcagcagcagcagcagcagcagcagcagcagcagcagcagcagcagcagcaggaggccgccgccgccgccgccgccgccgccgccgccgccgccgccgccgccgccgtgcccagactgagacccccccacgacaacagaaccatggtggagatcatcgccgaccaccccgccgagctggtgagaaccgacagccccaacttcctgtgcagcgtgctgcccagccactggagatgcaacaagaccctgcccgtggccttcaaggtggtggccctgggcgaggtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccccccaggtggccacctaccacagagccatcaaggtgaccgtggacggccccagagagcccagaagacacagacagaagctggacgacagcaagcccagcctgttcagcgacagactgagcgacctgggcagaatcccccaccccagcatgagagtgggcgtgcccccccagaaccccagacccagcctgaacagcgcccccagccccttcaacccccagggccagagccagatcaccgaccccagacaggcccagagcagccccccctggagctacgaccagagctaccccagctacctgagccagatgaccagccccagcatccacagcaccacccccctgagcagcaccagaggcaccggcctgcccgccatcaccgacgtgcccagaagaatcagcggcgccagcgagctgggccccttcagcgaccccagacagttccccagcatcagcagcctgaccgagagcagattcagcaaccccagaatgcactaccccgccaccttcacctacaccccccccgtgaccagcggcatgagcctgggcatgagcgccaccacccactaccacacctacctgccccccccctaccccggcagcagccagagccagagcggccccttccagaccagcagcaccccctacctgtactacggcaccagcagcggcagctaccagttccccatggtgcccggcggcgacagaagccccagcagaatgctgcccccctgcaccaccaccagcaacggcagcaccctgctgaaccccaacctgcccaaccagaacgacggcgtggacgccgacggcagccacagcagcagccccaccgtgctgaacagcagcggcagaatggacgagagcgtgtggagaccctactag

SEQ ID NO: 12764 - DNA, 1500 bp, Artificial Sequence
  Description of Artificial Sequence: Synthetic coding sequence
atggccagcaacagcctgttcagcaccgtgaccccctgccagcagaacttcttctgggaccccagcaccagcagaagattcagcccccccagcagcagcctgcagcccggcaagatgagcgacgtgagccccgtggtggccgcccagcagcagcagcagcagcagcagcagcagcagcagcagcagcagcagcagcagcagcagcagcagcaggaggccgccgccgccgccgccgccgccgccgccgccgccgccgccgccgccgccgtgcccagactgagacccccccacgacaacagaaccatggtggagatcatcgccgaccaccccgccgagctggtgagaaccgacagccccaacttcctgtgcagcgtgctgcccagccactggagatgcaacaagaccctgcccgtggccttcaaggtggtggccctgggcgaggtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccccccaggtggccacctaccacagagccatcaaggtgaccgtggacggccccagagagcccagaagacacagacagaagctggacgacagcaagcccagcctgttcagcgacagactgagcgacctgggcagaatcccccaccccagcatgagagtgggcgtgcccccccagaaccccagacccagcctgaacagcgcccccagccccttcaacccccagggccagagccagatcaccgaccccagacaggcccagagcagccccccctggagctacgaccagagctaccccagctacctgagccagatgaccagccccagcatccacagcaccacccccctgagcagcaccagaggcaccggcctgcccgccatcaccgacgtgcccagaagaatcagcggcgccagcgagctgggccccttcagcgaccccagacagttccccagcatcagcagcctgaccgagagcagattcagcaaccccagaatgcactaccccgccaccttcacctacaccccccccgtgaccagcggcatgagcctgggcatgagcgccaccacccactaccacacctacctgccccccccctaccccggcagcagccagagccagagcggccccttccagaccagcagcaccccctacctgtactacggcaccagcagcggcagctaccagttccccatggtgcccggcggcgacagaagccccagcagaatgctgcccccctgcaccaccaccagcaacggcagcaccctgctgaaccccaacctgcccaaccagaacgacggcgtggacgccgacggcagccacagcagcagccccaccgtgctgaacagcagcggcagaatggacgagagcgtgtggagaccctactag

SEQ ID NO: 12765 - DNA, 1566 bp, Artificial Sequence
  Description of Artificial Sequence: Synthetic coding sequence
atggccagcaacagcctgttcagcaccgtgaccccctgccagcagaacttcttctgggaccccagcaccagcagaagattcagcccccccagcagcagcctgcagcccggcaagatgagcgacgtgagccccgtggtggccgcccagcagcagcagcagcagcagcagcagcagcagcagcagcagcagcagcagcagcagcagcagcagcaggaggccgccgccgccgccgccgccgccgccgccgccgccgccgccgccgccgccgtgcccagactgagacccccccacgacaacagaaccatggtggagatcatcgccgaccaccccgccgagctggtgagaaccgacagccccaacttcctgtgcagcgtgctgcccagccactggagatgcaacaagaccctgcccgtggccttcaaggtggtggccctgggcgaggtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccccccaggtggccacctaccacagagccatcaaggtgaccgtggacggccccagagagcccagaagacacagacagaagctggacgacagcaagcccagcctgttcagcgacagactgagcgacctgggcagaatcccccaccccagcatgagagtgggcgtgcccccccagaaccccagacccagcctgaacagcgcccccagccccttcaacccccagggccagagccagatcaccgaccccagacaggcccagagcagccccccctggagctacgaccagagctaccccagctacctgagccagatgaccagccccagcatccacagcaccacccccctgagcagcaccagaggcaccggcctgcccgccatcaccgacgtgcccagaagaatcagcgacgacgacaccgccaccagcgacttctgcctgtggcccagcaccctgagcaagaagagccaggccggcgccagcgagctgggccccttcagcgaccccagacagttccccagcatcagcagcctgaccgagagcagattcagcaaccccagaatgcactaccccgccaccttcacctacaccccccccgtgaccagcggcatgagcctgggcatgagcgccaccacccactaccacacctacctgccccccccctaccccggcagcagccagagccagagcggccccttccagaccagcagcaccccctacctgtactacggcaccagcagcggcagctaccagttccccatggtgcccggcggcgacagaagccccagcagaatgctgcccccctgcaccaccaccagcaacggcagcaccctgctgaaccccaacctgcccaaccagaacgacggcgtggacgccgacggcagccacagcagcagccccaccgtgctgaacagcagcggcagaatggacgagagcgtgtggagaccctactag

SEQ ID NO: 12766 - DNA, 1566 bp, Artificial Sequence; identical to SEQ ID NO: 12765
  Description of Artificial Sequence: Synthetic coding sequence

SEQ ID NO: 12767 - DNA, 1704 bp, Artificial Sequence
  Description of Artificial Sequence: Synthetic coding sequence
atgctgcacagcccccacaagcagccccagaaccacaagtgcggcgccaacttcctgcaggaggacagcaagaagagcctggtgttcaagtggctgatcagcgccggccactaccagccccccagacccaccgagagcttcaaggccgccagcagcatctacaacagaggctacaagttctacctgaagaagaagggcggcaccatggccagcaacagcctgttcagcaccgtgaccccctgccagcagaacttcttctgggaccccagcaccagcagaagattcagcccccccagcagcagcctgcagcccggcaagatgagcgacgtgagccccgtggtggccgcccagcagcagcagcagcagcagcagcagcagcagcagcagcagcagcagcagcagcagcagcagcagcaggaggccgccgccgccgccgccgccgccgccgccgccgccgccgccgccgccgccgtgcccagactgagacccccccacgacaacagaaccatggtggagatcatcgccgaccaccccgccgagctggtgagaaccgacagccccaacttcctgtgcagcgtgctgcccagccactggagatgcaacaagaccctgcccgtggccttcaaggtggtggccctgggcgaggtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccccccaggtggccacctaccacagagccatcaaggtgaccgtggacggccccagagagcccagaagacacagacagaagctggacgacagcaagcccagcctgttcagcgacagactgagcgacctgggcagaatcccccaccccagcatgagagtgggcgtgcccccccagaaccccagacccagcctgaacagcgcccccagccccttcaacccccagggccagagccagatcaccgaccccagacaggcccagagcagccccccctggagctacgaccagagctaccccagctacctgagccagatgaccagccccagcatccacagcaccacccccctgagcagcaccagaggcaccggcctgcccgccatcaccgacgtgcccagaagaatcagcggcgccagcgagctgggccccttcagcgaccccagacagttccccagcatcagcagcctgaccgagagcagattcagcaaccccagaatgcactaccccgccaccttcacctacaccccccccgtgaccagcggcatgagcctgggcatgagcgccaccacccactaccacacctacctgccccccccctaccccggcagcagccagagccagagcggccccttccagaccagcagcaccccctacctgtactacggcaccagcagcggcagctaccagttccccatggtgcccggcggcgacagaagccccagcagaatgctgcccccctgcaccaccaccagcaacggcagcaccctgctgaaccccaacctgcccaaccagaacgacggcgtggacgccgacggcagccacagcagcagccccaccgtgctgaacagcagcggcagaatggacgagagcgtgtggagaccctactag

SEQ ID NO: 12768 - DNA, 1248 bp, Artificial Sequence
  Description of Artificial Sequence: Synthetic coding sequence
atgagaatccccgtggaccccagcaccagcagaagattcaccccccccagccccgccttcccctgcggcggcggcggcggcaagatgggcgagaacagcggcgccctgagcgcccaggccgccgtgggccccggcggcagagccagacccgaggtgagaagcatggtggacgtgctggccgaccacgccggcgagctggtgagaaccgacagccccaacttcctgtgcagcgtgctgcccagccactggagatgcaacaagaccctgcccgtggccttcaaggtggtggccctgggcgacgtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccacccaggtggccacctaccacagagccatcaaggtgaccgtggacggccccagagagcccagaagacacagacagaagctggaggaccagaccaagcccttccccgacagattcggcgacctggagagactgagaatgagagtgacccccagcacccccagccccagaggcagcctgagcaccaccagccacttcagcagccagccccagacccccatccagggcaccagcgagctgaaccccttcagcgaccccagacagttcgacagaagcttccccaccctgcccaccctgaccgagagcagattccccgaccccagaatgcactaccccggcgccatgagcgccgccttcccctacagcgccacccccagcggcaccagcatcagcagcctgagcgtggccggcatgcccgccaccagcagattccaccacacctacctgccccccccctaccccggcgccccccagaaccagagcggccccttccaggccaaccccagcccctaccacctgtactacggcaccagcagcggcagctaccagttcagcatggtggccggcagcagcagcggcggcgacagaagccccaccagaatgctggccagctgcaccagcagcgccgccagcgtggccgccggcaacctgatgaaccccagcctgggcggccagagcgacggcgtggaggccgacggcagccacagcaacagccccaccgccctgagcacccccggcagaatggacgaggccgtgtggagaccctactag

SEQ ID NO: 12769 - DNA, 1290 bp, Artificial Sequence
  Description of Artificial Sequence: Synthetic coding sequence
atggccagcaacagcatcttcgacagcttccccacctacagccccaccttcatcagagaccccagcaccagcagaagattcaccccccccagccccgccttcccctgcggcggcggcggcggcaagatgggcgagaacagcggcgccctgagcgcccaggccgccgtgggccccggcggcagagccagacccgaggtgagaagcatggtggacgtgctggccgaccacgccggcgagctggtgagaaccgacagccccaacttcctgtgcagcgtgctgcccagccactggagatgcaacaagaccctgcccgtggccttcaaggtggtggccctgggcgacgtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccacccaggtggccacctaccacagagccatcaaggtgaccgtggacggccccagagagcccagaagacacagacagaagctggaggaccagaccaagcccttccccgacagattcggcgacctggagagactgagaatgagagtgacccccagcacccccagccccagaggcagcctgagcaccaccagccacttcagcagccagccccagacccccatccagggcaccagcgagctgaaccccttcagcgaccccagacagttcgacagaagcttccccaccctgcccaccctgaccgagagcagattccccgaccccagaatgcactaccccggcgccatgagcgccgccttcccctacagcgccacccccagcggcaccagcatcagcagcctgagcgtggccggcatgcccgccaccagcagattccaccacacctacctgccccccccctaccccggcgccccccagaaccagagcggccccttccaggccaaccccagcccctaccacctgtactacggcaccagcagcggcagctaccagttcagcatggtggccggcagcagcagcggcggcgacagaagccccaccagaatgctggccagctgcaccagcagcgccgccagcgtggccgccggcaacctgatgaaccccagcctgggcggccagagcgacggcgtggaggccgacggcagccacagcaacagccccaccgccctgagcacccccggcagaatggacgaggccgtgtggagaccctactag

SEQ ID NO: 12770 - DNA, 1290 bp, Artificial Sequence; identical to SEQ ID NO: 12769
  Description of Artificial Sequence: Synthetic coding sequence

SEQ ID NO: 12771 - DNA, 1089 bp, Artificial Sequence
  Description of Artificial Sequence: Synthetic coding sequence
atgagaatccccgtggaccccagcaccagcagaagattcaccccccccagccccgccttcccctgcggcggcggcggcggcaagatgggcgagaacagcggcgccctgagcgcccaggccgccgtgggccccggcggcagagccagacccgaggtgagaagcatggtggacgtgctggccgaccacgccggcgagctggtgagaaccgacagccccaacttcctgtgcagcgtgctgcccagccactggagatgcaacaagaccctgcccgtggccttcaaggtggtggccctgggcgacgtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccacccaggtggccacctaccacagagccatcaaggtgaccgtggacggccccagagagcccagaagaaccagcgagctgaaccccttcagcgaccccagacagttcgacagaagcttccccaccctgcccaccctgaccgagagcagattccccgaccccagaatgcactaccccggcgccatgagcgccgccttcccctacagcgccacccccagcggcaccagcatcagcagcctgagcgtggccggcatgcccgccaccagcagattccaccacacctacctgccccccccctaccccggcgccccccagaaccagagcggccccttccaggccaaccccagcccctaccacctgtactacggcaccagcagcggcagctaccagttcagcatggtggccggcagcagcagcggcggcgacagaagccccaccagaatgctggccagctgcaccagcagcgccgccagcgtggccgccggcaacctgatgaaccccagcctgggcggccagagcgacggcgtggaggccgacggcagccacagcaacagccccaccgccctgagcacccccggcagaatggacgaggccgtgtggagaccctactag

SEQ ID NO: 12772 - DNA, 969 bp, Artificial Sequence
  Description of Artificial Sequence: Synthetic coding sequence
atggtggtggccctgggcgacgtgcccgacggcaccgtggtgaccgtgatggccggcaacgacgagaactacagcgccgagctgagaaacgccagcgccgtgatgaagaaccaggtggccagattcaacgacctgagattcgtgggcagaagcggcagaggcaagagcttcaccctgaccatcaccgtgttcaccaaccccacccaggtggccacctaccacagagccatcaaggtgaccgtggacggccccagagagcccagaagacacagacagaagctggaggaccagaccaagcccttccccgacagattcggcgacctggagagactgagaatgagagtgacccccagcacccccagccccagaggcagcctgagcaccaccagccacttcagcagccagccccagacccccatccagggcaccagcgagctgaaccccttcagcgaccccagacagttcgacagaagcttccccaccctgcccaccctgaccgagagcagattccccgaccccagaatgcactaccccggcgccatgagcgccgccttcccctacagcgccacccccagcggcaccagcatcagcagcctgagcgtggccggcatgcccgccaccagcagattccaccacacctacctgccccccccctaccccggcgccccccagaaccagagcggccccttccaggccaaccccagcccctaccacctgtactacggcaccagcagcggcagctaccagttcagcatggtggccggcagcagcagcggcggcgacagaagccccaccagaatgctggccagctgcaccagcagcgccgccagcgtggccgccggcaacctgatgaaccccagcctgggcggccagagcgacggcgtggaggccgacggcagccacagcaacagccccaccgccctgagcacccccggcagaatggacgaggccgtgtggagaccctactag

SEQ ID NO: 12773 - DNA, 2439 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcctggacgacgacggcgacctgaagggcggcaacaaggccgccatccagggcaacggcgacgtgggcgccgccgccgccaccgcccacaacggcttcagctgcagcaactgcagcatgctgagcgagagaaaggacgtgctgaccgcccaccccgccgcccccggccccgtgagcagagtgtacagcagagacagaaaccagaagtgcgacgactgcaagggcaagagacacctggacgcccaccccggcagagccggcaccctgtggcacatctgggcctgcgccggctacttcctgctgcagatcctgagaagaatcggcgccgtgggccaggccgtgagcagaaccgcctggagcgccctgtggctggccgtggtggcccccggcaaggccgccagcggcgtgttctggtggctgggcatcggctggtaccagttcgtgaccctgatcagctggctgaacgtgttcctgctgaccagatgcctgagaaacatctgcaagttcctggtgctgctgatccccctgttcctgctgctggccggcctgagcctgagaggccagggcaacttcttcagcttcctgcccgtgctgaactgggccagcatgcacagaacccagagagtggacgacccccaggacgtgttcaagcccaccaccagcagactgaagcagcccctgcagggcgacagcgaggccttcccctggcactggatgagcggcgtggagcagcaggtggccagcctgagcggccagtgccaccaccacggcgagaacctgagagagctgaccaccctgctgcagaagctgcaggccagagtggaccagatggagggcggcgccgccggccccagcgccagcgtgagagacgccgtgggccagccccccagagagaccgacttcatggccttccaccaggagcacgaggtgagaatgagccacctggaggacatcctgggcaagctgagagagaagagcgaggccatccagaaggagctggagcagaccaagcagaagaccatcagcgccgtgggcgagcagctgctgcccaccgtggagcacctgcagctggagctggaccagctgaagagcgagctgagcagctggagacacgtgaagaccggctgcgagaccgtggacgccgtgcaggagagagtggacgtgcaggtgagagagatggtgaagctgctgttcagcgaggaccagcagggcggcagcctggagcagctgctgcagagattcagcagccagttcgtgagcaagggcgacctgcagaccatgctgagagacctgcagctgcagatcctgagaaacgtgacccaccacgtgagcgtgaccaagcagctgcccaccagcgaggccgtggtgagcgccgtgagcgaggccggcgccagcggcatcaccgaggcccaggccagagccatcgtgaacagcgccctgaagctgtacagccaggacaagaccggcatggtggacttcgccctggagagcggcggcggcagcatcctgagcaccagatgcagcgagacctacgagaccaagaccgccctgatgagcctgttcggcatccccctgtggtacttcagccagagccccagagtggtgatccagcccgacatctaccccggcaactgctgggccttcaagggcagccagggctacctggtggtgagactgagcatgatgatccaccccgccgccttcaccctggagcacatccccaagaccctgagccccaccggcaacatcagcagcgcccccaaggacttcgccgtgtacggcctggagaacgagtaccaggaggagggccagctgctgggccagttcacctacgaccaggacggcgagagcctgcagatgttccaggccctgaagagacccgacgacaccgccttccagatcgtggagctgagaatcttcagcaactggggccaccccgagtacacctgcctgtacagattcagagtgcacggcgagcccgtgaagtag

SEQ ID NO: 12774 - DNA, 2109 bp, Artificial Sequence
  Description of Artificial Sequence: Synthetic coding sequence
atgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcctggacgacgacggcgacctgaagggcggcaacaaggccgccatccagggcaacggcgacgtgggcgccgccgccgccaccgcccacaacggcttcagctgcagcaactgcagcatgctgagcgagagaaaggacgtgctgaccgcccaccccgccgcccccggccccgtgagcagagtgtacagcagagacagaaaccagaagtggaaggccgccagcggcgtgttctggtggctgggcatcggctggtaccagttcgtgaccctgatcagctggctgaacgtgttcctgctgaccagatgcctgagaaacatctgcaagttcctggtgctgctgatccccctgttcctgctgctggccggcctgagcctgagaggccagggcaacttcttcagcttcctgcccgtgctgaactgggccagcatgcacagaacccagagagtggacgacccccaggacgtgttcaagcccaccaccagcagactgaagcagcccctgcagggcgacagcgaggccttcccctggcactggatgagcggcgtggagcagcaggtggccagcctgagcggccagtgccaccaccacggcgagaacctgagagagctgaccaccctgctgcagaagctgcaggccagagtggaccagatggagggcggcgccgccggccccagcgccagcgtgagagacgccgtgggccagccccccagagagaccgacttcatggccttccaccaggagcacgaggtgagaatgagccacctggaggacatcctgggcaagctgagagagaagagcgaggccatccagaaggagctggagcagaccaagcagaagaccatcagcgccgtgggcgagcagctgctgcccaccgtggagcacctgcagctggagctggaccagctgaagagcgagctgagcagctggagacacgtgaagaccggctgcgagaccgtggacgccgtgcaggagagagtggacgtgcaggtgagagagatggtgaagctgctgttcagcgaggaccagcagggcggcagcctggagcagctgctgcagagattcagcagccagttcgtgagcaagggcgacctgcagaccatgctgagagacctgcagctgcagatcctgagaaacgtgacccaccacgtgagcgtgaccaagcagctgcccaccagcgaggccgtggtgagcgccgtgagcgaggccggcgccagcggcatcaccgaggcccaggccagagccatcgtgaacagcgccctgaagctgtacagccaggacaagaccggcatggtggacttcgccctggagagcggcggcggcagcatcctgagcaccagatgcagcgagacctacgagaccaagaccgccctgatgagcctgttcggcatccccctgtggtacttcagccagagccccagagtggtgatccagcccgacatctaccccggcaactgctgggccttcaagggcagccagggctacctggtggtgagactgagcatgatgatccaccccgccgccttcaccctggagcacatccccaagaccctgagccccaccggcaacatcagcagcgcccccaaggacttcgccgtgtacggcctggagaacgagtaccaggaggagggccagctgctgggccagttcacctacgaccaggacggcgagagcctgcagatgttccaggccctgaagagacccgacgacaccgccttccagatcgtggagctgagaatcttcagcaactggggccaccccgagtacacctgcctgtacagattcagagtgcacggcgagcccgtgaagtag

SEQ ID NO: 12775 - DNA, 2358 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcctggacgacgacggcgacctgaagggcggcaacaaggccgccatccagggcaacggcgacgtgggcgccgccgccgccaccgcccacaacggcttcagctgcagcaactgcagcatgctgagcgagagaaaggacgtgctgaccgcccaccccgccgcccccggccccgtgagcagagtgtacagcagagacagaaaccagaagtgctacttcctgctgcagatcctgagaagaatcggcgccgtgggccaggccgtgagcagaaccgcctggagcgccctgtggctggccgtggtggcccccggcaaggccgccagcggcgtgttctggtggctgggcatcggctggtaccagttcgtgaccctgatcagctggctgaacgtgttcctgctgaccagatgcctgagaaacatctgcaagttcctggtgctgctgatccccctgttcctgctgctggccggcctgagcctgagaggccagggcaacttcttcagcttcctgcccgtgctgaactgggccagcatgcacagaacccagagagtggacgacccccaggacgtgttcaagcccaccaccagcagactgaagcagcccctgcagggcgacagcgaggccttcccctggcactggatgagcggcgtggagcagcaggtggccagcctgagcggccagtgccaccaccacggcgagaacctgagagagctgaccaccctgctgcagaagctgcaggccagagtggaccagatggagggcggcgccgccggccccagcgccagcgtgagagacgccgtgggccagccccccagagagaccgacttcatggccttccaccaggagcacgaggtgagaatgagccacctggaggacatcctgggcaagctgagagagaagagcgaggccatccagaaggagctggagcagaccaagcagaagaccatcagcgccgtgggcgagcagctgctgcccaccgtggagcacctgcagctggagctggaccagctgaagagcgagctgagcagctggagacacgtgaagaccggctgcgagaccgtggacgccgtgcaggagagagtggacgtgcaggtgagagagatggtgaagctgctgttcagcgaggaccagcagggcggcagcctggagcagctgctgcagagattcagcagccagttcgtgagcaagggcgacctgcagaccatgctgagagacctgcagctgcagatcctgagaaacgtgacccaccacgtgagcgtgaccaagcagctgcccaccagcgaggccgtggtgagcgccgtgagcgaggccggcgccagcggcatcaccgaggcccaggccagagccatcgtgaacagcgccctgaagctgtacagccaggacaagaccggcatggtggacttcgccctggagagcggcggcggcagcatcctgagcaccagatgcagcgagacctacgagaccaagaccgccctgatgagcctgttcggcatccccctgtggtacttcagccagagccccagagtggtgatccagcccgacatctaccccggcaactgctgggccttcaagggcagccagggctacctggtggtgagactgagcatgatgatccaccccgccgccttcaccctggagcacatccccaagaccctgagccccaccggcaacatcagcagcgcccccaaggacttcgccgtgtacggcctggagaacgagtaccaggaggagggccagctgctgggccagttcacctacgaccaggacggcgagagcctgcagatgttccaggccctgaagagacccgacgacaccgccttccagatcgtggagctgagaatcttcagcaactggggccaccccgagtacacctgcctgtacagattcagagtgcacggcgagcccgtgaagtag

SEQ ID NO: 12776 - DNA, 774 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcctggacgacgacggcgacctgaagggcggcaacaaggccgccatccagggcaacggcgacgtgggcgccgccgccgccaccgcccacaacggcttcagctgcagcaactgcagcatgctgagcgagagaaaggacgtgctgaccgcccaccccgccgcccccggccccgtgagcagagtgtacagcagagacagaaaccagaagtgcaagagccagagcttcaagacccagaagaaggtgtgcttccccaacctgatcttccccttctgcaagagccagtgcctgcactacctgagctggagactgaagatcatcccctag

SEQ ID NO: 12777 - DNA, 2469 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcctggacgacgacggcgacctgaagggcggcaacaaggccgccatccagggcaacggcgacgtgggcgccgccgccgccaccgcccacaacggcttcagctgcagcaactgcagcatgctgagcgagagaaaggacgtgctgaccgcccaccccgccgcccccggccccgtgagcagagtgtacagcagagacagaaaccagaagtgcgacgactgcaagggcaagagacacctggacgcccacaccgccgcccacagccagagccccagactgcccggcagagccggcaccctgtggcacatctgggcctgcgccggctacttcctgctgcagatcctgagaagaatcggcgccgtgggccaggccgtgagcagaaccgcctggagcgccctgtggctggccgtggtggcccccggcaaggccgccagcggcgtgttctggtggctgggcatcggctggtaccagttcgtgaccctgatcagctggctgaacgtgttcctgctgaccagatgcctgagaaacatctgcaagttcctggtgctgctgatccccctgttcctgctgctggccggcctgagcctgagaggccagggcaacttcttcagcttcctgcccgtgctgaactgggccagcatgcacagaacccagagagtggacgacccccaggacgtgttcaagcccaccaccagcagactgaagcagcccctgcagggcgacagcgaggccttcccctggcactggatgagcggcgtggagcagcaggtggccagcctgagcggccagtgccaccaccacggcgagaacctgagagagctgaccaccctgctgcagaagctgcaggccagagtggaccagatggagggcggcgccgccggccccagcgccagcgtgagagacgccgtgggccagccccccagagagaccgacttcatggccttccaccaggagcacgaggtgagaatgagccacctggaggacatcctgggcaagctgagagagaagagcgaggccatccagaaggagctggagcagaccaagcagaagaccatcagcgccgtgggcgagcagctgctgcccaccgtggagcacctgcagctggagctggaccagctgaagagcgagctgagcagctggagacacgtgaagaccggctgcgagaccgtggacgccgtgcaggagagagtggacgtgcaggtgagagagatggtgaagctgctgttcagcgaggaccagcagggcggcagcctggagcagctgctgcagagattcagcagccagttcgtgagcaagggcgacctgcagaccatgctgagagacctgcagctgcagatcctgagaaacgtgacccaccacgtgagcgtgaccaagcagctgcccaccagcgaggccgtggtgagcgccgtgagcgaggccggcgccagcggcatcaccgaggcccaggccagagccatcgtgaacagcgccctgaagctgtacagccaggacaagaccggcatggtggacttcgccctggagagcggcggcggcagcatcctgagcaccagatgcagcgagacctacgagaccaagaccgccctgatgagcctgttcggcatccccctgtggtacttcagccagagccccagagtggtgatccagcccgacatctaccccggcaactgctgggccttcaagggcagccagggctacctggtggtgagactgagcatgatgatccaccccgccgccttcaccctggagcacatccccaagaccctgagccccaccggcaacatcagcagcgcccccaaggacttcgccgtgtacggcctggagaacgagtaccaggaggagggccagctgctgggccagttcacctacgaccaggacggcgagagcctgcagatgttccaggccctgaagagacccgacgacaccgccttccagatcgtggagctgagaatcttcagcaactggggccaccccgagtacacctgcctgtacagattcagagtgcacggcgagcccgtgaagtag

SEQ ID NO: 12778 - DNA, 1752 bp, Artificial Sequence
  Description of Artificial Sequence: Synthetic coding sequence
atgaagctgagctacgagagcgagaactacaagctgaagacccacgagagcaaggactgcgagagcgagagctacaagagcaagagccacgagagcaaggcccacgccagctactacggcagaatgaacgtgagagaggtgctgagagaggacggccacctgagcgtgaacggcgaggccctgtggaaggccgccagcggcgtgttctggtggctgggcatcggctggtaccagttcgtgaccctgatcagctggctgaacgtgttcctgctgaccagatgcctgagaaacatctgcaagttcctggtgctgctgatccccctgttcctgctgctggccggcctgagcctgagaggccagggcaacttcttcagcttcctgcccgtgctgaactgggccagcatgcacagaacccagagagtggacgacccccaggacgtgttcaagcccaccaccagcagactgaagcagcccctgcagggcgacagcgaggccttcccctggcactggatgagcggcgtggagcagcaggtggccagcctgagcggccagtgccaccaccacggcgagaacctgagagagctgaccaccctgctgcagaagctgcaggccagagtggaccagatggagggcggcgccgccggccccagcgccagcaccgacttcatggccttccaccaggagcacgaggtgagaatgagccacctggaggacatcctgggcaagctgagagagaagagcgaggccatccagaaggagctggagcagaccaagcagaagaccatcagcgccgtgggcgagcagctgctgcccaccgtggagcacctgcagctggagctggaccagctgaagagcgagctgagcagctggagacacgtgaagaccggctgcgagaccgtggacgccgtgcaggagagagtggacgtgcaggtgagagagatggtgaagctgctgttcagcgaggaccagcagggcggcagcctggagcagctgctgcagagattcagcagccagttcgtgagcaagggcgacctgcagaccatgctgagagacctgcagctgcagatcctgagaaacgtgacccaccacgtgagcgtgaccaagcagctgcccaccagcgaggccgtggtgagcgccgtgagcgaggccggcgccagcggcatcaccgaggcccaggccagagccatcgtgaacagcgccctgaagctgtacagccaggacaagaccggcatggtggacttcgccctggagagcggcggcggcagcatcctgagcaccagatgcagcgagacctacgagaccaagaccgccctgatgagcctgttcggcatccccctgtggtacttcagccagagccccagagtggtgatccagcccgacatctaccccggcaactgctgggccttcaagggcagccagggctacctggtggtgagactgagcatgatgatccaccccgccgccttcaccctggagcacatccccaagaccctgagccccaccggcaacatcagcagcgcccccaaggacttcgccgtgtacggcctggagaacgagtaccaggaggagggccagctgctgggccagttcacctacgaccaggacggcgagagcctgcagatgttccaggccctgaagagacccgacgacaccgccttccagatcgtggagctgagaatcttcagcaactggggccaccccgagtacacctgcctgtacagattcagagtgcacggcgagcccgtgaagtag

SEQ ID NO: 12779 - DNA, 342 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagctag

SEQ ID NO: 12780 - DNA, 267 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgcctag

SEQ ID NO: 12781 - DNA, 2109 bp, Artificial Sequence; identical to SEQ ID NO: 12774
  Description of Artificial Sequence: Synthetic coding sequence

SEQ ID NO: 12782 - DNA, 525 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcctggacgacgacggcgacctgaagggcggcaacaaggccgccatccagggcaacggcgacgtgggcgcctag

SEQ ID NO: 12783 - DNA, 408 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctgtag

SEQ ID NO: 12784 - DNA, 267 bp, Artificial Sequence; identical to SEQ ID NO: 12780
  Description of Artificial Sequence: Synthetic coding sequence

SEQ ID NO: 12785 - DNA, 2049 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcaaggccgccagcggcgtgttctggtggctgggcatcggctggtaccagttcgtgaccctgatcagctggctgaacgtgttcctgctgaccagatgcctgagaaacatctgcaagttcctggtgctgctgatccccctgttcctgctgctgggcctgagcctgagaggccagggcaacttcttcagcttcctgcccgtgctgaactgggccagcatgcacagaacccagagagtggacgacccccaggacgtgttcaagcccaccaccagcagactgaagcagcccctgcagggcgacagcgaggccttcccctggcactggatgagcggcgtggagcagcaggtggccagcctgagcggccagtgccaccaccacggcgagaacctgagagagctgaccaccctgctgcagaagctgcaggccagagtggaccagatggagggcggcgccgccggccccagcgccagcgtgagagacgccgtgggccagccccccagagagaccgacttcatggccttccaccaggagcacgaggtgagaatgagccacctggaggacatcctgggcaagctgagagagaagagcgaggccatccagaaggagctggagcagaccaagcagaagaccatcagcgccgtgggcgagcagctgctgcccaccgtggagcacctgcagctggagctggaccagctgaagagcgagctgagcagctggagacacgtgaagaccggctgcgagaccgtggacgccgtgcaggagagagtggacgtgcaggtgagagagatggtgaagctgctgttcagcgaggaccagcagggcggcagcctggagcagctgctgcagagattcagcagccagttcgtgagcaagggcgacctgcagaccatgctgagagacctgcagctgcagatcctgagaaacgtgacccaccacgtgagcgtgaccaagcagctgcccaccagcgaggccgtggtgagcgccgtgagcgaggccggcgccagcggcatcaccgaggcccaggccagagccatcgtgaacagcgccctgaagctgtacagccaggacaagaccggcatggtggacttcgccctggagagcggcggcggcagcatcctgagcaccagatgcagcgagacctacgagaccaagaccgccctgatgagcctgttcggcatccccctgtggtacttcagccagagccccagagtggtgatccagcccgacatctaccccggcaactgctgggccttcaagggcagccagggctacctggtggtgagactgagcatgatgatccaccccgccgccttcaccctggagcacatccccaagaccctgagccccaccggcaacatcagcagcgcccccaaggacttcgccgtgtacggcctggagaacgagtaccaggaggagggccagctgctgggccagttcacctacgaccaggacggcgagagcctgcagatgttccaggccctgaagagacccgacgacaccgccttccagatcgtggagctgagaatcttcagcaactggggccaccccgagtacacctgcctgtacagattcagagtgcacggcgagcccgtgaagtag

SEQ ID NO: 12786 - DNA, 2925 bp, Artificial Sequence
  Description of Artificial Sequence: Synthetic coding sequence
atgggcgacgtgagaaaggccaaggaggccctggccgaggtgcagatccccccccccgacgccggccccagccccagatgcaagcccccccccgccgagagactgctgggccccggcagaagaagaagaggcctgagaagaagaagagaggccgtgtggttcgaggtggtgaacatggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcctggacgacgacggcgacctgaagggcggcaacaaggccgccatccagggcaacggcgacgtgggcgccgccgccgccaccgcccacaacggcttcagctgcagcaactgcagcatgctgagcgagagaaaggacgtgctgaccgcccaccccgccgcccccggccccgtgagcagagtgtacagcagagacagaaaccagaagtgcggcgccagcttctacgtgaacagaatcctgtggctggccagatacaccgccagcagcttcagcagcttcctggtgcagctgttccaggtggtgctgatgaagctgagctacgagagcgagaactacaagctgaagacccacgagagcaaggactgcgagagcgagagctacaagagcaagagccacgagagcaaggcccacgccagctactacggcagaatgaacgtgagagaggtgctgagagaggacggccacctgagcgtgaacggcgaggccctgtgcgacgactgcaagggcaagagacacctggacgcccacaccgccgcccacagccagagccccagactgcccggcagagccggcaccctgtggcacatctgggcctgcgccggctacttcctgctgcagatcctgagaagaatcggcgccgtgggccaggccgtgagcagaaccgcctggagcgccctgtggctggccgtggtggcccccggcaaggccgccagcggcgtgttctggtggctgggcatcggctggtaccagttcgtgaccctgatcagctggctgaacgtgttcctgctgaccagatgcctgagaaacatctgcaagttcctggtgctgctgatccccctgttcctgctgctggccggcctgagcctgagaggccagggcaacttcttcagcttcctgcccgtgctgaactgggccagcatgcacagaacccagagagtggacgacccccaggacgtgttcaagcccaccaccagcagactgaagcagcccctgcagggcgacagcgaggccttcccctggcactggatgagcggcgtggagcagcaggtggccagcctgagcggccagtgccaccaccacggcgagaacctgagagagctgaccaccctgctgcagaagctgcaggccagagtggaccagatggagggcggcgccgccggccccagcgccagcgtgagagacgccgtgggccagccccccagagagaccgacttcatggccttccaccaggagcacgaggtgagaatgagccacctggaggacatcctgggcaagctgagagagaagagcgaggccatccagaaggagctggagcagaccaagcagaagaccatcagcgccgtgggcgagcagctgctgcccaccgtggagcacctgcagctggagctggaccagctgaagagcgagctgagcagctggagacacgtgaagaccggctgcgagaccgtggacgccgtgcaggagagagtggacgtgcaggtgagagagatggtgaagctgctgttcagcgaggaccagcagggcggcagcctggagcagctgctgcagagattcagcagccagttcgtgagcaagggcgacctgcagaccatgctgagagacctgcagctgcagatcctgagaaacgtgacccaccacgtgagcgtgaccaagcagctgcccaccagcgaggccgtggtgagcgccgtgagcgaggccggcgccagcggcatcaccgaggcccaggccagagccatcgtgaacagcgccctgaagctgtacagccaggacaagaccggcatggtggacttcgccctggagagcggcggcggcagcatcctgagcaccagatgcagcgagacctacgagaccaagaccgccctgatgagcctgttcggcatccccctgtggtacttcagccagagccccagagtggtgatccagcccgacatctaccccggcaactgctgggccttcaagggcagccagggctacctggtggtgagactgagcatgatgatccaccccgccgccttcaccctggagcacatccccaagaccctgagccccaccggcaacatcagcagcgcccccaaggacttcgccgtgtacggcctggagaacgagtaccaggaggagggccagctgctgggccagttcacctacgaccaggacggcgagagcctgcagatgttccaggccctgaagagacccgacgacaccgccttccagatcgtggagctgagaatcttcagcaactggggccaccccgagtacacctgcctgtacagattcagagtgcacggcgagcccgtgaagtag

SEQ ID NO: 12787 - DNA, 837 bp, Artificial Sequence
  Description of Artificial Sequence: Synthetic coding sequence
atgggcagaatcagccccggcagccccggcctgcccagaaccgtgtggttcgaggtggtgaacatggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggcggcaccgtgagcctgcaggacgccgtgaccagaagaccccccgtgctggacgagagctggatcagagagcagaccaccgtggaccacttctggggcctggacgacgacggcgacctgaagggcggcaacaaggccgccatccagggcaacggcgacgtgggcgccgccgccgccaccgcccacaacggcttcagctgcagcaactgcagcatgctgagcgagagaaaggacgtgctgaccgcccaccccgccgcccccggccccgtgagcagagtgtacagcagagacagaaaccagaagtgcaagagccagagcttcaagacccagaagaaggtgtgcttccccaacctgatcttccccttctgcaagagccagtgcctgcactacctgagctggagactgaagatcatcccctag

SEQ ID NO: 12788 - DNA, 360 bp, Artificial Sequence
  Description of Artificial Sequence: Synthetic coding sequence
atggacttcagcagactgcacatgtacagccccccccagtgcgtgcccgagaacaccggctacacctacgccctgagcagcagctacagcagcgacgccctggacttcgagaccgagcacaagctggaccccgtgttcgacagccccagaatgagcagaagaagcctgagactggccaccaccgcctgcaccctgggcgacggcgaggccgtgggcgccgacagcggcaccagcagcgccgtgagcctgaagaacagagccgccagaaccaccaagcagagaagaagcaccaacaagagcgccttcagcatcaaccacgtgagcagacaggtgaccagcagcggcgtgagccacggctag

SEQ ID NO: 12789 - DNA, 2352 bp, Artificial Sequence
  Description of Artificial Sequence: Synthetic coding sequence
atggtgatcatgagcgagttcagcgccgaccccgccggccagggccagggccagcagaagcccctgagagtgggcttctacgacatcgagagaaccctgggcaagggcaacttcgccgtggtgaagctggccagacacagagtgaccaagacccaggtggccatcaagatcatcgacaagaccagactggacagcagcaacctggagaagatctacagagaggtgcagctgatgaagctgctgaaccacccccacatcatcaagctgtaccaggtgatggagaccaaggacatgctgtacatcgtgaccgagttcgccaagaacggcgagatgttcgactacctgaccagcaacggccacctgagcgagaacgaggccagaaagaagttctggcagatcctgagcgccgtggagtactgccacgaccaccacatcgtgcacagagacctgaagaccgagaacctgctgctggacggcaacatggacatcaagctggccgacttcggcttcggcaacttctacaagagcggcgagcccctgagcacctggtgcggcagccccccctacgccgcccccgaggtgttcgagggcaaggagtacgagggcccccagctggacatctggagcctgggcgtggtgctgtacgtgctggtgtgcggcagcctgcccttcgacggccccaacctgcccaccctgagacagagagtgctggagggcagattcagaatccccttcttcatgagccaggactgcgagagcctgatcagaagaatgctggtggtggaccccgccagaagaatcaccatcgcccagatcagacagcacagatggatgagagccgagccctgcctgcccggccccgcctgccccgccttcagcgcccacagctacaccagcaacctgggcgactacgacgagcaggccctgggcatcatgcagaccctgggcgtggacagacagagaaccgtggagagcctgcagaacagcagctacaaccacttcgccgccatctactacctgctgctggagagactgaaggagtacagaaacgcccagtgcgccagacccggccccgccagacagcccagacccagaagcagcgacctgagcggcctggaggtgccccaggagggcctgagcaccgaccccttcagacccgccctgctgtgcccccagccccagaccctggtgcagagcgtgctgcaggccgagatggactgcgagctgcagagcagcctgcagtggcccctgttcttccccgtggacgccagctgcagcggcgtgttcagacccagacccgtgagccccagcagcctgctggacaccgccatcagcgaggaggccagacagggccccggcctggaggaggagcaggacacccaggagagcctgcccagcagcaccggcagaagacacaccctggccgaggtgagcaccagactgagccccctgaccgccccctgcatcgtggtgagccccagcaccaccgccagccccgccgagggcaccagcagcgacagctgcctgaccttcagcgccagcaagagccccgccggcctgagcggcacccccgccacccagggcctgctgggcgcctgcagccccgtgagactggccagccccttcctgggcagccagagcgccacccccgtgctgcaggcccagggcggcctgggcggcgccgtgctgctgcccgtgagcttccaggagggcagaagagccagcgacaccagcctgacccagggcctgaaggccttcagacagcagctgagaaagaccaccagaaccaagggcttcctgggcctgaacaagatcaagggcctggccagacaggtgtgccaggcccccgccagcagagccagcagaggcggcctgagccccttccacgcccccgcccagagccccggcctgcacggcggcgccgccggcagcagagagggctggagcctgctggaggaggtgctggagcagcagagactgctgcagctgcagcaccaccccgccgccgcccccggctgcagccaggccccccagcccgcccccgcccccttcgtgatcgccccctgcgacggccccggcgccgcccccctgcccagcaccctgctgaccagcggcctgcccctgctgcccccccccctgctgcagaccggcgccagccccgtggccagcgccgcccagctgctggacacccacctgcacatcggcaccggccccaccgccctgcccgccgtgcccccccccagactggccagactggcccccggctgcgagcccctgggcctgctgcagggcgactgcgagatggaggacctgatgccctgcagcctgggcaccttcgtgctggtgcagtag

SEQ ID NO: 12790 - DNA, 3744 bp, Artificial Sequence
  Description of Artificial Sequence: Synthetic coding sequence
atggaggacgccggcgccgccggccccggccccgagcccgagcccgagcccgagcccgagcccgagcccgcccccgagcccgagcccgagcccaagcccggcgccggcaccagcgaggccttcagcagactgtggaccgacgtgatgggcatcctggacggcagcctgggcaacatcgacgacctggcccagcagtacgccgactactacaacacctgcttcagcgacgtgtgcgagagaatggaggagctgagaaagagaagagtgagccaggacctggaggtggagaagcccgacgccagccccaccagcctgcagctgagaagccagatcgaggagagcctgggcttctgcagcgccgtgagcacccccgaggtggagagaaagaaccccctgcacaagagcaacagcgaggacagcagcgtgggcaagggcgactggaagaagaagaacaagtacttctggcagaacttcagaaagaaccagaagggcatcatgagacagaccagcaagggcgaggacgtgggctacgtggccagcgagatcaccatgagcgacgaggagagaatccagctgatgatgatggtgaaggagaagatgatcaccatcgaggaggccctggccagactgaaggagtacgaggcccagcacagacagagcgccgccctggaccccgccgactggcccgacggcagctaccccaccttcgacggcagcagcaactgcaacagcagagagcagagcgacgacgagaccgaggagagcgtgaagttcaagagactgcacaagctggtgaacagcaccagaagagtgagaaagaagctgatcagagtggaggagatgaagaagcccagcaccgagggcggcgaggagcacgtgttcgagaacagccccgtgctggacgagagaagcgccctgtacagcggcgtgcacaagaagcccctgttcttcgacggcagccccgagaagccccccgaggacgacagcgacagcctgaccaccagccccagcagcagcagcctggacacctggggcgccggcagaaagctggtgaagaccttcagcaagggcgagagcagaggcctgatcaagccccccaagaagatgggcaccttcttcagctaccccgaggaggagaaggcccagaaggtgagcagaagcctgaccgagggcgagatgaagaagggcctgggcagcctgagccacggcagaacctgcagcttcggcggcttcgacctgaccaacagaagcctgcacgtgggcagcaacaacagcgaccccatgggcaaggagggcgacttcgtgtacaaggaggtgatcaagagccccaccgccagcagaatcagcctgggcaagaaggtgaagagcgtgaaggagaccatgagaaagagaatgagcaagaagtacagcagcagcgtgagcgagcaggacagcggcctggacggcatgcccggcagccccccccccagccagcccgaccccgagcacctggacaagcccaagctgaaggccggcggcagcgtggagagcctgagaagcagcctgagcggccagagcagcatgagcggccagaccgtgagcaccaccgacagcagcaccagcaacagagagagcgtgaagagcgaggacggcgacgacgaggagcccccctacagaggccccttctgcggcagagccagagtgcacaccgacttcacccccagcccctacgacaccgacagcctgaagctgaagaagggcgacatcatcgacatcatcagcaagccccccatgggcacctggatgggcctgctgaacaacaaggtgggcaccttcaagttcatctacgtggacgtgctgagcgaggacgaggagaagcccaagagacccaccagaagaagaagaaagggcagacccccccagcccaagagcgtggaggacctgctggacagaatcaacctgaaggagcacatgcccaccttcctgttcaacggctacgaggacctggacaccttcaagctgctggaggaggaggacctggacgagctgaacatcagagaccccgagcacagagccgtgctgctgaccgccgtggagctgctgcaggagtacgacagcaacagcgaccagagcggcagccaggagaagctgctggtggacagccagggcctgagcggctgcagccccagagacagcggctgctacgagagcagcgagaacctggagaacggcaagaccagaaaggccagcctgctgagcgccaagagcagcaccgagcccagcctgaagagcttcagcagaaaccagctgggcaactaccccaccctgcccctgatgaagagcggcgacgccctgaagcagggccaggaggagggcagactgggcggcggcctggcccccgacaccagcaagagctgcgacccccccggcgtgaccggcctgaacaagaacagaagaagcctgcccgtgagcatctgcagaagctgcgagaccctggagggcccccagaccgtggacacctggcccagaagccacagcctggacgacctgcaggtggagcccggcgccgagcaggacgtgcccaccgaggtgaccgagccccccccccagatcgtgcccgaggtgccccagaagaccaccgccagcagcaccaaggcccagcccctggagcaggacagcgccgtggacaacgccctgctgctgacccagagcaagagattcagcgagccccagaagctgaccaccaagaagctggagggcagcatcgccgccagcggcagaggcctgagccccccccagtgcctgcccagaaactacgacgcccagccccccggcgccaagcacggcctggccagaacccccctggagggccacagaaagggccacgagttcgagggcacccaccaccccctgggcaccaaggagggcgtggacgccgagcagagaatgcagcccaagatccccagccagcccccccccgtgcccgccaagaagagcagagagagactggccaacggcctgcaccccgtgcccatgggccccagcggcgccctgcccagccccgacgccccctgcctgcccgtgaagagaggcagccccgccagccccaccagccccagcgactgcccccccgccctggcccccagacccctgagcggccaggcccccggcagcccccccagcaccagaccccccccctggctgagcgagctgcccgagaacaccagcctgcaggagcacggcgtgaagctgggccccgccctgaccagaaaggtgagctgcgccagaggcgtggacctggagaccctgaccgagaacaagctgcacgccgagggcatcgacctgaccgaggagccctacagcgacaagcacggcagatgcggcatccccgaggccctggtgcagagatacgccgaggacctggaccagcccgagagagacgtggccgccaacatggaccagatcagagtgaagcagctgagaaagcagcacagaatggccatccccagcggcggcctgaccgagatctgcagaaagcccgtgagccccggctgcatcagcagcgtgagcgactggctgatcagcatcggcctgcccatgtacgccggcaccctgagcaccgccggcttcagcaccctgagccaggtgcccagcctgagccacacctgcctgcaggaggccggcatcaccgaggagagacacatcagaaagctgctgagcgccgccagactgttcaagctgccccccggccccgaggccatgtag

SEQ ID NO: 12791 - DNA, 255 bp, Artificial Sequence
  Description of Artificial Sequence: Synthetic coding sequence
atggaggagcaggactgcagagacggcagcctgggcaacatcgacgacctggcccagcagtacgccgactactacaacacctgcttcagcgacgtgtgcgagagaatggaggagctgagaaagagaagagtgagccaggacctggaggtggagaagcccgacgccagccccaccagcctgcagctgagaagccagatcgaggagagcctgggcttctgcagcgccgtgagcacccccgaggtggagagaaagtag

SEQ ID NO: 12792 - DNA, 249 bp, Artificial Sequence
  Description of Artificial Sequence: Synthetic coding sequence
caggcccaggacttcaaggacggcagcctgggcaacatcgacgacctggcccagcagtacgccgactactacaacacctgcttcagcgacgtgtgcgagagaatggaggagctgagaaagagaagagtgagccaggacctggaggtggagaagcccgacgccagccccaccagcctgcagctgagaagccagatcgaggagagcctgggcttctgcagcgccgtgagcacccccgaggtggagagatag

SEQ ID NO: 12793 - DNA, 2091 bp, Artificial Sequence
  Description of Artificial Sequence: Synthetic coding sequence
atgcccaagcccagcagagagcagagcgacgacgagaccgaggagagcgtgaagttcaagagactgcacaagctggtgaacagcaccagaagagtgagaaagaagctgatcagagtggaggagatgaagaagcccagcaccgagggcggcgaggagcacgtgttcgagaacagccccgtgctggacgagagaagcgccctgtacagcggcgtgcacaagaagcccctgttcttcgacggcagccccgagaagccccccgaggacgacagcgacagcctgaccaccagccccagcagcagcagcctggacacctggggcgccggcagaaagctggtgaagaccttcagcaagggcgagagcagaggcctgatcaagccccccaagaagatgggcaccttcttcagctaccccgaggaggagaaggcccagaaggtgagcagaagcctgaccgagggcgagatgaagaagggcctgggcagcctgagccacggcagaacctgcagcttcggcggcttcgacctgaccaacagaagcctgcacgtgggcagcaacaacagcgaccccatgggcaaggagggcgacttcgtgtacaaggaggtgatcaagagccccaccgccagcagaatcagcctgggcaagaaggtgaagagcgtgaaggagaccatgagaaagagaatgagcaagaagtacagcagcagcgtgagcgagcaggacagcggcctggacggcatgcccggcagccccccccccagccagcccgaccccgagcacctggacaagcccaagctgaaggccggcggcagcgtggagagcctgagaagcagcctgagcggccagagcagcatgagcggccagaccgtgagcaccaccgacagcagcaccagcaacagagagagcgtgaagagcgaggacggcgacgacgaggagcccccctacagaggccccttctgcggcagagccagagtgcacaccgacttcacccccagcccctacgacaccgacagcctgaagctgaagaagggcgacatcatcgacatcatcagcaagccccccatgggcacctggatgggcctgctgaacaacaaggtgggcaccttcaagttcatctacgtggacgtgctgagcgaggacgaggagaagcccaagagacccaccagaagaagaagaaagggcagacccccccagcccaagagcgtggaggacctgctggacagaatcaacctgaaggagcacatgcccaccttcctgttcaacggctacgaggacctggacaccttcaagctgctggaggaggaggacctggacgagctgaacatcagagaccccgagcacagagccgtgctgctgaccgccgtggagctgctgcaggagtacgacagcaacagcgaccagagcggcagccaggagaagctgctggtggacagccagggcctgagcggctgcagccccagagacagcggctgctacgagagcagcgagaacctggagaacggcaagaccagaaaggccagcctgctgagcgccaagagcagcaccgagcccagcctgaagagcttcagcagaaaccagctgggcaactaccccaccctgcccctgatgaagagcggcgacgccctgaagcagggccaggaggagggcagactgggcggcggcctggcccccgacaccagcaagagctgcgacccccccggcgtgaccggcctgaacaagaacagaagaagcctgcccgtgagcatctgcagaagctgcgagaccctggagggcccccagaccgtggacacctggcccagaagccacagcctggacgacctgcaggtggagcccggcgccgagcaggacgtgcccaccgaggtgaccgagccccccccccagatcgtgcccgaggtgccccagaagaccaccgccagcagcaccaaggcccagcccctggagcaggacagcgccgtggacaacgccctgctgctgacccagagcaagagattcagcgagccccagaagctgaccaccaagaagctggagggcagcatcgccgccagcggcagaggcctgagccccccccagtgcctgcccagaaactacgacgcccagtag

SEQ ID NO: 12794 - DNA, 1974 bp, Artificial Sequence
  Description of Artificial Sequence: Synthetic coding sequence
atgggcacctggatgggcctgctgaacaacaaggtgggcaccttcaagttcatctacgtggacgtgctgagcgaggacgaggagaagcccaagagacccaccagaagaagaagaaagggcagacccccccagcccaagagcgtggaggacctgctggacagaatcaacctgaaggagcacatgcccaccttcctgttcaacggctacgaggacctggacaccttcaagctgctggaggaggaggacctggacgagctgaacatcagagaccccgagcacagagccgtgctgctgaccgccgtggagctgctgcaggagtacgacagcaacagcgaccagagcggcagccaggagaagctgctggtggacagccagggcctgagcggctgcagccccagagacagcggctgctacgagagcagcgagaacctggagaacggcaagaccagaaaggccagcctgctgagcgccaagagcagcaccgagcccagcctgaagagcttcagcagaaaccagctgggcaactaccccaccctgcccctgatgaagagcggcgacgccctgaagcagggccaggaggagggcagactgggcggcggcctggcccccgacaccagcaagagctgcgacccccccggcgtgaccggcctgaacaagaacagaagaagcctgcccgtgagcatctgcagaagctgcgagaccctggagggcccccagaccgtggacacctggcccagaagccacagcctggacgacctgcaggtggagcccggcgccgagcaggacgtgcccaccgaggtgaccgagccccccccccagatcgtgcccgaggtgccccagaagaccaccgccagcagcaccaaggcccagcccctggagcaggacagcgccgtggacaacgccctgctgctgacccagagcaagagattcagcgagccccagaagctgaccaccaagaagctggagggcagcatcgccgccagcggcagaggcctgagccccccccagtgcctgcccagaaactacgacgcccagccccccggcgccaagcacggcctggccagaacccccctggagggccacagaaagggccacgagttcgagggcacccaccaccccctgggcaccaaggagggcgtggacgccgagcagagaatgcagcccaagatccccagccagcccccccccgtgcccgccaagaagagcagagagagactggccaacggcctgcaccccgtgcccatgggccccagcggcgccctgcccagccccgacgccccctgcctgcccgtgaagagaggcagccccgccagccccaccagccccagcgactgcccccccgccctggcccccagacccctgagcggccaggcccccggcagcccccccagcaccagaccccccccctggctgagcgagctgcccgagaacaccagcctgcaggagcacggcgtgaagctgggccccgccctgaccagaaaggtgagctgcgccagaggcgtggacctggagaccctgaccgagaacaagctgcacgccgagggcatcgacctgaccgaggagccctacagcgacaagcacggcagatgcggcatccccgaggccctggtgcagagatacgccgaggacctggaccagcccgagagagacgtggccgccaacatggaccagatcagagtgaagcagctgagaaagcagcacagaatggccatccccagcggcggcctgaccgagatctgcagaaagcccgtgagccccggctgcatcagcagcgtgagcgactggctgatcagcatcggcctgcccatgtacgccggcaccctgagcaccgccggcttcagcaccctgagccaggtgcccagcctgagccacacctgcctgcaggaggccggcatcaccgaggagagacacatcagaaagctgctgagcgccgccagactgttcaagctgccccccggccccgaggccatgtag

SEQ ID NO: 12795 - DNA, 621 bp, Artificial Sequence
  Description of Artificial Sequence: Synthetic coding sequence
atgctgccccccgccatccacttctacctgctgcccctggcctgcatcctgatgaagagctgcctggccttcaagaacgacgccaccgagatcctgtacagccacgtggtgaagcccgtgcccgcccaccccagcagcaacagcaccctgaaccaggccagaaacggcggcagacacttcagcaacaccggcctggacagaaacaccagagtgcaggtgggctgcagagagctgagaagcaccaagtacatcagcgacggccagtgcaccagcatcagccccctgaaggagctggtgtgcgccggcgagtgcctgcccctgcccgtgctgcccaactggatcggcggcggctacggcaccaagtactggagcagaagaagcagccaggagtggagatgcgtgaacgacaagaccagaacccagagaatccagctgcagtgccaggacggcagcaccagaacctacaagatcaccgtggtgaccgcctgcaagtgcaagagatacaccagacagcacaacgagagcagccacaacttcgagagcatgagccccgccaagcccgtgcagcaccacagagagagaaagagagccagcaagagcagcaagcacagcatgagctag

SEQ ID NO: 12796 - DNA, 693 bp, Artificial Sequence
  Description of Artificial Sequence: Synthetic coding sequence
atgctgccccccgccatccacttctacctgctgcccctggcctgcatcctgatgaagagctgcctggccttcaagaacgacgccaccgagatcctgtacagccacgtggtgaagcccgtgcccgcccaccccagcagcaacagcaccctgaaccaggccagaaacggcggcagacacttcagcaacaccggcctggacagaaacagaaccgagagcctgaccagacagaactacttctggctgttccccggcgccttcctgagacagctgcaggaggccagagtgcaggtgggctgcagagagctgagaagcaccaagtacatcagcgacggccagtgcaccagcatcagccccctgaaggagctggtgtgcgccggcgagtgcctgcccctgcccgtgctgcccaactggatcggcggcggctacggcaccaagtactggagcagaagaagcagccaggagtggagatgcgtgaacgacaagaccagaacccagagaatccagctgcagtgccaggacggcagcaccagaacctacaagatcaccgtggtgaccgcctgcaagtgcaagagatacaccagacagcacaacgagagcagccacaacttcgagagcatgagccccgccaagcccgtgcagcaccacagagagagaaagagagccagcaagagcagcaagcacagcatgagctag

SEQ ID NO: 12797 - DNA, 2229 bp, Artificial Sequence
  Description of Artificial Sequence: Synthetic coding sequence
atgggcagcgagaacagcgccctgaagagctacaccctgagagagccccccttcaccctgcccagcggcctggccgtgtaccccgccgtgctgcaggacggcaagttcgccagcgtgttcgtgtacaagagagagaacgaggacaaggtgaacaaggccgccaagcacctgaagaccctgagacacccctgcctgctgagattcctgagctgcaccgtggaggccgacggcatccacctggtgaccgagagagtgcagcccctggaggtggccctggagaccctgagcagcgccgaggtgtgcgccggcatctacgacatcctgctggccctgatcttcctgcacgacagaggccacctgacccacaacaacgtgtgcctgagcagcgtgttcgtgagcgaggacggccactggaagctgggcggcatggagaccgtgtgcaaggtgagccaggccacccccgagttcctgagaagcatccagagcatcagagaccccgccagcatcccccccgaggagatgagccccgagttcaccaccctgcccgagtgccacggccacgccagagacgccttcagcttcggcaccctggtggagagcctgctgaccatcctgaacgagcaggtgagcgccgacgtgctgagcagcttccagcagaccctgcacagcaccctgctgaaccccatccccaagtgcagacccgccctgtgcaccctgctgagccacgacttcttcagaaacgacttcctggaggtggtgaacttcctgaagagcctgaccctgaagagcgaggaggagaagaccgagttcttcaagttcctgctggacagagtgagctgcctgagcgaggagctgatcgccagcagactggtgcccctgctgctgaaccagctggtgttcgccgagcccgtggccgtgaagagcttcctgccctacctgctgggccccaagaaggaccacgcccagggcgagaccccctgcctgctgagccccgccctgttccagagcagagtgatccccgtgctgctgcagctgttcgaggtgcacgaggagcacgtgagaatggtgctgctgagccacatcgaggcctacgtggagcacttcacccaggagcagctgaagaaggtgatcctgccccaggtgctgctgggcctgagagacaccagcgacagcatcgtggccatcaccctgcacagcctggccgtgctggtgagcctgctgggccccgaggtggtggtgggcggcgagagaaccaagatcttcaagagaaccgcccccagcttcaccaagaacaccgacctgagcctggaggacagccccatgtgcgtggtgtgcagccaccacagccagatcagccccatcctggagaaccccttcagcagcatcttccccaagtgcttcttcagcggcagcacccccatcaacagcaagaagcacatccagagagactactacaacaccctgctgcagaccggcgaccccttcagccagcccatcaagttccccatcaacggcctgagcgacgtgaagaacaccagcgaggacagcgagaacttccccagcagcagcaagaagagcgaggagtggcccgactggagcgagcccgaggagcccgagaaccagaccgtgaacatccagatctggcccagagagccctgcgacgacgtgaagagccagtgcaccaccctggacgtggaggagagcagctgggacgactgcgagcccagcagcctggacaccaaggtgaaccccggcggcggcatcaccgccaccaagcccgtgaccagcggcgagcagaagcccatccccgccctgctgagcctgaccgaggagagcatgccctggaagagcagcctgccccagaagatcagcctggtgcagagaggcgacgacgccgaccagatcgagccccccaaggtgagcagccaggagagacccctgaaggtgcccagcgagctgggcctgggcgaggagttcaccatccaggtgaagaagaagcccgtgaaggaccccgagatggactggttcgccgacatgatccccgagatcaagcccagcgccgccttcctgatcctgcccgagctgagaaccgagatggtgcccaagaaggacgacgtgagccccgtgatgcagttcagcagcaagttcgccgccgccgagatcaccgagggcgaggccgagggctgggaggaggagggcgagctgaactgggaggacaacaactggtag

SEQ ID NO: 12798 - DNA, 2067 bp, Artificial Sequence
  Description of Artificial Sequence: Synthetic coding sequence
atgggcagcgagaacagcgccctgaagagctacaccctgagagagccccccttcaccctgcccagcggcctggccgtgtaccccgccgtgctgcaggacggcaagttcgccagcgtgttcgtgtacaagagagagaacgaggacaaggtgaacaaggccgccaagcacctgaagaccctgagacacccctgcctgctgagattcctgagctgcaccgtggaggccgacggcatccacctggtgaccgagagagtgcagcccctggaggtggccctggagaccctgagcagcgccgaggtgtgcgccggcatctacgacatcctgctggccctgatcttcctgcacgacagaggccacctgacccacaacaacgtgtgcctgagcagcgtgttcgtgagcgaggacggccactggaagctgggcggcatggagaccgtgtgcaaggtgagccaggccacccccgagttcctgagaagcatccagagcatcagagaccccgccagcatcccccccgaggagatgagccccgagttcaccaccctgcccgagtgccacggccacgccagagacgccttcagcttcggcaccctggtggagagcctgctgaccatcctgaacgagcaggtgagcgccgacgtgctgagcagcttccagcagaccctgcacagcaccctgctgaaccccatccccaagtgcagacccgccctgtgcaccctgctgagccacgacttcttcagaaacgacttcctggaggtggtgaacttcctgaagagcctgaccctgaagagcgaggaggagaagaccgagttcttcaagttcctgctggacagagtgagctgcctgagcgaggagctgatcgccagcagactggtgcccctgctgctgaaccagctggtgttcgccgagcccgtggccgtgaagagcttcctgccctacctgctgggccccaagaaggaccacgcccagggcgagaccccctgcctgctgagccccgccctgttccagagcagagtgatccccgtgctgctgcagctgttcgaggtgcacgaggagcacgtgagaatggtgctgctgagccacatcgaggcctacgtggagcacttcacccaggagcagctgaagaaggtgatcctgccccaggtgctgctgggcctgagagacaccagcgacagcatcgtggccatcaccctgcacagcctggccgtgctggtgagcctgctgggccccgaggtggtggtgggcggcgagagaaccaagatcttcaagagaaccgcccccagcttcaccaagaacaccgacctgagcctggagggcgaccccttcagccagcccatcaagttccccatcaacggcctgagcgacgtgaagaacaccagcgaggacagcgagaacttccccagcagcagcaagaagagcgaggagtggcccgactggagcgagcccgaggagcccgagaaccagaccgtgaacatccagatctggcccagagagccctgcgacgacgtgaagagccagtgcaccaccctggacgtggaggagagcagctgggacgactgcgagcccagcagcctggacaccaaggtgaaccccggcggcggcatcaccgccaccaagcccgtgaccagcggcgagcagaagcccatccccgccctgctgagcctgaccgaggagagcatgccctggaagagcagcctgccccagaagatcagcctggtgcagagaggcgacgacgccgaccagatcgagccccccaaggtgagcagccaggagagacccctgaaggtgcccagcgagctgggcctgggcgaggagttcaccatccaggtgaagaagaagcccgtgaaggaccccgagatggactggttcgccgacatgatccccgagatcaagcccagcgccgccttcctgatcctgcccgagctgagaaccgagatggtgcccaagaaggacgacgtgagccccgtgatgcagttcagcagcaagttcgccgccgccgagatcaccgagggcgaggccgagggctgggaggaggagggcgagctgaactgggaggacaacaactggtag

SEQ ID NO: 12799 - DNA, 2229 bp, Artificial Sequence; identical to SEQ ID NO: 12797
  Description of Artificial Sequence: Synthetic coding sequence

SEQ ID NO: 12800 - DNA, 1767 bp, Artificial Sequence
  Description of Artificial Sequence: Synthetic coding sequence
atgggcagcgagaacagcgccctgaagagctacaccctgagagagccccccttcaccctgcccagcggcctggccgtgtaccccgccgtgctgcaggacggcaagttcgccagcgtgttcgtgtacaagagagagaacgaggacaaggtgaacaaggccgccaagcacctgaagaccctgagacacccctgcctgctgagattcctgagctgcaccgtggaggccgacggcatccacctggtgaccgagagagtgcagcccctggaggtggccctggagaccctgagcagcgccgaggtgtgcgccggcatctacgacatcctgctggccctgatcttcctgcacgacagaggccacctgacccacaacaacgtgtgcctgagcagcgtgttcgtgagcgaggacggccactggaagctgggcggcatggagaccgtgtgcaaggtgagccaggccacccccgagttcctgagaagcatccagagcatcagagaccccgccagcatcccccccgaggagatgagccccgagttcaccaccctgcccgagtgccacggccacgccagagacgccttcagcttcggcaccctggtggagagcctgctgaccatcctgaacgagcaggtgagcgccgacgtgctgagcagcttccagcagaccctgcacagcaccctgctgaaccccatccccaagtgcagacccgccctgtgcaccctgctgagccacgacttcttcagaaacgacttcctggaggtggtgaacttcctgaagagcctgaccctgaagagcgaggaggagaagaccgagttcttcaagttcctgctggacagagtgagctgcctgagcgaggagctgatcgccagcagactggtgcccctgctgctgaaccagctggtgttcgccgagcccgtggccgtgaagagcttcctgccctacctgctgggccccaagaaggaccacgcccagggcgagaccccctgcctgctgagccccgccctgttccagagcagagtgatccccgtgctgctgcagctgttcgaggtgcacgaggagcacgtgagaatggtgctgctgagccacatcgaggcctacgtggagcacttcacccaggagcagctgaagaaggtgatcctgccccaggtgctgctgggcctgagagacaccagcgacagcatcgtggccatcaccctgcacagcctggccgtgctggtgagcctgctgggccccgaggtggtggtgggcggcgagagaaccaagatcttcaagagaaccgcccccagcttcaccaagaacaccgacctgagcctggagggcgaccccttcagccagcccatcaagttccccatcaacggcctgagcgacgtgaagaacaccagcgaggacagcgagaacttccccagcagcagcaagaagagcgaggagtggcccgactggagcgagcccgaggagcccgagaaccagaccgtgaacatccagatctggcccagagagccctgcgacgacgtgaagagccagtgcaccaccctggacgtggaggagagcagctgggacgactgcgagcccagcagcctggacaccaaggtgaaccccggcggcggcatcaccgccaccaagcccgtgaccagcggcgagcagaagcccatccccgccctgctgagcctgaccgaggagagcatgccctggaagagcagcctgccccagaagatcagcctggtgcagagaggcgacgacgccgaccagatcgagccccccaaggtgagcagctag

SEQ ID NO: 12801 - DNA, 1008 bp, Artificial Sequence
  Description of Artificial Sequence: Synthetic coding sequence
atgaagctgcccgccagagtgttcttcaccctgggcagcagactgccctgcggcctggcccccagaagattcttcagctacggcaccaagatcctgtaccagaacaccgaggccctgcagagcaagttcttcagccccctgcagaaggccatgctgccccccaacagcttccagggcaaggtggccttcatcaccggcggcggcaccggcctgggcaagggcatgaccaccctgctgagcagcctgggcgcccagtgcgtgatcgccagcagaaagatggacgtgctgaaggccaccgccgagcagatcagcagccagaccggcaacaaggtgcacgccatccagtgcgacgtgagagaccccgacatggtgcagaacaccgtgagcgagctgatcaaggtggccggccaccccaacatcgtgatcaacaacgccgccggcaacttcatcagccccaccgagagactgagccccaacgcctggaagaccatcaccgacatcgtgctgaacggcaccgccttcgtgaccctggagatcggcaagcagctgatcaaggcccagaagggcgccgccttcctgagcatcaccaccatctacgccgagaccggcagcggcttcgtggtgcccagcgccagcgccaaggccggcgtggaggccatgagcaagagcctggccgccgagtggggcaagtacggcatgagattcaacgtgatccagcccggccccatcaagaccaagggcgccttcagcagactggaccccaccggcaccttcgagaaggagatgatcggcagaatcccctgcggcagactgggcaccgtggaggagctggccaacctggccgccttcctgtgcagcgactacgccagctggatcaacggcgccgtgatcaagttcgacggcggcgaggaggtgctgatcagcggcgagttcaacgacctgagaaaggtgaccaaggagcagtgggacaccatcgaggagctgatcagaaagaccaagggcagctag

SEQ ID NO: 12802 - DNA, 945 bp, Artificial Sequence
  Description of Artificial Sequence: Synthetic coding sequence
atgggcatcggcagaagcgagggcggcagaagaggcgccgccctgggcgtgctgctggccctgggcgccgccctgctggccgtgggcagcgccagcgagtacgactacgtgagcttccagagcgacatcggcccctaccagagcggcagattctacaccaagcccccccagtgcgtggacatccccgccgacctgagactgtgccacaacgtgggctacaagaagatggtgctgcccaacctgctggagcacgagaccatggccgaggtgaagcagcaggccagcagctgggtgcccctgctgaacaagaactgccacgccggcacccaggtgttcctgtgcagcctgttcgcccccgtgtgcctggacagacccatctacccctgcagatggctgtgcgaggccgtgagagacagctgcgagcccgtgatgcagttcttcggcttctactggcccgagatgctgaagtgcgacaagttccccgagggcgacgtgtgcatcgccatgaccccccccaacgccaccgaggccagcaagccccagggcaccaccgtgtgccccccctgcgacaacgagctgaagagcgaggccatcatcgagcacctgtgcgccagcgagttcgccctgagaatgaagatcaaggaggtgaagaaggagaacggcgacaagaagatcgtgcccaagaagaagaagcccctgaagctgggccccatcaagaagaaggacctgaagaagctggtgctgtacctgaagaacggcgccgactgcccctgccaccagctggacaacctgagccaccacttcctgatcatgggcagaaaggtgaagagccagtacctgctgaccgccatccacaagtgggacaagaagaacaaggagttcaagaacttcatgaagaagatgaagaaccacgagtgccccaccttccagagcgtgttcaagtag

SEQ ID NO: 12803 - DNA, 1041 bp, Artificial Sequence
  Description of Artificial Sequence: Synthetic coding sequence
atgttcctgagcatcctggtggccctgtgcctgtggctgcacctggccctgggcgtgagaggcgccccctgcgaggccgtgagaatccccatgtgcagacacatgccctggaacatcaccagaatgcccaaccacctgcaccacagcacccaggagaacgccatcctggccatcgagcagtacgaggagctggtggacgtgaactgcagcgccgtgctgagattcttcctgtgcgccatgtacgcccccatctgcaccctggagttcctgcacgaccccatcaagccctgcaagagcgtgtgccagagagccagagacgactgcgagcccctgatgaagatgtacaaccacagctggcccgagagcctggcctgcgacgagctgcccgtgtacgacagaggcgtgtgcatcagccccgaggccatcgtgaccgacctgcccgaggacgtgaagtggatcgacatcacccccgacatgatggtgcaggagagacccctggacgtggactgcaagagactgagccccgacagatgcaagtgcaagaaggtgaagcccaccctggccacctacctgagcaagaactacagctacgtgatccacgccaagatcaaggccgtgcagagaagcggctgcaacgaggtgaccaccgtggtggacgtgaaggagatcttcaagagcagcagccccatccccagaacccaggtgcccctgatcaccaacagcagctgccagtgcccccacatcctgccccaccaggacgtgctgatcatgtgctacgagtggagaagcagaatgatgctgctggagaactgcctggtggagaagtggagagaccagctgagcaagagaagcatccagtgggaggagagactgcaggagcagagaagaaccgtgcaggacaagaagaagaccgccggcagaaccagcagaagcaacccccccaagcccaagggcaagccccccgcccccaagcccgccagccccaagaagaacatcaagaccagaagcgcccagaagagaaccaaccccaagagagtgtag

SEQ ID NO: 12804 - DNA, 1032 bp, Artificial Sequence
  Description of Artificial Sequence: Synthetic coding sequence
atgagagtggccggcagagagggcagattcctgagcgccggcgtggccgccagagagggcagcgccatgttcctgagcatcctggtggccctgtgcctgtggctgcacctggccctgggcgtgagaggcgccccctgcgaggccgtgagaatccccatgtgcagacacatgccctggaacatcaccagaatgcccaaccacctgcaccacagcacccaggagaacgccatgtacgcccccatctgcaccctggagttcctgcacgaccccatcaagccctgcaagagcgtgtgccagagagccagagacgactgcgagcccctgatgaagatgtacaaccacagctggcccgagagcctggcctgcgacgagctgcccgtgtacgacagaggcgtgtgcatcagccccgaggccatcgtgaccgacctgcccgaggacgtgaagtggatcgacatcacccccgacatgatggtgcaggagagacccctggacgtggactgcaagagactgagccccgacagatgcaagtgcaagaaggtgaagcccaccctggccacctacctgagcaagaactacagctacgtgatccacgccaagatcaaggccgtgcagagaagcggctgcaacgaggtgaccaccgtggtggacgtgaaggagatcttcaagagcagcagccccatccccagaacccaggtgcccctgatcaccaacagcagctgccagtgcccccacatcctgccccaccaggacgtgctgatcatgtgctacgagtggagaagcagaatgatgctgctggagaactgcctggtggagaagtggagagaccagctgagcaagagaagcatccagtgggaggagagactgcaggagcagagaagaaccgtgcaggacaagaagaagaccgccggcagaaccagcagaagcaacccccccaagcccaagggcaagccccccgcccccaagcccgccagccccaagaagaacatcaagaccagaagcgcccagaagagaaccaaccccaagagagtgtag

SEQ ID NO: 12805 - DNA, 954 bp, Artificial Sequence
  Description of Artificial Sequence: Synthetic coding sequence
atgagagccgccgccgccggcggcggcgtgagaaccgccgccctggccctgctgctgggcgccctgcactgggcccccgccagatgcgaggagtacgactactacggctggcaggccgagcccctgcacggcagaagctacagcaagcccccccagtgcctggacatccccgccgacctgcccctgtgccacaccgtgggctacaagagaatgagactgcccaacctgctggagcacgagagcctggccgaggtgaagcagcaggccagcagctggctgcccctgctggccaagagatgccacagcgacacccaggtgttcctgtgcagcctgttcgcccccgtgtgcctggacagacccatctacccctgcagaagcctgtgcgaggccgtgagagccggctgcgcccccctgatggaggcctacggcttcccctggcccgagatgctgcactgccacaagttccccctggacaacgacctgtgcatcgccgtgcagttcggccacctgcccgccaccgccccccccgtgaccaagatctgcgcccagtgcgagatggagcacagcgccgacggcctgatggagcagatgtgcagcagcgacttcgtggtgaagatgagaatcaaggagatcaagatcgagaacggcgacagaaagctgatcggcgcccagaagaagaagaagctgctgaagcccggccccctgaagagaaaggacaccaagagactggtgctgcacatgaagaacggcgccggctgcccctgcccccagctggacagcctggccggcagcttcctggtgatgggcagaaaggtggacggccagctgctgctgatggccgtgtacagatgggacaagaagaacaaggagatgaagttcgccgtgaagttcatgttcagctacccctgcagcctgtactaccccttcttctacggcgccgccgagccccactag

SEQ ID NO: 12806 - DNA, 903 bp, Artificial Sequence
  Description of Artificial Sequence: Synthetic coding sequence
atgagaatcgccgtgatctgcttctgcctgctgggcatcacctgcgccatccccgtgaagcaggccgacagcggcagcagcgaggagaagcagctgtacaacaagtaccccgacgccgtggccacctggctgaaccccgaccccagccagaagcagaacctgctggccccccagaccctgcccagcaagagcaacgagagccacgaccacatggacgacatggacgacgaggacgacgacgaccacgtggacagccaggacagcatcgacagcaacgacagcgacgacgtggacgacaccgacgacagccaccagagcgacgagagccaccacagcgacgagagcgacgagctggtgaccgacttccccaccgacctgcccgccaccgaggtgttcacccccgtggtgcccaccgtggacacctacgacggcagaggcgacagcgtggtgtacggcctgagaagcaagagcaagaagttcagaagacccgacatccagtaccccgacgccaccgacgaggacatcaccagccacatggagagcgaggagctgaacggcgcctacaaggccatccccgtggcccaggacctgaacgcccccagcgactgggacagcagaggcaaggacagctacgagaccagccagctggacgaccagagcgccgagacccacagccacaagcagagcagactgtacaagagaaaggccaacgacgagagcaacgagcacagcgacgtgatcgacagccaggagctgagcaaggtgagcagagagttccacagccacgagttccacagccacgaggacatgctggtggtggaccccaagagcaaggaggaggacaagcacctgaagttcagaatcagccacgagctggacagcgccagcagcgaggtgaactag

SEQ ID NO: 12807 - DNA, 879 bp, Artificial Sequence
  Description of Artificial Sequence: Synthetic coding sequence
atgagaatcgccgtgatctgcttctgcctgctgggcatcacctgcgccatccccgtgaagcaggccgacagcggcagcagcgaggagaagcagctgtacaacaagtaccccgacgccgtggccacctggctgaaccccgaccccagccagaagcagaacctgctggccccccagaacgccgtgagcagcgaggagaccaacgacttcaagcaggagaccctgcccagcaagagcaacgagagccacgaccacatggacgacatggacgacgaggacgacgacgaccaccagagcgacgagagccaccacagcgacgagagcgacgagctggtgaccgacttccccaccgacctgcccgccaccgaggtgttcacccccgtggtgcccaccgtggacacctacgacggcagaggcgacagcgtggtgtacggcctgagaagcaagagcaagaagttcagaagacccgacatccagtaccccgacgccaccgacgaggacatcaccagccacatggagagcgaggagctgaacggcgcctacaaggccatccccgtggcccaggacctgaacgcccccagcgactgggacagcagaggcaaggacagctacgagaccagccagctggacgaccagagcgccgagacccacagccacaagcagagcagactgtacaagagaaaggccaacgacgagagcaacgagcacagcgacgtgatcgacagccaggagctgagcaaggtgagcagagagttccacagccacgagttccacagccacgaggacatgctggtggtggaccccaagagcaaggaggaggacaagcacctgaagttcagaatcagccacgagctggacagcgccagcagcgaggtgaactag

SEQ ID NO: 12808 - DNA, 864 bp, Artificial Sequence
  Description of Artificial Sequence: Synthetic coding sequence
atgagaatcgccgtgatctgcttctgcctgctgggcatcacctgcgccatccccgtgaagcaggccgacagcggcagcagcgaggagaagcagaacgccgtgagcagcgaggagaccaacgacttcaagcaggagaccctgcccagcaagagcaacgagagccacgaccacatggacgacatggacgacgaggacgacgacgaccacgtggacagccaggacagcatcgacagcaacgacagcgacgacgtggacgacaccgacgacagccaccagagcgacgagagccaccacagcgacgagagcgacgagctggtgaccgacttccccaccgacctgcccgccaccgaggtgttcacccccgtggtgcccaccgtggacacctacgacggcagaggcgacagcgtggtgtacggcctgagaagcaagagcaagaagttcagaagacccgacatccagtaccccgacgccaccgacgaggacatcaccagccacatggagagcgaggagctgaacggcgcctacaaggccatccccgtggcccaggacctgaacgcccccagcgactgggacagcagaggcaaggacagctacgagaccagccagctggacgaccagagcgccgagacccacagccacaagcagagcagactgtacaagagaaaggccaacgacgagagcaacgagcacagcgacgtgatcgacagccaggagctgagcaaggtgagcagagagttccacagccacgagttccacagccacgaggacatgctggtggtggaccccaagagcaaggaggaggacaagcacctgaagttcagaatcagccacgagctggacagcgccagcagcgaggtgaactag

SEQ ID NO: 12809 - DNA, 945 bp, Artificial Sequence
  Description of Artificial Sequence: Synthetic coding sequence
atgagaatcgccgtgatctgcttctgcctgctgggcatcacctgcgccatccccgtgaagcaggccgacagcggcagcagcgaggagaagcagctgtacaacaagtaccccgacgccgtggccacctggctgaaccccgaccccagccagaagcagaacctgctggccccccagaacgccgtgagcagcgaggagaccaacgacttcaagcaggagaccctgcccagcaagagcaacgagagccacgaccacatggacgacatggacgacgaggacgacgacgaccacgtggacagccaggacagcatcgacagcaacgacagcgacgacgtggacgacaccgacgacagccaccagagcgacgagagccaccacagcgacgagagcgacgagctggtgaccgacttccccaccgacctgcccgccaccgaggtgttcacccccgtggtgcccaccgtggacacctacgacggcagaggcgacagcgtggtgtacggcctgagaagcaagagcaagaagttcagaagacccgacatccagtaccccgacgccaccgacgaggacatcaccagccacatggagagcgaggagctgaacggcgcctacaaggccatccccgtggcccaggacctgaacgcccccagcgactgggacagcagaggcaaggacagctacgagaccagccagctggacgaccagagcgccgagacccacagccacaagcagagcagactgtacaagagaaaggccaacgacgagagcaacgagcacagcgacgtgatcgacagccaggagctgagcaaggtgagcagagagttccacagccacgagttccacagccacgaggacatgctggtggtggaccccaagagcaaggaggaggacaagcacctgaagttcagaatcagccacgagctggacagcgccagcagcgaggtgaactag

SEQ ID NO: 12810 - DNA, 822 bp, Artificial Sequence
  Description of Artificial Sequence: Synthetic coding sequence
atgagaatcgccgtgatctgcttctgcctgctgggcatcacctgcgccatccccgtgaagcaggccgacagcggcagcagcgaggagaagcagaccctgcccagcaagagcaacgagagccacgaccacatggacgacatggacgacgaggacgacgacgaccacgtggacagccaggacagcatcgacagcaacgacagcgacgacgtggacgacaccgacgacagccaccagagcgacgagagccaccacagcgacgagagcgacgagctggtgaccgacttccccaccgacctgcccgccaccgaggtgttcacccccgtggtgcccaccgtggacacctacgacggcagaggcgacagcgtggtgtacggcctgagaagcaagagcaagaagttcagaagacccgacatccagtaccccgacgccaccgacgaggacatcaccagccacatggagagcgaggagctgaacggcgcctacaaggccatccccgtggcccaggacctgaacgcccccagcgactgggacagcagaggcaaggacagctacgagaccagccagctggacgaccagagcgccgagacccacagccacaagcagagcagactgtacaagagaaaggccaacgacgagagcaacgagcacagcgacgtgatcgacagccaggagctgagcaaggtgagcagagagttccacagccacgagttccacagccacgaggacatgctggtggtggaccccaagagcaaggaggaggacaagcacctgaagttcagaatcagccacgagctggacagcgccagcagcgaggtgaactag

SEQ ID NO: 12811 - DNA, 2370 bp, Artificial Sequence
  Description of Artificial Sequence: Synthetic coding sequence
atgagaacctaccactacatccccctgttcatctggacctacatgttccacaccgtggacaccatcctgctgcaggagaagcccaacagctacctgagcagcaagaagatcgccggcctgaccaaggacgacggcaagatgctgagaagaaccaagagaggctggatgtggaaccagttcttcctgctggaggagtacaccggcaccgacacccagtacgtgggcaagctgcacaccgaccaggacaagggcgacggcaacctgaagtacatcctgaccggcgacggcgccggcagcctgttcgtgatcgacgagaacaccggcgacatccacgccgccaagaagctggacagagaggagaagagcctgtacatcctgagagccaaggccatcgacagaaagaccggcagacaggtggagcccgagagcgagttcatcatcaagatccacgacatcaacgacaacgagcccaagttcaccaaggacctgtacaccgccagcgtgcccgagatgagcggcgtgggcaccagcgtgatccaggtgaccgccaccgacgccgacgacgccaactacggcaacagcgccaaggtggtgtacagcatcctgcagggccagccctacttcagcgtggaccccgagagcggcatcatcaagaccgccctgcccgacatgagcagagagaacagagagcagtaccaggtggtgatccaggccaaggacatgggcggccagatgggcggcctgagcggcaccaccaccgtgaacatcaccctgaccgacgtgaacaacaacccccccagattcccccagagcacctaccagttcaacagccccgagagcgtgcccctgggcacccacctgggcagaatcaaggccaacgaccccgacgtgggcgagaacgccgagatggagtacagcatcgccgagggcgacggcgccgacatgttcgacgtgatcaccgacaaggacacccaggagggcatcatcaccgtgaagcagaacctggacttcgagaaccagatgctgtacaccctgagagtggacgccagcaacacccaccccgaccccagattcctgcacctgggccccttcaaggacaccgccgtggtgaagatcagcgtggaggacatcgacgagccccccgtgttcaccaaggtgagctacctgatcgaggtggacgaggacgtgaaggagggcagcatcatcggccaggtgaccgcctacgaccccgacgccagaaacaacctgatcaagtacagcgtggacagacacaccgacatggacagaatcttcggcatccacagcgagaacggcagcatcttcaccctgaaggccctggacagagagagcagcccctggcacaacatcaccgtgaccgccaccgagatcaacaaccccaagcagagcagccacatccccgtgttcatcagaatcctggacatcaacgaccacgcccccgagttcgccatgtactacgagaccttcgtgtgcgagaacgccaagcccggccagctgatccagaccgtgagcgtgatggacaaggacgacccccccagaggccacaagttcttcttcgagcccgtgcccgagttcaccctgaaccccaacttcaccatcgtggacaacaaggacaacaccgccggcatcatgaccagaaaggacggctacagcagaaacaagatgagcacctacctgctgcccatcctgatcttcgacaacgactaccccatccagagcagcaccggcaccctgaccatcagagtgtgcgcctgcgacaaccagggcaacatgcagagctgcaccgccgaggccctgatcctgagcgccggcctgagcaccggcgccctggtggccatcctgctgtgcgtgctgatcctgctgatcctggtggtgctgttcgccgccctgaagagacagagaaagaaggagcccctgatcatcagcaaggacgacgtgagagacaacatcgtgacctacaacgacgagggcggcggcgaggaggacacccaggccttcgacatcggcaccctgagaaaccccgaggccagagaggacagcaagctgagaagagacgtgatgcccgagaccatcttccagatcagaagaaccgtgcccctgtgggagaacatcgacgtgcaggacttcatccacagaagactgaaggagaacgacgccgaccccagcgcccccccctacgacagcctggccacctacgcctacgagggcaacgacagcatcgccgacagcctgagcagcctggagagcctgaccgccgactgcaaccaggactacgactacctgagcgactggggccccagattcaagaagctggccgacatgtacggcggcgacgacagcgacagagactag

SEQ ID NO: 12812 - DNA, 162 bp, Artificial Sequence
  Description of Artificial Sequence: Synthetic coding sequence
atgagagcctggatcttcttcctgctgtgcctggccggcagagccctggccgccccccagcaggaggccctgcccgacgagaccgaggtggtggaggagaccgtggccgaggtgaccgaggtgagcgtgggcgccaaccccgtgcaggtggaggtgggctag

SEQ ID NO: 12813 - DNA, 336 bp, Artificial Sequence
  Description of Artificial Sequence: Synthetic coding sequence
atgagagcctggatcttcttcctgctgtgcctggccggcagagccctggccgccccccagcaggaggccctgcccgacgagaccgaggtggtggaggagaccgtggccgaggtgaccgaggtgagcgtgggcgccaaccccgtgcaggtggaggtgggcgagttcgacgacggcgccgaggagaccgaggaggaggtggtggccgagaacccctgccagaaccaccactgcaagcacggcaaggtgtgcgagctggacgagaacaacacccccatgtgcgtgtgccaggaccccaccagctgccccgcccccatcggcgagttcgagaaggtgtag

SEQ ID NO: 12814 - DNA, 276 bp, Artificial Sequence
  Description of Artificial Sequence: Synthetic coding sequence
atgaagctggccgtgaccctgaccctggtgaccctggccctgtgctgcagcagcgccagcgccgagatctgccccagcttccagagagtgatcgagaccctgctgatggacacccccagcagctacgaggccgccatggagctgttcagccccgaccaggacatgagagaggccggcgcccagctgaagaagctggtggacaccctgccccagaagcccagagagagcatcatcaagctgatggagaagatcgcccagagcagcctgtgcaactag

SEQ ID NO: 12815 - DNA, 1380 bp, Artificial Sequence
  Description of Artificial Sequence: Synthetic coding sequence
atgatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 12816 - DNA, 1437 bp, Artificial Sequence
  Description of Artificial Sequence: Synthetic coding sequence
atggacagaagcctgggctggcagggcaacagcgtgcccgaggacagaaccgaggccggcatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 12817 - DNA, 1380 bp, Artificial Sequence; identical to SEQ ID NO: 12815
  Description of Artificial Sequence: Synthetic coding sequence

SEQ ID NO: 12818 - DNA, 1413 bp, Artificial Sequence
  Description of Artificial Sequence: Synthetic coding sequence
atgcccggcttctacagcgtgatgaccgacgaggagatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 12819 - DNA, 825 bp, Artificial Sequence
  Description of Artificial Sequence: Synthetic coding sequence
atgatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggctacggccccagcctgagactgctggccccccccggcgccgtgaagggcaccggccaggagcaccagggccagggctgccactag

SEQ ID NO: 12820 - DNA, 1479 bp, Artificial Sequence
  Description of Artificial Sequence: Synthetic coding sequence
tacagcagccccgccctgttcagcagcagagccgccccccagaagcccagaaaggagggcagccaggccgccggcctgctggtgttcagcgacagcctggagatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 12821 - DNA, 996 bp, Artificial Sequence
  Description of Artificial Sequence: Synthetic coding sequence
atggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 12822 - DNA, 1311 bp, Artificial Sequence
  Description of Artificial Sequence: Synthetic coding sequence
atgagcgtgagcgccagaagcgccgccgccgaggagagaagcgtgaacagcagcaccatgggccagcagaagaacctggagggctacgtgggcttcgccaacctgcccaaccaggtgtacagaaagagcgtgaagagaggcttcgagttcaccctgatggtggtgggcgagagcggcctgggcaagagcaccctgatcaacagcctgttcctgaccgacctgtacagccccgagtaccccggccccagccacagaatcaagaagaccgtgcaggtggagcagagcaaggtgctgatcaaggagggcggcgtgcagctgctgctgaccatcgtggacacccccggcttcggcgacgccgtggacaacagcaactgctggcagcccgtgatcgactacatcgacagcaagttcgaggactacctgaacgccgagagcagagtgaacagaagacagatgcccgacaacagagtgcagtgctgcctgtacttcatcgcccccagcggccacggcctgaagcccctggacatcgagttcatgaagagactgcacgagaaggtgaacatcatccccctgatcgccaaggccgacaccctgacccccgaggagtgccagcagttcaagaagcagatcatgaaggagatccaggagcacaagatcaagatctacgagttccccgagaccgacgacgaggaggagaacaagctggtgaagaagatcaaggacagactgcccctggccgtggtgggcagcaacaccatcatcgaggtgaacggcaagagagtgagaggcagacagtacccctggggcgtggccgaggtggagaacggcgagcactgcgacttcaccatcctgagaaacatgctgatcagaacccacatgcaggacctgaaggacgtgaccaacaacgtgcactacgagaactacagaagcagaaagctggccgccgtgacctacaacggcgtggacaacaacaagaacaagggccagctgaccaagagccccctggcccagatggaggaggagagaagagagcacgtggccaagatgaagaagatggagatggagatggagcaggtgttcgagatgaaggtgaaggagaaggtgcagaagctgaaggacagcgaggccgagctgcagagaagacacgagcagatgaagaagaacctggaggcccagcacaaggagctggaggagaagagaagacagttcgaggacgagaaggccaactgggaggcccagcagagaatcctggagcagcagaacagcagcagaaccctggagaagaacaagaagaagggcaagatcttctag

SEQ ID NO: 12823 - DNA, 1317 bp, Artificial Sequence
  Description of Artificial Sequence: Synthetic coding sequence
atgagcgtgagcgccagaagcgccgccgccgaggagagaagcgtgaacagcagcaccatggaggtggcccagcagaagaacctggagggctacgtgggcttcgccaacctgcccaaccaggtgtacagaaagagcgtgaagagaggcttcgagttcaccctgatggtggtgggcgagagcggcctgggcaagagcaccctgatcaacagcctgttcctgaccgacctgtacagccccgagtaccccggccccagccacagaatcaagaagaccgtgcaggtggagcagagcaaggtgctgatcaaggagggcggcgtgcagctgctgctgaccatcgtggacacccccggcttcggcgacgccgtggacaacagcaactgctggcagcccgtgatcgactacatcgacagcaagttcgaggactacctgaacgccgagagcagagtgaacagaagacagatgcccgacaacagagtgcagtgctgcctgtacttcatcgcccccagcggccacggcctgaagcccctggacatcgagttcatgaagagactgcacgagaaggtgaacatcatccccctgatcgccaaggccgacaccctgacccccgaggagtgccagcagttcaagaagcagatcatgaaggagatccaggagcacaagatcaagatctacgagttccccgagaccgacgacgaggaggagaacaagctggtgaagaagatcaaggacagactgcccctggccgtggtgggcagcaacaccatcatcgaggtgaacggcaagagagtgagaggcagacagtacccctggggcgtggccgaggtggagaacggcgagcactgcgacttcaccatcctgagaaacatgctgatcagaacccacatgcaggacctgaaggacgtgaccaacaacgtgcactacgagaactacagaagcagaaagctggccgccgtgacctacaacggcgtggacaacaacaagaacaagggccagctgaccaagagccccctggcccagatggaggaggagagaagagagcacgtggccaagatgaagaagatggagatggagatggagcaggtgttcgagatgaaggtgaaggagaaggtgcagaagctgaaggacagcgaggccgagctgcagagaagacacgagcagatgaagaagaacctggaggcccagcacaaggagctggaggagaagagaagacagttcgaggacgagaaggccaactgggaggcccagcagagaatcctggagcagcagaacagcagcagaaccctggagaagaacaagaagaagggcaagatcttctag

SEQ ID NO: 12824 - DNA, 1311 bp, Artificial Sequence
  Description of Artificial Sequence: Synthetic coding sequence
atgagcgtgagcgccagaagcgccgccgccgaggagagaagcgtgaacagcagcaccatggtgcagcagaagaacctggagggctacgtgggcttcgccaacctgcccaaccaggtgtacagaaagagcgtgaagagaggcttcgagttcaccctgatggtggtgggcgagagcggcctgggcaagagcaccctgatcaacagcctgttcctgaccgacctgtacagccccgagtaccccggccccagccacagaatcaagaagaccgtgcaggtggagcagagcaaggtgctgatcaaggagggcggcgtgcagctgctgctgaccatcgtggacacccccggcttcggcgacgccgtggacaacagcaactgctggcagcccgtgatcgactacatcgacagcaagttcgaggactacctgaacgccgagagcagagtgaacagaagacagatgcccgacaacagagtgcagtgctgcctgtacttcatcgcccccagcggccacggcctgaagcccctggacatcgagttcatgaagagactgcacgagaaggtgaacatcatccccctgatcgccaaggccgacaccctgacccccgaggagtgccagcagttcaagaagcagatcatgaaggagatccaggagcacaagatcaagatctacgagttccccgagaccgacgacgaggaggagaacaagctggtgaagaagatcaaggacagactgcccctggccgtggtgggcagcaacaccatcatcgaggtgaacggcaagagagtgagaggcagacagtacccctggggcgtggccgaggtggagaacggcgagcactgcgacttcaccatcctgagaaacatgctgatcagaacccacatgcaggacctgaaggacgtgaccaacaacgtgcactacgagaactacagaagcagaaagctggccgccgtgacctacaacggcgtggacaacaacaagaacaagggccagctgaccaagagccccctggcccagatggaggaggagagaagagagcacgtggccaagatgaagaagatggagatggagatggagcaggtgttcgagatgaaggtgaaggagaaggtgcagaagctgaaggacagcgaggccgagctgcagagaagacacgagcagatgaagaagaacctggaggcccagcacaaggagctggaggagaagagaagacagttcgaggacgagaaggccaactgggaggcccagcagagaatcctggagcagcagaacagcagcagaaccctggagaagaacaagaagaagggcaagatcttctag

SEQ ID NO: 12825 - DNA, 267 bp, Artificial Sequence
  Description of Artificial Sequence: Synthetic coding sequence
atgaagaagatggagatggagatggagcaggtgttcgagatgaaggtgaaggagaaggtgcagaagctgaaggacagcgaggccgagctgcagagaagacacgagcagatgaagaagaacctggaggcccagcacaaggagctggaggagaagagaagacagttcgaggacgagaaggccaactgggaggcccagcagagaatcctggagcagcagaacagcagcagaaccctggagaagaacaagaagaagggcaagatcttctag

SEQ ID NO: 12826 - DNA, 1155 bp, Artificial Sequence
  Description of Artificial Sequence: Synthetic coding sequence
atggtggtgggcgagagcggcctgggcaagagcaccctgatcaacagcctgttcctgaccgacctgtacagccccgagtaccccggccccagccacagaatcaagaagaccgtgcaggtggagcagagcaaggtgctgatcaaggagggcggcgtgcagctgctgctgaccatcgtggacacccccggcttcggcgacgccgtggacaacagcaactgctggcagcccgtgatcgactacatcgacagcaagttcgaggactacctgaacgccgagagcagagtgaacagaagacagatgcccgacaacagagtgcagtgctgcctgtacttcatcgcccccagcggccacggcctgaagcccctggacatcgagttcatgaagagactgcacgagaaggtgaacatcatccccctgatcgccaaggccgacaccctgacccccgaggagtgccagcagttcaagaagcagatcatgaaggagatccaggagcacaagatcaagatctacgagttccccgagaccgacgacgaggaggagaacaagctggtgaagaagatcaaggacagactgcccctggccgtggtgggcagcaacaccatcatcgaggtgaacggcaagagagtgagaggcagacagtacccctggggcgtggccgaggtggagaacggcgagcactgcgacttcaccatcctgagaaacatgctgatcagaacccacatgcaggacctgaaggacgtgaccaacaacgtgcactacgagaactacagaagcagaaagctggccgccgtgacctacaacggcgtggacaacaacaagaacaagggccagctgaccaagagccccctggcccagatggaggaggagagaagagagcacgtggccaagatgaagaagatggagatggagatggagcaggtgttcgagatgaaggtgaaggagaaggtgcagaagctgaaggacagcgaggccgagctgcagagaagacacgagcagatgaagaagaacctggaggcccagcacaaggagctggaggagaagagaagacagttcgaggacgagaaggccaactgggaggcccagcagagaatcctggagcagcagaacagcagcagaaccctggagaagaacaagaagaagggcaagatcttctag

SEQ ID NO: 12827 - DNA, 708 bp, Artificial Sequence
  Description of Artificial Sequence: Synthetic coding sequence
atgagcgtgagcgccagaagcgccgccgccgaggagagaagcgtgaacagcagcaccatgggccagcagaagaacctggagggctacgtgggcttcgccaacctgcccaaccaggtgtacagaaagagcgtgaagagaggcttcgagttcaccctgatggtggtgggcgagagcggcctgggcaagagcaccctgatcaacagcctgttcctgaccgacctgtacagccccgagtaccccggccccagccacagaatcaagaagaccgtgcaggtggagcagagcaaggtgctgatcaaggagggcggcgtgcagctgctgctgaccatcgtggacacccccggcttcggcgacgccgtggacaacagcaactgctggcagcccgtgatcgactacatcgacagcaagttcgaggactacctgaacgccgagagcagagtgaacagaagacagatgcccgacaacagagtgcagtgctgcctgtacttcatcgcccccagcggccacggcctgaagcccctggacatcgagttcatgaagagactgcacgagaaggtgaacatcatccccctgatcgccaaggccgacaccctgacccccgaggagtgccagcagttcaagaagcagatcatgaaggagatccaggagcacaagatcaagatctacgagttccccgagaccgccaagaagaagaagaagaagaagtag

SEQ ID NO: 12828 - DNA, 1155 bp, Artificial Sequence; identical to SEQ ID NO: 12826
  Description of Artificial Sequence: Synthetic coding sequence

SEQ ID NO: 12829 - DNA, 1146 bp, Artificial Sequence
  Description of Artificial Sequence: Synthetic coding sequence
gtgacccacgagaccatcgtggagcagcagaagaacctggagggctacgtgggcttcgccaacctgcccaaccaggtgtacagaaagagcgtgaagagaggcttcgagttcaccctgatggtggtgggcgagagcggcctgggcaagagcaccctgatcaacagcctgttcctgaccgacctgtacagccccgagtaccccggccccagccacagaatcaagaagaccgtgcaggtggagcagagcaaggtgctgatcaaggagggcggcgtgcagctgctgctgaccatcgtggacacccccggcttcggcgacgccgtggacaacagcaactgctggcagcccgtgatcgactacatcgacagcaagttcgaggactacctgaacgccgagagcagagtgaacagaagacagatgcccgacaacagagtgcagtgctgcctgtacttcatcgcccccagcggccacggcctgaagcccctggacatcgagttcatgaagagactgcacgagaaggtgaacatcatccccctgatcgccaaggccgacaccctgacccccgaggagtgccagcagttcaagaagcagatcatgaaggagatccaggagcacaagatcaagatctacgagttccccgagaccgacgacgaggaggagaacaagctggtgaagaagatcaaggacagactgcccctggccgtggtgggcagcaacaccatcatcgaggtgaacggcaagagagtgagaggcagacagtacccctggggcgtggccgaggtggagaacggcgagcactgcgacttcaccatcctgagaaacatgctgatcagaacccacatgcaggacctgaaggacgtgaccaacaacgtgcactacgagaactacagaagcagaaagctggccgccgtgacctacaacggcgtggacaacaacaagaacaagggccagctgaccaagagccccctggcccagatggaggaggagagaagagagcacgtggccaagatgaagaagatggagatggagatggagcaggtgttcgagatgaaggtgaaggagaaggtgcagaagctgaaggacagcgaggccgaggtgatcagcctgatcagccacctgctggccgacatcgtgttcctgttcaagtag

SEQ ID NO: 12830 - DNA, 1149 bp, Artificial Sequence
  Description of Artificial Sequence: Synthetic coding sequence
atgggcgagagcggcctgggcaagagcaccctgatcaacagcctgttcctgaccgacctgtacagccccgagtaccccggccccagccacagaatcaagaagaccgtgcaggtggagcagagcaaggtgctgatcaaggagggcggcgtgcagctgctgctgaccatcgtggacacccccggcttcggcgacgccgtggacaacagcaactgctggcagcccgtgatcgactacatcgacagcaagttcgaggactacctgaacgccgagagcagagtgaacagaagacagatgcccgacaacagagtgcagtgctgcctgtacttcatcgcccccagcggccacggcctgaagcccctggacatcgagttcatgaagagactgcacgagaaggtgaacatcatccccctgatcgccaaggccgacaccctgacccccgaggagtgccagcagttcaagaagcagatcatgaaggagatccaggagcacaagatcaagatctacgagttccccgagaccgacgacgaggaggagaacaagctggtgaagaagatcaaggacagactgcccctggccgtggtgggcagcaacaccatcatcgaggtgaacggcaagagagtgagaggcagacagtacccctggggcgtggccgaggtggagaacggcgagcactgcgacttcaccatcctgagaaacatgctgatcagaacccacatgcaggacctgaaggacgtgaccaacaacgtgcactacgagaactacagaagcagaaagctggccgccgtgacctacaacggcgtggacaacaacaagaacaagggccagctgaccaagagccccctggcccagatggaggaggagagaagagagcacgtggccaagatgaagaagatggagatggagatggagcaggtgttcgagatgaaggtgaaggagaaggtgcagaagctgaaggacagcgaggccgagctgcagagaagacacgagcagatgaagaagaacctggaggcccagcacaaggagctggaggagaagagaagacagttcgaggacgagaaggccaactgggaggcccagcagagaatcctggagcagcagaacagcagcagaaccctggagaagaacaagaagaagggcaagatcttctag

SEQ ID NO: 12831 - DNA, 1302 bp, Artificial Sequence
  Description of Artificial Sequence: Synthetic coding sequence
atggaggtggtggacccccagcagctgggcatgttcaccgagggcgagctgatgagcgtgggcatggacaccttcatccacagaatcgacagcaccgaggtgatctaccagcccagaagaaagagagccaagctgatcggcaagtacctgatgggcgacctgctgggcgagggcagctacggcaaggtgaaggaggtgctggacagcgagaccctgtgcagaagagccgtgaagatcctgaagaagaagaagctgagaagaatccccaacggcgaggccaacgtgaagaaggagatccagctgctgagaagactgagacacaagaacgtgatccagctggtggacgtgctgtacaacgaggagaagcagaagatgtacatggtgatggagtactgcgtgtgcggcatgcaggagatgctggacagcgtgcccgagaagagattccccgtgtgccaggcccacggctacttctgccagctgatcgacggcctggagtacctgcacagccagggcatcgtgcacaaggacatcaagcccggcaacctgctgctgaccaccggcggcaccctgaagatcagcgacctgggcgtggccgaggccctgcaccccttcgccgccgacgacacctgcagaaccagccagggcagccccgccttccagccccccgagatcgccaacggcctggacaccttcagcggcttcaaggtggacatctggagcgccggcgtgaccctgtacaacatcaccaccggcctgtaccccttcgagggcgacaacatctacaagctgttcgagaacatcggcaagggcagctacgccatccccggcgactgcggcccccccctgagcgacctgctgaagggcatgctggagtacgagcccgccaagagattcagcatcagacagatcagacagcacagctggttcagaaagaagcacccccccgccgaggcccccgtgcccatcccccccagccccgacaccaaggacagatggagaagcatgaccgtggtgccctacctggaggacctgcacggcgccgacgaggacgaggacctgttcgacatcgaggacgacatcatctacacccaggacttcaccgtgcccggccaggtgcccgaggaggaggccagccacaacggccagagaagaggcctgcccaaggccgtgtgcatgaacggcaccgaggccgcccagctgagcaccaagagcagagccgagggcagagcccccaaccccgccagaaaggcctgcagcgccagcagcaagatcagaagactgagcgcctgcaagcagcagtag

SEQ ID NO: 12832 - DNA, 1299 bp, Artificial Sequence
  Description of Artificial Sequence: Synthetic coding sequence
atggaggtggtggacccccagcagctgggcatgttcaccgagggcgagctgatgagcgtgggcatggacaccttcatccacagaatcgacagcaccgaggtgatctaccagcccagaagaaagagagccaagctgatcggcaagtacctgatgggcgacctgctgggcgagggcagctacggcaaggtgaaggaggtgctggacagcgagaccctgtgcagaagagccgtgaagatcctgaagaagaagaagctgagaagaatccccaacggcgaggccaacgtgaagaaggagatccagctgctgagaagactgagacacaagaacgtgatccagctggtggacgtgctgtacaacgaggagaagcagaagatgtacatggtgatggagtactgcgtgtgcggcatgcaggagatgctggacagcgtgcccgagaagagattccccgtgtgccaggcccacggctacttctgccagctgatcgacggcctggagtacctgcacagccagggcatcgtgcacaaggacatcaagcccggcaacctgctgctgaccaccggcggcaccctgaagatcagcgacctgggcgtggccgaggccctgcaccccttcgccgccgacgacacctgcagaaccagccagggcagccccgccttccagccccccgagatcgccaacggcctggacaccttcagcggcttcaaggtggacatctggagcgccggcgtgaccctgtacaacatcaccaccggcctgtaccccttcgagggcgacaacatctacaagctgttcgagaacatcggcaagggcagctacgccatccccggcgactgcggcccccccctgagcgacctgctgaagggcatgctggagtacgagcccgccaagagattcagcatcagacagatcagacagcacagctggttcagaaagaagcacccccccgccgaggcccccgtgcccatcccccccagccccgacaccaaggacagatggagaagcatgaccgtggtgccctacctggaggacctgcacggcgccgacgaggacgaggacctgttcgacatcgaggacgacatcatctacacccaggacttcaccgtgcccggccaggtgcccgaggaggaggccagccacaacggccagagaagaggcctgcccaaggccgtgtgcatgaacggcaccgaggccgcccagctgagcaccaagagcagagccgaggccggcccccccaccctgcccgccagacccgccgccagcagcaagatcagaagactgagcgcctgcaagcagcagtag

SEQ ID NO: 12833 - DNA, 1248 bp, Artificial Sequence
  Description of Artificial Sequence: Synthetic coding sequence
atggaggacctgtgcgtggccaacaccctgttcgccctgaacctgttcaagcacctggccaaggccagccccacccagaacctgttcctgagcccctggagcatcagcagcaccatggccatggtgtacatgggcagcagaggcagcaccgaggaccagatggccaaggtgctgcagttcaacgaggtgggcgccaacgccgtgacccccatgacccccgagaacttcaccagctgcggcttcatgcagcagatccagaagggcagctaccccgacgccatcctgcaggcccaggccgccgacaagatccacagcagcttcagaagcctgagcagcgccatcaacgccagcaccggcaactacctgctggagagcgtgaacaagctgttcggcgagaagagcgccagcttcagagaggagtacatcagactgtgccagaagtactacagcagcgagccccaggccgtggacttcctggagtgcgccgaggaggccagaaagaagatcaacagctgggtgaagacccagaccaagggcaagatccccaacctgctgcccgagggcagcgtggacggcgacaccagaatggtgctggtgaacgccgtgtacttcaagggcaagtggaagacccccttcgagaagaagctgaacggcctgtaccccttcagagtgaacagcgcccagagaacccccgtgcagatgatgtacctgagagagaagctgaacatcggctacatcgaggacctgaaggcccagatcctggagctgccctacgccggcgacgtgagcatgttcctgctgctgcccgacgagatcgccgacgtgagcaccggcctggagctgctggagagcgagatcacctacgacaagctgaacaagtggaccagcaaggacaagatggccgaggacgaggtggaggtgtacatcccccagttcaagctggaggagcactacgagctgagaagcatcctgagaagcatgggcatggaggacgccttcaacaagggcagagccaacttcagcggcatgagcgagagaaacgacctgttcctgagcgaggtgttccaccaggccatggtggacgtgaacgaggagggcaccgaggccgccgccggcaccggcggcgtgatgaccggcagaaccggccacggcggcccccagttcgtggccgaccaccccttcctgttcctgatcatgcacaagatcaccaactgcatcctgttcttcggcagattcagcagcccctag

SEQ ID NO: 12834 - DNA, 342 bp, Artificial Sequence
  Description of Artificial Sequence: Synthetic coding sequence
atggaggacctgtgcgtggccaacaccctgttcgccctgaacctgttcaagcacctggccaaggccagccccacccagaacctgttcctgagcccctggagcatcagcagcaccatggccatggtgtacatgggcagcagaggcagcaccgaggaccagatggccaaggtgctgcagttcaacgaggtgggcgccaacgccgtgacccccatgacccccgagaacttcaccagctgcggcttcatgcagcagatccagaagggcagctaccccgacgccatcctgcaggcccaggccgccgacaagatccacagcagcttcagaagcctgagcagcgcctag

SEQ ID NO: 12835 - DNA, 486 bp, Artificial Sequence
  Description of Artificial Sequence: Synthetic coding sequence
atggaggacctgtgcgtggccaacaccctgttcgccctgaacctgttcaagcacctggccaaggccagccccacccagaacctgttcctgagcccctggagcatcagcagcaccatggccatggtgtacatgggcagcagaggcagcaccgaggaccagatggccaaggtgctgcagttcaacgaggtgggcgccaacgccgtgacccccatgacccccgagaacttcaccagctgcggcttcatgcagcagatccagaagggcagctaccccgacgccatcctgcaggcccaggccgccgacaagatccacagcagcttcagaagcctgagcagcgccatcaacgccagcaccggcaactacctgctggagagcgtgaacaagctgttcggcgagaagagcgccagcttcagagaggagtacatcagactgtgccagaagtactacagcagcgagccccaggccgtggacttcctggagtgctag

SEQ ID NO: 12836 - DNA, 399 bp, Artificial Sequence
  Description of Artificial Sequence: Synthetic coding sequence
atggaggacctgtgcgtggccaacaccctgttcgccctgaacctgttcaagcacctggccaaggccagccccacccagaacctgttcctgagcccctggagcatcagcagcaccatggccatggtgtacatgggcagcagaggcagcaccgaggaccagatggccaaggtgctgcagttcaacgaggtgggcgccaacgccgtgacccccatgacccccgagaacttcaccagctgcggcttcatgcagcagatccagaagggcagctaccccgacgccatcctgcaggcccaggccgccgacaagatccacagcagcttcagaagcctgagcagcgccatcaacgccagcaccggcaactacctgctggagagcgtgaacaagctgttcggcgagtag

SEQ ID NO: 12837 - DNA, 1248 bp, Artificial Sequence; identical to SEQ ID NO: 12833
  Description of Artificial Sequence: Synthetic coding sequence

SEQ ID NO: 12838 - DNA, 2280 bp, Artificial Sequence
  Description of Artificial Sequence: Synthetic coding sequence
atggccggcctgaccctgttcgtgggcagactgccccccagcgccagaagcgagcagctggaggagctgttcagccaggtgggccccgtgaagcagtgcttcgtggtgaccgagaagggcagcaaggcctgcagaggcttcggctacgtgaccttcagcatgctggaggacgtgcagagagccctgaaggagatcaccaccttcgagggctgcaagatcaacgtgaccgtggccaagaagaagctgagaaacaagaccaaggagaagggcaagaacgagaacagcgagtgccccaagaaggagcccaaggccaagaaggccaaggtggccgacaagaaggccagactgatcatcagaaacctgagcttcaagtgcagcgaggacgacctgaagaccgtgttcgcccagttcggcgccgtgctggaggtgaacatccccagaaagcccgacggcaagatgagaggcttcggcttcgtgcagttcaagaacctgctggaggccggcaaggccctgaagggcatgaacatgaaggagatcaagggcagaaccgtggccgtggactgggccgtggccaaggacaagtacaaggacacccagagcgtgagcgccatcggcgaggagaagagccacgagagcaagcaccaggagagcgtgaagaagaagggcagagaggaggaggacatggaggaggaggagaacgacgacgacgacgacgacgacgacgaggaggacggcgtgttcgacgacgaggacgaggaggaggagaacatcgagagcaaggtgaccaagcccgtgcagatccagaagagagccgtgaagagacccgcccccgccaagagcagcgaccacagcgaggaggacagcgacctggaggagagcgacagcatcgacgacggcgaggagctggcccagagcgacaccagcaccgaggagcaggaggacaaggccgtgcaggtgagcaacaagaagaagagaaagctgcccagcgacgtgaacgagggcaagaccgtgttcatcagaaacctgagcttcgacagcgaggaggaggagctgggcgagctgctgcagcagttcggcgagctgaagtacgtgagaatcgtgctgcaccccgacaccgagcacagcaagggctgcgccttcgcccagttcatgacccaggaggccgcccagaagtgcctgctggccgccagccccgagaacgaggccggcggcctgaagctggacggcagacagctgaaggtggacctggccgtgaccagagacgaggccgccaagctgcagaccaccaaggtgaagaagcccaccggcaccagaaacctgtacctggccagagagggcctgatcagagccggcaccaaggccgccgagggcgtgagcgccgccgacatggccaagagagagagattcgagctgctgaagcaccagaagctgaaggaccagaacatcttcgtgagcagaaccagactgtgcctgcacaacctgcccaaggccgtggacgacaagcagctgagaaagctgctgctgagcgccaccagcggcgagaagggcgtgagaatcaaggagtgcagagtgatgagagacctgaagggcgtgcacggcaacatgaagggccagagcctgggctacgccttcgccgagttccaggagcacgagcacgccctgaaggccctgagactgatcaacaacaaccccgagatcttcggccccctgaagagacccatcgtggagttcagcctggaggacagaagaaagctgaagatgaaggagctgagaatccagagaagcctgcagaagatgagaagcaagcccgccaccggcgagccccagaagggccagcccgagcccgccaaggaccagcagcagaaggccgcccagcaccacaccgaggagcagagcaaggtgccccccgagcagaagagaaaggccggcagcaccagctggaccggcttccagaccaaggccgaggtggagcaggtggagctgcccgacggcaagaagagaagaaaggtgctggccctgcccagccacagaggccccaagatcagactgagagacaagggcaaggtgaagcccgtgcaccccaagaagcccaagccccagatcaaccagtggaagcaggagaagcagcagctgagcagcgagcaggtgagcagaaagaaggccaagggcaacaagaccgagaccagattcaaccagctggtggagcagtacaagcagaagctgctgggccccagcaagggcgcccccctggccaagagaagcaagtggttcgacagctag

SEQ ID NO: 12839 - DNA, 1164 bp, Artificial Sequence
  Description of Artificial Sequence: Synthetic coding sequence
atgcagatgagccccgccctgacctgcctggtgctgggcctggccctggtgttcggcgagggcagcgccgtgcaccacccccccagctacgtggcccaggccagcaaggacagaaacgtggtgttcagcccctacggcgtggccagcgtgctggccatgctgcagctgaccaccggcggcgagacccagcagcagatccaggccgccatgggcttcaagatcgacgacaagggcatggcccccgccctgagacacctgtacaaggagctgatgggcccctggaacaaggacgagatcagcaccaccgacgccatcttcgtgcagagagacctgaagctggtgcagggcttcatgccccacttcttcagactgttcagaagcaccgtgaagcaggtggacttcagcgaggtggagagagccagattcatcatcaacgactgggtgaagacccacaccaagggcatgatcagcaacctgctgggcaagggcgccgtggaccagctgaccagactggtgctggtgaacgccctgtacttcaacggccagtggaagacccccttccccgacagcagcacccacagaagactgttccacaagagcgacggcagcaccgtgagcgtgcccatgatggcccagaccaacaagttcaactacaccgagttcaccacccccgacggccactactacgacatcctggagctgccctaccacggcgacaccctgagcatgttcatcgccgccccctacgagaaggaggtgcccctgagcgccctgaccaacatcctgagcgcccagctgatcagccactggaagggcaacatgaccagactgcccagactgctggtgctgcccaagttcagcctggagaccgaggtggacctgagaaagcccctggagaacctgggcatgaccgacatgttcagacagttccaggccgacttcaccagcctgagcgaccaggagcccctgcacgtggcccaggccctgcagaaggtgaagatcgaggtgaacgagagcggcaccgtggccagcagcagcaccgccgtgatcgtgagcgccagaatggcccccgaggagatcatcatggacagacccttcctgttcgtggtgagacacaaccccaccggcaccgtgctgttcatgggccaggtgatggagccctag

SEQ ID NO: 12840 - DNA, 540 bp, Artificial Sequence
  Description of Artificial Sequence: Synthetic coding sequence
atgatggcccagaccaacaagttcaactacaccgagttcaccacccccgacggccactactacgacatcctggagctgccctaccacggcgacaccctgagcatgttcatcgccgccccctacgagaaggaggtgcccctgagcgccctgaccaacatcctgagcgcccagctgatcagccactggaagggcaacatgaccagactgcccagactgctggtgctgcccaagttcagcctggagaccgaggtggacctgagaaagcccctggagaacctgggcatgaccgacatgttcagacagttccaggccgacttcaccagcctgagcgaccaggagcccctgcacgtggcccaggccctgcagaaggtgaagatcgaggtgaacgagagcggcaccgtggccagcagcagcaccgccgtgatcgtgagcgccagaatggcccccgaggagatcatcatggacagacccttcctgttcgtggtgagacacaaccccaccggcaccgtgctgttcatgggccaggtgatggagccctag

SEQ ID NO: 12841 - DNA, 711 bp, Artificial Sequence
  Description of Artificial Sequence: Synthetic coding sequence
atgctgagcaagggcctgaagagaaagagagaggaggaggaggagaaggagcccctggccgtggacagctggtggctggaccccggccacaccgccgtggcccaggccccccccgccgtggccagcagcagcctgttcgacctgagcgtgctgaagctgcaccacagcctgcagcagagcgagcccgacctgagacacctggtgctggtggtgaacaccctgagaagaatccaggccagcatggcccccgccgccgccctgccccccgtgcccagcccccccgccgcccccagcgtggccgacaacctgctggccagcagcgacgccgccctgagcgccagcatggccagcctgctggaggacctgagccacatcgagggcctgagccaggccccccagcccctggccgacgagggcccccccggcagaagcatcggcggcgccgcccccagcctgggcgccctggacctgctgggccccgccaccggctgcctgctggacgacggcctggagggcctgttcgaggacatcgacaccagcatgtacgacaacgagctgtgggcccccgccagcgagggcctgaagcccggccccgaggacggccccggcaaggaggaggcccccgagctggacgaggccgagctggactacctgatggacgtgctggtgggcacccaggccctggagagaccccccggccccggcagatag

SEQ ID NO: 12842 - DNA, 1527 bp, Artificial Sequence
  Description of Artificial Sequence: Synthetic coding sequence
atgctgcccacccaggccggcgccgccgccgccctgggcagaggcagcgccctgggcggcagcctgaacagaacccccaccggcagacccggcggcggcggcggcaccagaggcgccaacggcggcagagtgcccggcaacggcgccggcctgggccccggcagactggagagagaggccgccgccgccgccgccaccacccccgcccccaccgccggcgccctgtacagcggcagcgagggcgacagcgagagcggcgaggaggaggagctgggcgccgagagaagaggcctgaagagaagcctgagcgagatggagatcggcatggtggtgggcggccccgaggccagcgccgccgccaccggcggctacggccccgtgagcggcgccgtgagcggcgccaagcccggcaagaagaccagaggcagagtgaagatcaagatggagttcatcgacaacaagctgagaagatacaccaccttcagcaagagaaagaccggcatcatgaagaaggcctacgagctgagcaccctgaccggcacccaggtgctgctgctggtggccagcgagaccggccacgtgtacaccttcgccaccagaaagctgcagcccatgatcaccagcgagaccggcaaggccctgatccagacctgcctgaacagccccgacagcccccccagaagcgaccccaccaccgaccagagaatgagcgccaccggcttcgaggagaccgacctgacctaccaggtgagcgagagcgacagcagcggcgagaccaaggacaccctgaagcccgccttcaccgtgaccaacctgcccggcaccaccagcaccatccagaccgcccccagcaccagcaccaccatgcaggtgagcagcggccccagcttccccatcaccaactacctggcccccgtgagcgccagcgtgagccccagcgccgtgagcagcgccaacggcaccgtgctgaagagcaccggcagcggccccgtgagcagcggcggcctgatgcagctgcccaccagcttcaccctgatgcccggcggcgccgtggcccagcaggtgcccgtgcaggccatccaggtgcaccaggccccccagcaggccagccccagcagagacagcagcaccgacctgacccagaccagcagcagcggcaccgtgaccctgcccgccaccatcatgaccagcagcgtgcccaccaccgtgggcggccacatgatgtaccccagcccccacgccgtgatgtacgcccccaccagcggcctgggcgacggcagcctgaccgtgctgaacgccttcagccaggcccccagcaccatgcaggtgagccacagccaggtgcaggagcccggcggcgtgccccaggtgttcctgaccgccagcagcggcaccgtgcagatccccgtgagcgccgtgcagctgcaccagatggccgtgatcggccagcaggccggcagcagcagcaacctgaccgagctgcaggtggtgaacctggacaccgcccacagcaccaagagcgagtag

SEQ ID NO: 12843 - DNA, 915 bp, Artificial Sequence
  Description of Artificial Sequence: Synthetic coding sequence
atgatcaccagcgagaccggcaaggccctgatccagacctgcctgaacagccccgacagcccccccagaagcgaccccaccaccgaccagagaatgagcgccaccggcttcgaggagaccgacctgacctaccaggtgagcgagagcgacagcagcggcgagaccaaggacaccctgaagcccgccttcaccgtgaccaacctgcccggcaccaccagcaccatccagaccgcccccagcaccagcaccaccatgcaggtgagcagcggccccagcttccccatcaccaactacctggcccccgtgagcgccagcgtgagccccagcgccgtgagcagcgccaacggcaccgtgctgaagagcaccggcagcggccccgtgagcagcggcggcctgatgcagctgcccaccagcttcaccctgatgcccggcggcgccgtggcccagcaggtgcccgtgcaggccatccaggtgcaccaggccccccagcaggccagccccagcagagacagcagcaccgacctgacccagaccagcagcagcggcaccgtgaccctgcccgccaccatcatgaccagcagcgtgcccaccaccgtgggcggccacatgatgtaccccagcccccacgccgtgatgtacgcccccaccagcggcctgggcgacggcagcctgaccgtgctgaacgccttcagccaggcccccagcaccatgcaggtgagccacagccaggtgcaggagcccggcggcgtgccccaggtgttcctgaccgccagcagcggcaccgtgcagatccccgtgagcgccgtgcagctgcaccagatggccgtgatcggccagcaggccggcagcagcagcaacctgaccgagctgcaggtggtgaacctggacaccgcccacagcaccaagagcgagtag

SEQ ID NO: 12844 - DNA, 834 bp, Artificial Sequence
  Description of Artificial Sequence: Synthetic coding sequence
atgagcgcccccgccgccaaggtgagcaagaaggagctgaacagcaaccacgacggcgccgacgagaccagcgagaaggagcagcaggaggccatcgagcacatcgacgaggtgcagaacgagatcgacagactgaacgagcaggccagcgaggagatcctgaaggtggagcagaagtacaacaagctgagacagcccttcttccagaagagaagcgagctgatcgccaagatccccaacttctgggtgaccaccttcgtgaaccacccccaggtgagcgccctgctgggcgaggaggacgaggaggccctgcactacctgaccagagtggaggtgaccgagttcgaggacatcaagagcggctacagaatcgacttctacttcgacgagaacccctacttcgagaacaaggtgctgagcaaggagttccacctgaacgagagcggcgaccccagcagcaagagcaccgagatcaagtggaagagcggcaaggacctgaccaagagaagcagccagacccagaacaaggccagcagaaagagacagcacgaggagcccgagagcttcttcacctggttcaccgaccacagcgacgccggcgccgacgagctgggcgaggtgatcaaggacgacatctggcccaaccccctgcagtactacctggtgcccgacatggacgacgaggagggcgagggcgaggaggacgacgacgacgacgaggaggaggagggcctggaggacatcgacgaggagggcgacgaggacgagggcgaggaggacgaggacgacgacgagggcgaggagggcgaggaggacgagggcgaggacgactag

SEQ ID NO: 12845 - DNA, 798 bp, Artificial Sequence
  Description of Artificial Sequence: Synthetic coding sequence
atgcccagaagccaccagccccccccccccccccacgagaaggagcagcaggaggccatcgagcacatcgacgaggtgcagaacgagatcgacagactgaacgagcaggccagcgaggagatcctgaaggtggagcagaagtacaacaagctgagacagcccttcttccagaagagaagcgagctgatcgccaagatccccaacttctgggtgaccaccttcgtgaaccacccccaggtgagcgccctgctgggcgaggaggacgaggaggccctgcactacctgaccagagtggaggtgaccgagttcgaggacatcaagagcggctacagaatcgacttctacttcgacgagaacccctacttcgagaacaaggtgctgagcaaggagttccacctgaacgagagcggcgaccccagcagcaagagcaccgagatcaagtggaagagcggcaaggacctgaccaagagaagcagccagacccagaacaaggccagcagaaagagacagcacgaggagcccgagagcttcttcacctggttcaccgaccacagcgacgccggcgccgacgagctgggcgaggtgatcaaggacgacatctggcccaaccccctgcagtactacctggtgcccgacatggacgacgaggagggcgagggcgaggaggacgacgacgacgacgaggaggaggagggcctggaggacatcgacgaggagggcgacgaggacgagggcgaggaggacgaggacgacgacgagggcgaggagggcgaggaggacgagggcgaggacgactag

SEQ ID NO: 12846 - DNA, 801 bp, Artificial Sequence
  Description of Artificial Sequence: Synthetic coding sequence
atgatgcccagaagccaccagccccccccccccccccacgagaaggagcagcaggaggccatcgagcacatcgacgaggtgcagaacgagatcgacagactgaacgagcaggccagcgaggagatcctgaaggtggagcagaagtacaacaagctgagacagcccttcttccagaagagaagcgagctgatcgccaagatccccaacttctgggtgaccaccttcgtgaaccacccccaggtgagcgccctgctgggcgaggaggacgaggaggccctgcactacctgaccagagtggaggtgaccgagttcgaggacatcaagagcggctacagaatcgacttctacttcgacgagaacccctacttcgagaacaaggtgctgagcaaggagttccacctgaacgagagcggcgaccccagcagcaagagcaccgagatcaagtggaagagcggcaaggacctgaccaagagaagcagccagacccagaacaaggccagcagaaagagacagcacgaggagcccgagagcttcttcacctggttcaccgaccacagcgacgccggcgccgacgagctgggcgaggtgatcaaggacgacatctggcccaaccccctgcagtactacctggtgcccgacatggacgacgaggagggcgagggcgaggaggacgacgacgacgacgaggaggaggagggcctggaggacatcgacgaggagggcgacgaggacgagggcgaggaggacgaggacgacgacgagggcgaggagggcgaggaggacgagggcgaggacgactag

SEQ ID NO: 12847 - DNA, 873 bp, Artificial Sequence
  Description of Artificial Sequence: Synthetic coding sequence
atggcccccaagagacagagccccctgcccccccagaagaagaagcccagacccccccccgccctgggccccgaggagaccagcgccagcgccggcctgcccaagaagggcgagaaggagcagcaggaggccatcgagcacatcgacgaggtgcagaacgagatcgacagactgaacgagcaggccagcgaggagatcctgaaggtggagcagaagtacaacaagctgagacagcccttcttccagaagagaagcgagctgatcgccaagatccccaacttctgggtgaccaccttcgtgaaccacccccaggtgagcgccctgctgggcgaggaggacgaggaggccctgcactacctgaccagagtggaggtgaccgagttcgaggacatcaagagcggctacagaatcgacttctacttcgacgagaacccctacttcgagaacaaggtgctgagcaaggagttccacctgaacgagagcggcgaccccagcagcaagagcaccgagatcaagtggaagagcggcaaggacctgaccaagagaagcagccagacccagaacaaggccagcagaaagagacagcacgaggagcccgagagcttcttcacctggttcaccgaccacagcgacgccggcgccgacgagctgggcgaggtgatcaaggacgacatctggcccaaccccctgcagtactacctggtgcccgacatggacgacgaggagggcgagggcgaggaggacgacgacgacgacgaggaggaggagggcctggaggacatcgacgaggagggcgacgaggacgagggcgaggaggacgaggacgacgacgagggcgaggagggcgaggaggacgagggcgaggacgactag

SEQ ID NO: 12848 - DNA, 807 bp, Artificial Sequence
  Description of Artificial Sequence: Synthetic coding sequence
atgggctgcagagacctgctgcccagcctgaagcccaccctgctggagaaggagcagcaggaggccatcgagcacatcgacgaggtgcagaacgagatcgacagactgaacgagcaggccagcgaggagatcctgaaggtggagcagaagtacaacaagctgagacagcccttcttccagaagagaagcgagctgatcgccaagatccccaacttctgggtgaccaccttcgtgaaccacccccaggtgagcgccctgctgggcgaggaggacgaggaggccctgcactacctgaccagagtggaggtgaccgagttcgaggacatcaagagcggctacagaatcgacttctacttcgacgagaacccctacttcgagaacaaggtgctgagcaaggagttccacctgaacgagagcggcgaccccagcagcaagagcaccgagatcaagtggaagagcggcaaggacctgaccaagagaagcagccagacccagaacaaggccagcagaaagagacagcacgaggagcccgagagcttcttcacctggttcaccgaccacagcgacgccggcgccgacgagctgggcgaggtgatcaaggacgacatctggcccaaccccctgcagtactacctggtgcccgacatggacgacgaggagggcgagggcgaggaggacgacgacgacgacgaggaggaggagggcctggaggacatcgacgaggagggcgacgaggacgagggcgaggaggacgaggacgacgacgagggcgaggagggcgaggaggacgagggcgaggacgactag

SEQ ID NO: 12849 - DNA, 99 bp, Artificial Sequence
  Description of Artificial Sequence: Synthetic coding sequence
atggcccccaagagacagagccccctgcccccccagaagaagaagcccagacccccccccgccctgggccccgaggagaccagcgccagcgccggctag

SEQ ID NO: 12850 - DNA, 942 bp, Artificial Sequence
  Description of Artificial Sequence: Synthetic coding sequence
atgaccggcaaggccaccccccccagcctgtacagctggagaggcgtgctgttcacctgcctgcccgccgccagaaccagaaagagaaaggagatgagcagacagaccgccaccgccctgcccaccggcaccagcaagtgcccccccagccagagagtgcccgccctgaccggcaccaccgccagcaacaacgacctggccagcctgttcgagtgccccgtgtgcttcgactacgtgctgccccccatcctgcagtgccagagcggccacctggtgtgcagcaactgcagacccaagctgacctgctgccccacctgcagaggccccctgggcagcatcagaaacctggccatggagaaggtggccaacagcgtgctgttcccctgcaagtacgccagcagcggctgcgagatcaccctgccccacaccgagaaggccgaccacgaggagctgtgcgagttcagaccctacagctgcccctgccccggcgccagctgcaagtggcagggcagcctggacgccgtgatgccccacctgatgcaccagcacaagagcatcaccaccctgcagggcgaggacatcgtgttcctggccaccgacatcaacctgcccggcgccgtggactgggtgatgatgcagagctgcttcggcttccacttcatgctggtgctggagaagcaggagaagtacgacggccaccagcagttcttcgccatcgtgcagctgatcggcaccagaaagcaggccgagaacttcgcctacagactggagctgaacggccacagaagaagactgacctgggaggccacccccagaagcatccacgagggcatcgccaccgccatcatgaacagcgactgcctggtgttcgacaccagcatcgcccagctgttcgccgagaacggcaacctgggcatcaacgtgaccatcagcatgtgctag

SEQ ID NO: 12851 - DNA, 897 bp, Artificial Sequence
  Description of Artificial Sequence: Synthetic coding sequence
atggtgatcatcatcttcctgctgcccccctacgtgttcatcagcgagatgagcagacagaccgccaccgccctgcccaccggcaccagcaagtgcccccccagccagagagtgcccgccctgaccggcaccaccgccagcaacaacgacctggccagcctgttcgagtgccccgtgtgcttcgactacgtgctgccccccatcctgcagtgccagagcggccacctggtgtgcagcaactgcagacccaagctgacctgctgccccacctgcagaggccccctgggcagcatcagaaacctggccatggagaaggtggccaacagcgtgctgttcccctgcaagtacgccagcagcggctgcgagatcaccctgccccacaccgagaaggccgaccacgaggagctgtgcgagttcagaccctacagctgcccctgccccggcgccagctgcaagtggcagggcagcctggacgccgtgatgccccacctgatgcaccagcacaagagcatcaccaccctgcagggcgaggacatcgtgttcctggccaccgacatcaacctgcccggcgccgtggactgggtgatgatgcagagctgcttcggcttccacttcatgctggtgctggagaagcaggagaagtacgacggccaccagcagttcttcgccatcgtgcagctgatcggcaccagaaagcaggccgagaacttcgcctacagactggagctgaacggccacagaagaagactgacctgggaggccacccccagaagcatccacgagggcatcgccaccgccatcatgaacagcgactgcctggtgttcgacaccagcatcgcccagctgttcgccgagaacggcaacctgggcatcaacgtgaccatcagcatgtgctag

SEQ ID NO: 12852 - DNA, 849 bp, Artificial Sequence
  Description of Artificial Sequence: Synthetic coding sequence
atgagcagacagaccgccaccgccctgcccaccggcaccagcaagtgcccccccagccagagagtgcccgccctgaccggcaccaccgccagcaacaacgacctggccagcctgttcgagtgccccgtgtgcttcgactacgtgctgccccccatcctgcagtgccagagcggccacctggtgtgcagcaactgcagacccaagctgacctgctgccccacctgcagaggccccctgggcagcatcagaaacctggccatggagaaggtggccaacagcgtgctgttcccctgcaagtacgccagcagcggctgcgagatcaccctgccccacaccgagaaggccgaccacgaggagctgtgcgagttcagaccctacagctgcccctgccccggcgccagctgcaagtggcagggcagcctggacgccgtgatgccccacctgatgcaccagcacaagagcatcaccaccctgcagggcgaggacatcgtgttcctggccaccgacatcaacctgcccggcgccgtggactgggtgatgatgcagagctgcttcggcttccacttcatgctggtgctggagaagcaggagaagtacgacggccaccagcagttcttcgccatcgtgcagctgatcggcaccagaaagcaggccgagaacttcgcctacagactggagctgaacggccacagaagaagactgacctgggaggccacccccagaagcatccacgagggcatcgccaccgccatcatgaacagcgactgcctggtgttcgacaccagcatcgcccagctgttcgccgagaacggcaacctgggcatcaacgtgaccatcagcatgtgctag

SEQ ID NO: 12853 - DNA, 708 bp, Artificial Sequence
  Description of Artificial Sequence: Synthetic coding sequence
atgaccttcgacctgaccaagatcaccaagaccagcagcagcttcgaggtgagaacctgggaccccgagggcgtgatcttctacggcgacaccaaccccaaggacgactggttcatgctgggcctgagagacggcagacccgagatccagctgcacaaccactgggcccagctgaccgtgggcgccggccccagactggacgacggcagatggcaccaggtggaggtgaagatggagggcgacagcgtgctgctggaggtggacggcgaggaggtgctgagactgagacaggtgagcggccccctgaccagcaagagacaccccatcatgagaatcgccctgggcggcctgctgttccccgccagcaacctgagactgcccctggtgcccgccctggacggctgcctgagaagagacagctggctggacaagcaggccgagatcagcgccagcgcccccaccagcctgagaagctgcgacgtggagagcaaccccggcatcttcctgccccccggcacccaggccgagttcaacctgagagacatcccccagccccacgccgagccctgggccttcagcctggacctgggcctgaagcaggccgccggcagcggccacctgctggccctgggcacccccgagaaccccagctggctgagcctgcacctgcaggaccaggagaagaccctgccccccctgttcgcctag

SEQ ID NO: 12854 - DNA, 1209 bp, Artificial Sequence
  Description of Artificial Sequence: Synthetic coding sequence
atggagagcagaggccccctggccaccagcagactgctgctgctgctgctgctgctgctgctgagacacaccagacagggctgggccctgagacccgtgctgcccacccagagcgcccacgacccccccgccgtgcacctgagcaacggccccggccaggagcccatcgccgtgatgaccttcgacctgaccaagatcaccaagaccagcagcagcttcgaggtgagaacctgggaccccgagggcgtgatcttctacggcgacaccaaccccaaggacgactggttcatgctgggcctgagagacggcagacccgagatccagctgcacaaccactgggcccagctgaccgtgggcgccggccccagactggacgacggcagatggcaccaggtggaggtgaagatggagggcgacagcgtgctgctggaggtggacggcgaggaggtgctgagactgagacaggtgagcggccccctgaccagcaagagacaccccatcatgagaatcgccctgggcggcctgctgttccccgccagcaacctgagactgcccctggtgcccgccctggacggctgcctgagaagagacagctggctggacaagcaggccgagatcagcgccagcgcccccaccagcctgagaagctgcgacgtggagagcaaccccggcatcttcctgccccccggcacccaggccgagttcaacctgagagacatcccccagccccacgccgagccctgggccttcagcctggacctgggcctgaagcaggccgccggcagcggccacctgctggccctgggcacccccgagaaccccagctggctgagcctgcacctgcaggaccagaaggtggtgctgagcagcggcagcggccccggcctggacctgcccctggtgctgggcctgcccctgcagctgaagctgagcatgagcagagtggtgctgagccagggcagcaagatgaaggccctggccctgccccccctgggcctggcccccctgctgaacctgtgggccaagccccagggcagactgttcctgggcgccctgcccggcgaggacagcagcaccagcttctgcctgaacggcctgtgggcccagggccagagactggacgtggaccaggccctgaacagaagccacgagatctggacccacagctgcccccagagccccggcaacggcaccgacgccagccactag

SEQ ID NO: 12855 - DNA, 882 bp, Artificial Sequence
  Description of Artificial Sequence: Synthetic coding sequence
atggagagcagaggccccctggccaccagcagactgctgctgctgctgctgctgctgctgctgagacacaccagacagggctgggccctgagacccgtgctgcccacccagagcgcccacgacccccccgccgtgcacctgagcaacggccccggccaggagcccatcgccgtgatgaccttcgacctgaccaagatcaccaagaccagcagcagcttcgaggtgagaacctgggaccccgagggcgtgatcttctacggcgacaccaaccccaaggacgactggttcatgctgggcctgagagacggcagacccgagatccagctgcacaaccactgggcccagctgaccgtgggcgccggccccagactggacgacggcagatggcaccaggtggaggtgaagatggagggcgacagcgtgctgctggaggtggacggcgaggaggtgctgagactgagacaggtgagcggccccctgaccagcaagagacaccccatcatgagaatcgccctgggcggcctgctgttccccgccagcaacctgagactgcccctggtgcccgccctggacggctgcctgagaagagacagctggctggacaagcaggccgagatcagcgccagcgcccccaccagcctgagaagctgcgacgtggagagcaaccccggcatcttcctgccccccggcacccaggccgagttcaacctgagagacatcccccagccccacgccgagccctgggccttcagcctggacctgggcctgaagcaggccgccggcagcggccacctgctggccctgggcacccccgagaaccccagctggctgagcctgcacctgcaggaccaggagaagaccctgccccccctgttcgcctag

SEQ ID NO: 12856 - DNA, 720 bp, Artificial Sequence
  Description of Artificial Sequence: Synthetic coding sequence
atggagagcagaggccccctggccaccagcagactgctgctgctgctgctgctgctgctgctgagacacaccagacagggctgggccctgagacccgtgctgcccacccagagcgcccacgacccccccgccgtgcacctgagcaacggccccggccaggagcccatcgccgtgatgaccttcgacctgaccaagatcaccaagaccagcagcagcttcgaggtgagaacctgggaccccgagggcgtgatcttctacggcgacaccaaccccaaggacgactggttcatgctgggcctgagagacggcagacccgagatccagctgcacaaccactgggcccagctgaccgtgggcgccggccccagactggacgacggcagatggcaccagctggtgcccgccctggacggctgcctgagaagagacagctggctggacaagcaggccgagatcagcgccagcgcccccaccagcctgagaagctgcgacgtggagagcaaccccggcatcttcctgccccccggcacccaggccgagttcaacctgagagacatcccccagccccacgccgagccctgggccttcagcctggacctgggcctgaagcaggccgccggcagcggccacctgctggccctgggcacccccgagaaccccagctggctgagcctgcacctgcaggaccaggagaagaccctgccccccctgttcgcctag

SEQ ID NO: 12857 - DNA, 864 bp, Artificial Sequence
  Description of Artificial Sequence: Synthetic coding sequence
atggagagcagaggccccctggccaccagcagactgctgctgctgctgctgctgctgctgctgagacacaccagacagggctgggccctgagacccgtgctgcccacccagagcgcccacgacccccccgccgtgcacctgagcaacggccccggccaggagcccatcgccgtgatgaccttcgacctgaccaagatcaccaagaccagcagcagcttcgaggtgagaacctgggaccccgagggcgtgatcttctacggcgacaccaaccccaaggacgactggttcatgctgggcctgagagacggcagacccgagatccagctgcacaaccactgggcccagctgaccgtgggcgccggccccagactggacgacggcagatggcaccaggtggaggtgaagatggagggcgacagcgtgctgctggaggtggacggcgaggaggtgctgagactgagacaggtgagcggccccctgaccagcaagagacaccccatcatgagaatcgccctgggcggcctgctgttccccgccagcaacctgagactgcccctggtgcccgccctggacggctgcctgagaagagacagctggctggacaagcaggccgagatcagcgccagcgcccccaccagcctgagaagctgcgacgtggagagcaaccccggcatcttcctgccccccggcacccaggccgagttcaacctgagaggcgaggacagcagcaccagcttctgcctgaacggcctgtgggcccagggccagagactggacgtggaccaggccctgaacagaagccacgagatctggacccacagctgcccccagagccccggcaacggcaccgacgccagccactag

SEQ ID NO: 12858 - DNA, 423 bp, Artificial Sequence
  Description of Artificial Sequence: Synthetic coding sequence
atggagagcagaggccccctggccaccagcagactgctgctgctgctgctgctgctgctgctgagacacaccagacagggctgggccctgagacccgtgctgcccacccagagcgcccacgacccccccgccgtgcacctgagcaacggccccggccaggagcccatcgccgtgatgaccttcgacctgaccaagatcaccaagaccagcagcagcttcgaggtgagaacctgggaccccgagggcgtgatcttctacggcgacaccaaccccaaggacgactggttcatgctgggcctgagagacggcagacccgagatccagctgcacaaccactgggcccagctgaccgtgggcgccggccccagactggacgacggcagatggcaccaggagaagaccctgccccccctgttcgcctag

SEQ ID NO: 12859 - DNA, 1155 bp, Artificial Sequence
  Description of Artificial Sequence: Synthetic coding sequence
atggagagcagaggccccctggccaccagcagactgctgctgctgctgctgctgctgctgctgagacacaccagacagggctgggccctgagacccgtgctgcccacccagagcgcccacgacccccccgccgtgcacctgagcaacggccccggccaggagcccatcgccgtgatgaccttcgacctgaccaagatcaccaagaccagcagcagcttcgaggtgagaacctgggaccccgagggcgtgatcttctacggcgacaccaaccccaaggacgactggttcatgctgggcctgagagacggcagacccgagatccagctgcacaaccactgggcccagctgaccgtgggcgccggccccagactggacgacggcagatggcaccaggtggaggtgaagatggagggcgacagcgtgctgctggaggtggacggcgaggaggtgctgagactgagacaggtgagcggccccctgaccagcaagagacaccccatcatgagaatcgccctgggcggcctgctgttccccgccagcaacctgagactgcccgccgagatcagcgccagcgcccccaccagcctgagaagctgcgacgtggagagcaaccccggcatcttcctgccccccggcacccaggccgagttcaacctgagagacatcccccagccccacgccgagccctgggccttcagcctggacctgggcctgaagcaggccgccggcagcggccacctgctggccctgggcacccccgagaaccccagctggctgagcctgcacctgcaggaccagaaggtggtgctgagcagcggcagcggccccggcctggacctgcccctggtgctgggcctgcccctgcagctgaagctgagcatgagcagagtggtgctgagccagggcagcaagatgaaggccctggccctgccccccctgggcctggcccccctgctgaacctgtgggccaagccccagggcagactgttcctgggcgccctgcccggcgaggacagcagcaccagcttctgcctgaacggcctgtgggcccagggccagagactggacgtggaccaggccctgaacagaagccacgagatctggacccacagctgcccccagagccccggcaacggcaccgacgccagccactag

SEQ ID NO: 12860 - DNA, 1116 bp, Artificial Sequence
  Description of Artificial Sequence: Synthetic coding sequence
atgagccccagcaccttccagatcaccgacatgaccagaagaagctgccagaacctgggctacaccgccgccagcccccaggcccccgaggccgccagcaacaccggcaacgccgagagagccgaggaggtgcccggcgagggcagcctgttcctgcaggccgagaccagagcctggttccagaagacccaggcccactggctgctgcagcacggcgccgcccccgcctggttccacggcttcatcaccagaagagaggccgagagactgctggagcccaagccccagggctgctacctggtgagattcagcgagagcgccgtgaccttcgtgctgacctacagaagcagaacctgctgcagacacttcctgctggcccagctgagagacggcagacacgtggtgctgggcgaggacagcgcccacgccagactgcaggacctgctgctgcactacaccgcccaccccctgagcccctacggcgagaccctgaccgagcccctggccagacagacccccgagcccgccggcctgagcctgagaaccgaggagagcaacttcggcagcaagagccaggaccccaacccccagtacagccccatcatcaagcagggccaggcccccgtgcccatgcagaaggagggcgccggcgagaaggagcccagccagctgctgagacccaagccccccatccccgccaagccccagctgccccccgaggtgtacaccatccccgtgcccagacacagacccgcccccagacccaagcccagcaaccccatctacaacgagcccgacgagcccatcgccttctacgccatgggcagaggcagccccggcgaggcccccagcaacatctacgtggaggtggaggacgagggcctgcccgccaccctgggccaccccgtgctgagaaagagctggagcagacccgtgcccggcggccagaacaccggcggcagccagctgcacagcgagaacagcgtgatcggccagggcccccccctgccccaccagcccccccccgcctggagacacaccctgccccacaacctgagcagacaggtgctgcaggacagaggccaggcctggctgcccctgggccccccccagtag

SEQ ID NO: 12861 - DNA, 1170 bp, Artificial Sequence
  Description of Artificial Sequence: Synthetic coding sequence
atggagttccccctggcccagatctgcccccagggcagccacgaggcccccatccccaccttcagcaccttccagatcaccgacatgaccagaagaagctgccagaacctgggctacaccgccgccagcccccaggcccccgaggccgccagcaacaccggcaacgccgagagagccgaggaggtgcccggcgagggcagcctgttcctgcaggccgagaccagagcctggttccagaagacccaggcccactggctgctgcagcacggcgccgcccccgcctggttccacggcttcatcaccagaagagaggccgagagactgctggagcccaagccccagggctgctacctggtgagattcagcgagagcgccgtgaccttcgtgctgacctacagaagcagaacctgctgcagacacttcctgctggcccagctgagagacggcagacacgtggtgctgggcgaggacagcgcccacgccagactgcaggacctgctgctgcactacaccgcccaccccctgagcccctacggcgagaccctgaccgagcccctggccagacagacccccgagcccgccggcctgagcctgagaaccgaggagagcaacttcggcagcaagagccaggaccccaacccccagtacagccccatcatcaagcagggccaggcccccgtgcccatgcagaaggagggcgccggcgagaaggagcccagccagctgctgagacccaagccccccatccccgccaagccccagctgccccccgaggtgtacaccatccccgtgcccagacacagacccgcccccagacccaagcccagcaaccccatctacaacgagcccgacgagcccatcgccttctacgccatgggcagaggcagccccggcgaggcccccagcaacatctacgtggaggtggaggacgagggcctgcccgccaccctgggccaccccgtgctgagaaagagctggagcagacccgtgcccggcggccagaacaccggcggcagccagctgcacagcgagaacagcgtgatcggccagggcccccccctgccccaccagcccccccccgcctggagacacaccctgccccacaacctgagcagacaggtgctgcaggacagaggccaggcctggctgcccctgggccccccccagtag

SEQ ID NO: 12862 - DNA, 1200 bp, Artificial Sequence
  Description of Artificial Sequence: Synthetic coding sequence
atggagttccccctggcccagatctgcccccagggcagccacgaggcccccatccccaccttcagcaccttccagatcaccgacatgaccagaagaagctgccagaacctgggctacaccgccgccagcccccaggcccccgaggccgccagcaacaccggcaacgccgagagagccgaggaggtgcccggcgagggcagcctgttcctgcaggccgagaccagagcctggttccagaagacccaggcccactggctgctgcagcacggcgccgcccccgcctggttccacggcttcatcaccagaagagtgagaccccccctgagcgtgacccacagagaggccgagagactgctggagcccaagccccagggctgctacctggtgagattcagcgagagcgccgtgaccttcgtgctgacctacagaagcagaacctgctgcagacacttcctgctggcccagctgagagacggcagacacgtggtgctgggcgaggacagcgcccacgccagactgcaggacctgctgctgcactacaccgcccaccccctgagcccctacggcgagaccctgaccgagcccctggccagacagacccccgagcccgccggcctgagcctgagaaccgaggagagcaacttcggcagcaagagccaggaccccaacccccagtacagccccatcatcaagcagggccaggcccccgtgcccatgcagaaggagggcgccggcgagaaggagcccagccagctgctgagacccaagccccccatccccgccaagccccagctgccccccgaggtgtacaccatccccgtgcccagacacagacccgcccccagacccaagcccagcaaccccatctacaacgagcccgacgagcccatcgccttctacgccatgggcagaggcagccccggcgaggcccccagcaacatctacgtggaggtggaggacgagggcctgcccgccaccctgggccaccccgtgctgagaaagagctggagcagacccgtgcccggcggccagaacaccggcggcagccagctgcacagcgagaacagcgtgatcggccagggcccccccctgccccaccagcccccccccgcctggagacacaccctgccccacaacctgagcagacaggtgctgcaggacagaggccaggcctggctgcccctgggccccccccagtag

SEQ ID NO: 12863 - DNA, 2823 bp, Artificial Sequence
  Description of Artificial Sequence: Synthetic coding sequence
atgatcctggagcagtacgtggtggtgagcaactacaagaagcaggagaacagcgagctgagcctgcaggccggcgaggtggtggacgtgatcgagaagaacgagagcggctggtggttcgtgagcaccagcgaggagcagggctgggtgcccgccacctacctggaggcccagaacggcaccagagacgacagcgacatcaacaccagcaagaccggcgaggaggagaagtacgtgaccgtgcagccctacaccagccagagcaaggacgagatcggcttcgagaagggcgtgaccgtggaggtgatcagaaagaacctggagggctggtggtacatcagatacctgggcaaggagggctgggcccccgccagctacctgaagaaggccaaggacgacctgcccaccagaaagaagaacctggccggccccgtggagatcatcggcaacatcatggagatcagcaacctgctgaacaagaaggccagcggcgacaaggagaccccccccgccgagggcgagggccacgaggcccccatcgccaagaaggagatcagcctgcccatcctgtgcaacgccagcaacggcagcgccgtgggcgtgcccgacagaaccgtgagcagactggcccagggcagccccgccgtggccagaatcgccccccagagagcccagatcagcagccccaacctgagaaccagacccccccccagaagagagagcagcctgggcttccagctgcccaagccccccgagccccccagcgtggaggtggagtactacaccatcgccgagttccagagctgcatcagcgacggcatcagcttcagaggcggccagaaggccgaggtgatcgacaagaacagcggcggctggtggtacgtgcagatcggcgagaaggagggctgggcccccgccagctacatcgacaagagaaagaagcccaacctgagcagaagaaccagcaccctgaccagacccaaggtgcccccccccgccccccccagcaagcccaaggaggccgaggagggccccaccggcgccagcgagagccaggacagccccagaaagctgaagtacgaggagcccgagtacgacatccccgccttcggcttcgacagcgagcccgagctgagcgaggagcccgtggaggacagagccagcggcgagagaagacccgcccagccccacagacccagccccgccagcagcctgcagagagccagattcaaggtgggcgagagcagcgaggacgtggccctggaggaggagaccatctacgagaacgagggcttcagaccctacgccgaggacaccctgagcgccagaggcagcagcggcgacagcgacagccccggcagcagcagcctgagcctgaccagaaagaacagccccaagagcggcagccccaagagcagcagcctgctgaagctgaaggccgagaagaacgcccaggccgagatgggcaagaaccacagcagcgccagcttcagcagcagcatcaccatcaacaccacctgctgcagcagcagcagcagcagcagcagcagcctgagcaagaccagcggcgacctgaagcccagaagcgccagcgacgccggcatcagaggcacccccaaggtgagagccaagaaggacgccgacgccaacgccggcctgaccagctgccccagagccaagcccagcgtgagacccaagcccttcctgaacagagccgagagccagagccaggagaagatggacatcagcaccctgagaagacagctgagacccaccggccagctgagaggcggcctgaagggcagcaagagcgaggacagcgagctgcccccccagaccgccagcgaggcccccagcgagggcagcagaagaagcagcagcgacctgatcaccctgcccgccaccacccccccctgccccaccaagaaggagtgggagggccccgccaccagctacatgacctgcagcgcctaccagaaggtgcaggacagcgagatcagcttccccgccggcgtggaggtgcaggtgctggagaagcaggagagcggctggtggtacgtgagattcggcgagctggagggctgggcccccagccactacctggtgctggacgagaacgagcagcccgaccccagcggcaaggagctggacaccgtgcccgccaagggcagacagaacgagggcaagagcgacagcctggagaagatcgagagaagagtgcaggccctgaacaccgtgaaccagagcaagaaggccaccccccccatccccagcaagccccccggcggcttcggcaagaccagcggcacccccgccgtgaagatgagaaacggcgtgagacaggtggccgtgagaccccagagcgtgttcgtgagccccccccccaaggacaacaacctgagctgcgccctgagaagaaacgagagcctgaccgccaccgacggcctgagaggcgtgagaagaaacagcagcttcagcaccgccagaagcgccgccgccgaggccaagggcagactggccgagagagccgccagccagggcagcgacagccccctgctgcccgcccagagaaacagcatccccgtgagccccgtgagacccaagcccatcgagaagagccagttcatccacaacaacctgaaggacgtgtacgtgagcatcgccgactacgagggcgacgaggagaccgccggcttccaggagggcgtgagcatggaggtgctggagagaaaccccaacggctggtggtactgccagatcctggacggcgtgaagcccttcaagggctgggtgcccagcaactacctggagaagaagaactag

SEQ ID NO: 12864 - DNA, 3318 bp, Artificial Sequence
  Description of Artificial Sequence: Synthetic coding sequence
atgctggcctactgcgtgcaggacgccaccgtggtggacgtggagaagagaagaaaccccagcaagcactacgtgtacatcatcaacgtgacctggagcgacagcaccagccagaccatctacagaagatacagcaagttcttcgacctgcagatgcagctgctggacaagttccccatcgagggcggccagaaggaccccaagcagagaatcatccccttcctgcccggcaagatcctgttcagaagaagccacatcagagacgtggccgtgaagagactgaagcccatcgacgagtactgcagagccctggtgagactgcccccccacatcagccagtgcgacgaggtgttcagattcttcgaggccagacccgaggacgtgaacccccccaaggaggactacggcagcagcaagagaaagagcgtgtggctgagcagctgggccgagagccccaagaaggacgtgaccggcgccgacgccaccgccgagcccatgatcctggagcagtacgtggtggtgagcaactacaagaagcaggagaacagcgagctgagcctgcaggccggcgaggtggtggacgtgatcgagaagaacgagagcggctggtggttcgtgagcaccagcgaggagcagggctgggtgcccgccacctacctggaggcccagaacggcaccagagacgacagcgacatcaacaccagcaagaccggcgaggaggagaagtacgtgaccgtgcagccctacaccagccagagcaaggacgagatcggcttcgagaagggcgtgaccgtggaggtgatcagaaagaacctggagggctggtggtacatcagatacctgggcaaggagggctgggcccccgccagctacctgaagaaggccaaggacgacctgcccaccagaaagaagaacctggccggccccgtggagatcatcggcaacatcatggagatcagcaacctgctgaacaagaaggccagcggcgacaaggagaccccccccgccgagggcgagggccacgaggcccccatcgccaagaaggagatcagcctgcccatcctgtgcaacgccagcaacggcagcgccgtgggcgtgcccgacagaaccgtgagcagactggcccagggcagccccgccgtggccagaatcgccccccagagagcccagatcagcagccccaacctgagaaccagacccccccccagaagagagagcagcctgggcttccagctgcccaagccccccgagccccccagcgtggaggtggagtactacaccatcgccgagttccagagctgcatcagcgacggcatcagcttcagaggcggccagaaggccgaggtgatcgacaagaacagcggcggctggtggtacgtgcagatcggcgagaaggagggctgggcccccgccagctacatcgacaagagaaagaagcccaacctgagcagaagaaccagcaccctgaccagacccaaggtgcccccccccgccccccccagcaagcccaaggaggccgaggagggccccaccggcgccagcgagagccaggacagccccagaaagctgaagtacgaggagcccgagtacgacatccccgccttcggcttcgacagcgagcccgagctgagcgaggagcccgtggaggacagagccagcggcgagagaagacccgcccagccccacagacccagccccgccagcagcctgcagagagccagattcaaggtgggcgagagcagcgaggacgtggccctggaggaggagaccatctacgagaacgagggcttcagaccctacgccgaggacaccctgagcgccagaggcagcagcggcgacagcgacagccccggcagcagcagcctgagcctgaccagaaagaacagccccaagagcggcagccccaagagcagcagcctgctgaagctgaaggccgagaagaacgcccaggccgagatgggcaagaaccacagcagcgccagcttcagcagcagcatcaccatcaacaccacctgctgcagcagcagcagcagcagcagcagcagcctgagcaagaccagcggcgacctgaagcccagaagcgccagcgacgccggcatcagaggcacccccaaggtgagagccaagaaggacgccgacgccaacgccggcctgaccagctgccccagagccaagcccagcgtgagacccaagcccttcctgaacagagccgagagccagagccaggagaagatggacatcagcaccctgagaagacagctgagacccaccggccagctgagaggcggcctgaagggcagcaagagcgaggacagcgagctgcccccccagaccgccagcgaggcccccagcgagggcagcagaagaagcagcagcgacctgatcaccctgcccgccaccacccccccctgccccaccaagaaggagtgggagggccccgccaccagctacatgacctgcagcgcctaccagaaggtgcaggacagcgagatcagcttccccgccggcgtggaggtgcaggtgctggagaagcaggagagcggctggtggtacgtgagattcggcgagctggagggctgggcccccagccactacctggtgctggacgagaacgagcagcccgaccccagcggcaaggagctggacaccgtgcccgccaagggcagacagaacgagggcaagagcgacagcctggagaagatcgagagaagagtgcaggccctgaacaccgtgaaccagagcaagaaggccaccccccccatccccagcaagccccccggcggcttcggcaagaccagcggcacccccgccgtgaagatgagaaacggcgtgagacaggtggccgtgagaccccagagcgtgttcgtgagccccccccccaaggacaacaacctgagctgcgccctgagaagaaacgagagcctgaccgccaccgacggcctgagaggcgtgagaagaaacagcagcttcagcaccgccagaagcgccgccgccgaggccaagggcagactggccgagagagccgccagccagggcagcgacagccccctgctgcccgcccagagaaacagcatccccgtgagccccgtgagacccaagcccatcgagaagagccagttcatccacaacaacctgaaggacgtgtacgtgagcatcgccgactacgagggcgacgaggagaccgccggcttccaggagggcgtgagcatggaggtgctggagagaaaccccaacggctggtggtactgccagatcctggacggcgtgaagcccttcaagggctgggtgcccagcaactacctggagaagaagaactag

SEQ ID NO: 12865 - DNA, 3402 bp, Artificial Sequence
  Description of Artificial Sequence: Synthetic coding sequence
atgctggcctactgcgtgcaggacgccaccgtggtggacgtggagaagagaagaaaccccagcaagcactacgtgtacatcatcaacgtgacctggagcgacagcaccagccagaccatctacagaagatacagcaagttcttcgacctgcagatgcagctgctggacaagttccccatcgagggcggccagaaggaccccaagcagagaatcatccccttcctgcccggcaagatcctgttcagaagaagccacatcagagacgtggccgtgaagagactgaagcccatcgacgagtactgcagagccctggtgagactgcccccccacatcagccagtgcgacgaggtgttcagattcttcgaggccagacccgaggacgtgaacccccccaaggaggactacggcagcagcaagagaaagagcgtgtggctgagcagctgggccgagagccccaagaaggacgtgaccggcgccgacgccaccgccgagcccatgatcctggagcagtacgtggtggtgagcaactacaagaagcaggagaacagcgagctgagcctgcaggccggcgaggtggtggacgtgatcgagaagaacgagagcggctggtggttcgtgagcaccagcgaggagcagggctgggtgcccgccacctacctggaggcccagaacggcaccagagacgacagcgacatcaacaccagcaagaccggcgaggtgagcaagagaagaaaggcccacctgagaagactggacagaagatggaccctgggcggcatggtgaacagacagcacagcagagaggagaagtacgtgaccgtgcagccctacaccagccagagcaaggacgagatcggcttcgagaagggcgtgaccgtggaggtgatcagaaagaacctggagggctggtggtacatcagatacctgggcaaggagggctgggcccccgccagctacctgaagaaggccaaggacgacctgcccaccagaaagaagaacctggccggccccgtggagatcatcggcaacatcatggagatcagcaacctgctgaacaagaaggccagcggcgacaaggagaccccccccgccgagggcgagggccacgaggcccccatcgccaagaaggagatcagcctgcccatcctgtgcaacgccagcaacggcagcgccgtgggcgtgcccgacagaaccgtgagcagactggcccagggcagccccgccgtggccagaatcgccccccagagagcccagatcagcagccccaacctgagaaccagacccccccccagaagagagagcagcctgggcttccagctgcccaagccccccgagccccccagcgtggaggtggagtactacaccatcgccgagttccagagctgcatcagcgacggcatcagcttcagaggcggccagaaggccgaggtgatcgacaagaacagcggcggctggtggtacgtgcagatcggcgagaaggagggctgggcccccgccagctacatcgacaagagaaagaagcccaacctgagcagaagaaccagcaccctgaccagacccaaggtgcccccccccgccccccccagcaagcccaaggaggccgaggagggccccaccggcgccagcgagagccaggacagccccagaaagctgaagtacgaggagcccgagtacgacatccccgccttcggcttcgacagcgagcccgagctgagcgaggagcccgtggaggacagagccagcggcgagagaagacccgcccagccccacagacccagccccgccagcagcctgcagagagccagattcaaggtgggcgagagcagcgaggacgtggccctggaggaggagaccatctacgagaacgagggcttcagaccctacgccgaggacaccctgagcgccagaggcagcagcggcgacagcgacagccccggcagcagcagcctgagcctgaccagaaagaacagccccaagagcggcagccccaagagcagcagcctgctgaagctgaaggccgagaagaacgcccaggccgagatgggcaagaaccacagcagcgccagcttcagcagcagcatcaccatcaacaccacctgctgcagcagcagcagcagcagcagcagcagcctgagcaagaccagcggcgacctgaagcccagaagcgccagcgacgccggcatcagaggcacccccaaggtgagagccaagaaggacgccgacgccaacgccggcctgaccagctgccccagagccaagcccagcgtgagacccaagcccttcctgaacagagccgagagccagagccaggagaagatggacatcagcaccctgagaagacagctgagacccaccggccagctgagaggcggcctgaagggcagcaagagcgaggacagcgagctgcccccccagaccgccagcgaggcccccagcgagggcagcagaagaagcagcagcgacctgatcaccctgcccgccaccacccccccctgccccaccaagaaggagtgggagggccccgccaccagctacatgacctgcagcgcctaccagaaggtgcaggacagcgagatcagcttccccgccggcgtggaggtgcaggtgctggagaagcaggagagcggctggtggtacgtgagattcggcgagctggagggctgggcccccagccactacctggtgctggacgagaacgagcagcccgaccccagcggcaaggagctggacaccgtgcccgccaagggcagacagaacgagggcaagagcgacagcctggagaagatcgagagaagagtgcaggccctgaacaccgtgaaccagagcaagaaggccaccccccccatccccagcaagccccccggcggcttcggcaagaccagcggcacccccgccgtgaagatgagaaacggcgtgagacaggtggccgtgagaccccagagcgtgttcgtgagccccccccccaaggacaacaacctgagctgcgccctgagaagaaacgagagcctgaccgccaccgacggcctgagaggcgtgagaagaaacagcagcttcagcaccgccagaagcgccgccgccgaggccaagggcagactggccgagagagccgccagccagggcagcgacagccccctgctgcccgcccagagaaacagcatccccgtgagccccgtgagacccaagcccatcgagaagagccagttcatccacaacaacctgaaggacgtgtacgtgagcatcgccgactacgagggcgacgaggagaccgccggcttccaggagggcgtgagcatggaggtgctggagagaaaccccaacggctggtggtactgccagatcctggacggcgtgaagcccttcaagggctgggtgcccagcaactacctggagaagaagaactag

SEQ ID NO: 12866 - DNA, 3183 bp, Artificial Sequence
  Description of Artificial Sequence: Synthetic coding sequence
tgattcttcgacctgcagatgcagctgctggacaagttccccatcgagggcggccagaaggaccccaagcagagaatcatccccttcctgcccggcaagatcctgttcagaagaagccacatcagagacgtggccgtgaagagactgaagcccatcgacgagtactgcagagccctggtgagactgcccccccacatcagccagtgcgacgaggtgttcagattcttcgaggccagacccgaggacgtgaacccccccaaggaggactacggcagcagcaagagaaagagcgtgtggctgagcagctgggccgagagccccaagaaggacgtgaccggcgccgacgccaccgccgagcccatgatcctggagcagtacgtggtggtgagcaactacaagaagcaggagaacagcgagctgagcctgcaggccggcgaggtggtggacgtgatcgagaagaacgagagcggctggtggttcgtgagcaccagcgaggagcagggctgggtgcccgccacctacctggaggcccagaacggcaccagagacgacagcgacatcaacaccagcaagaccggcgaggaggagaagtacgtgaccgtgcagccctacaccagccagagcaaggacgagatcggcttcgagaagggcgtgaccgtggaggtgatcagaaagaacctggagggctggtggtacatcagatacctgggcaaggagggctgggcccccgccagctacctgaagaaggccaaggacgacctgcccaccagaaagaagaacctggccggccccgtggagatcatcggcaacatcatggagatcagcaacctgctgaacaagaaggccagcggcgacaaggagaccccccccgccgagggcgagggccacgaggcccccatcgccaagaaggagatcagcctgcccatcctgtgcaacgccagcaacggcagcgccgtgggcgtgcccgacagaaccgtgagcagactggcccagggcagccccgccgtggccagaatcgccccccagagagcccagatcagcagccccaacctgagaaccagacccccccccagaagagagagcagcctgggcttccagctgcccaagccccccgagccccccagcgtggaggtggagtactacaccatcgccgagttccagagctgcatcagcgacggcatcagcttcagaggcggccagaaggccgaggtgatcgacaagaacagcggcggctggtggtacgtgcagatcggcgagaaggagggctgggcccccgccagctacatcgacaagagaaagaagcccaacctgagcagaagaaccagcaccctgaccagacccaaggtgcccccccccgccccccccagcaagcccaaggaggccgaggagggccccaccggcgccagcgagagccaggacagccccagaaagctgaagtacgaggagcccgagtacgacatccccgccttcggcttcgacagcgagcccgagctgagcgaggagcccgtggaggacagagccagcggcgagagaagacccgcccagccccacagacccagccccgccagcagcctgcagagagccagattcaaggtgggcgagagcagcgaggacgtggccctggaggaggagaccatctacgagaacgagggcttcagaccctacgccgaggacaccctgagcgccagaggcagcagcggcgacagcgacagccccggcagcagcagcctgagcctgaccagaaagaacagccccaagagcggcagccccaagagcagcagcctgctgaagctgaaggccgagaagaacgcccaggccgagatgggcaagaaccacagcagcgccagcttcagcagcagcatcaccatcaacaccacctgctgcagcagcagcagcagcagcagcagcagcctgagcaagaccagcggcgacctgaagcccagaagcgccagcgacgccggcatcagaggcacccccaaggtgagagccaagaaggacgccgacgccaacgccggcctgaccagctgccccagagccaagcccagcgtgagacccaagcccttcctgaacagagccgagagccagagccaggagaagatggacatcagcaccctgagaagacagctgagacccaccggccagctgagaggcggcctgaagggcagcaagagcgaggacagcgagctgcccccccagaccgccagcgaggcccccagcgagggcagcagaagaagcagcagcgacctgatcaccctgcccgccaccacccccccctgccccaccaagaaggagtgggagggccccgccaccagctacatgacctgcagcgcctaccagaaggtgcaggacagcgagatcagcttccccgccggcgtggaggtgcaggtgctggagaagcaggagagcggctggtggtacgtgagattcggcgagctggagggctgggcccccagccactacctggtgctggacgagaacgagcagcccgaccccagcggcaaggagctggacaccgtgcccgccaagggcagacagaacgagggcaagagcgacagcctggagaagatcgagagaagagtgcaggccctgaacaccgtgaaccagagcaagaaggccaccccccccatccccagcaagccccccggcggcttcggcaagaccagcggcacccccgccgtgaagatgagaaacggcgtgagacaggtggccgtgagaccccagagcgtgttcgtgagccccccccccaaggacaacaacctgagctgcgccctgagaagaaacgagagcctgaccgccaccgacggcctgagaggcgtgagaagaaacagcagcttcagcaccgccagaagcgccgccgccgaggccaagggcagactggccgagagagccgccagccagggcagcgacagccccctgctgcccgcccagagaaacagcatccccgtgagccccgtgagacccaagcccatcgagaagagccagttcatccacaacaacctgaaggacgtgtacgtgagcatcgccgactacgagggcgacgaggagaccgccggcttccaggagggcgtgagcatggaggtgctggagagaaaccccaacggctggtggtactgccagatcctggacggcgtgaagcccttcaagggctgggtgcccagcaactacctggagaagaagaactag

SEQ ID NO: 12867 - DNA, 1110 bp, Artificial Sequence
  Description of Artificial Sequence: Synthetic coding sequence
atgagcatctgctgctgcttcttcttcagagactacggcagcagcaagagaaagagcggcgccgacgccaccgccgagcccatgatcctggagcagtacgtggtggtgagcaactacaagaagcaggagaacagcgagctgagcctgcaggccggcgaggtggtggacgtgatcgagaagaacgagagcggctggtggttcgtgagcaccagcgaggagcagggctgggtgcccgccacctacctggaggcccagaacggcaccagagacgacagcgacatcaacaccagcaagaccggcgaggtgagcaagagaagaaaggcccacctgagaagactggacagaagatggaccctgggcggcatggtgaacagacagcacagcagagaggagaagtacgtgaccgtgcagccctacaccagccagagcaaggacgagatcggcttcgagaagggcgtgaccgtggaggtgatcagaaagaacctggagggctggtggtacatcagatacctgggcaaggagggctgggcccccgccagctacctgaagaaggccaaggacgacctgcccaccagaaagaagaacctggccggccccgtggagatcatcggcaacatcatggagatcagcaacctgctgaacaagaaggccagcggcgacaaggagaccccccccgccgagggcgagggccacgaggcccccatcgccaagaaggagatcagcctgcccatcctgtgcaacgccagcaacggcagcgccgtgggcgtgcccgacagaaccgtgagcagactggcccagggcagccccgccgtggccagaatcgccccccagagagcccagatcagcagccccaacctgagaaccagacccccccccagaagagagagcagcctgaccgagagcagatgcagacaggccggcgtgcagtggcacgacctgggcagcctgcagagcccccaccccagattcaagagattcagctgcctgagcctgctgagcagctgggaccacagacacatgcccccccaccccgccaacttcctgatcttcctgatcgagaccggcttccaccacgtgggccaggacggcctgcacctgctgaccagctag

SEQ ID NO: 12868 - DNA, 2898 bp, Artificial Sequence
  Description of Artificial Sequence: Synthetic coding sequence
atgcccgtgaccgccaccggcaagatcctgttcagaagaagccacatcagagacgtggccgtgaagagactgaagcccatcgacgagtactgcagagccctggtgagactgcccccccacatcagccagtgcgacgaggtgttcagattcttcgaggccagacccgaggacgtgaacccccccaaggaggactacggcagcagcaagagaaagagcggcgccgacgccaccgccgagcccatgatcctggagcagtacgtggtggtgagcaactacaagaagcaggagaacagcgagctgagcctgcaggccggcgaggtggtggacgtgatcgagaagaacgagagcggctggtggttcgtgagcaccagcgaggagcagggctgggtgcccgccacctacctggaggcccagaacggcaccagagacgacagcgacatcaacaccagcaagaccggcgaggtgagcaagagaagaaaggcccacctgagaagactggacagaagatggaccctgggcggcatggtgaacagacagcacagcagagaggagaagtacgtgaccgtgcagccctacaccagccagagcaaggacgagatcggcttcgagaagggcgtgaccgtggaggtgatcagaaagaacctggagggctggtggtacatcagatacctgggcaaggagggctgggcccccgccagctacctgaagaaggccaaggacgacctgcccaccagaaagaagaacctggccggccccgtggagatcatcggcaacatcatggagatcagcaacctgctgaacaagaaggccagcggcgacaaggagaccccccccgccgagggcgagggccacgaggcccccatcgccaagaaggagatcagcctgcccatcctgtgcaacgccagcaacggcagcgccgtgggcgtgcccgacagaaccgtgagcagactggcccagggcagccccgccgtggccagaatcgccccccagagagcccagatcagcagccccaacctgagaaccagacccccccccagaagagagagcagcctgggcttccagctgcccaagccccccgagccccccagcgtggaggtggagtactacaccatcgccgagttccagagctgcatcagcgacggcatcagcttcagaggcggccagaaggccgaggtgatcgacaagaacagcggcggctggtggtacgtgcagatcggcgagaaggagggctgggcccccgccagctacatcgacaagagaaagaagcccaacctgagcagaagaaccagcaccctgaccagacccaaggtgcccccccccgccccccccagcaagcccaaggaggccgaggagggccccaccggcgccagcgagagccaggacagccccagaaagctgaagtacgaggagcccgagtacgacatccccgccttcggcttcgacagcgagcccgagctgagcgaggagcccgtggaggacagagccagcggcgagagaagacccgcccagccccacagacccagccccgccagcagcctgcagagagccagattcaaggtgggcgagagcagcgaggacgtggccctggaggaggagaccatctacgagaacgagggcttcagaccctacgccgaggacaccctgagcgccagaggcagcagcggcgacagcgacagccccggcagcagcagcctgagcctgaccagaaagaacagccccaagagcggcagccccaagagcagcagcctgctgaagctgaaggccgagaagaacgcccaggccgagatgggcaagaaccacagcagcgccagcttcagcagcagcatcaccatcaacaccacctgctgcagcagcagcagcagcagcagcagcagcctgagcaagaccagcggcgacctgaagcccagaagcgccagcgacgccggcatcagaggcacccccaaggtgagagccaagaaggacgccgacgccaacgccggcctgaccagctgccccagagccaagcccagcgtgagacccaagcccttcctgaacagagccgagagccagagccaggagaagatggacatcagcaccctgagaagacagctgagacccaccggccagctgagaggcggcctgaagggcagcaagagcgaggacagcgagctgcccccccagaccgccagcgaggcccccagcgagggcagcagaagaagcagcagcgacctgatcaccctgcccgccaccacccccccctgccccaccaagaaggagtgggagggccccgccaccagctacatgacctgcagcgcctaccagaaggtgcaggacagcgagatcagcttccccgccggcgtggaggtgcaggtgctggagaagcaggagagcggctggtggtacgtgagattcggcgagctggagggctgggcccccagccactacctggtgctggacgagaacgagcagcccgaccccagcggcaaggagctggacaccgtgcccgccaagggcagacagaacgagggcaagagcgacagcctggagaagatcgagagaagagtgcaggccctgaacaccgtgaaccagagcaagaaggccaccccccccatccccagcaagccccccggcggcttcggcaagaccagcggcacccccgccgtgaagatgagaaacggcgtgagacaggtggccgtgagacccatcgagaagagccagttcatccacaacaacctgaaggacgtgtacgtgagcatcgccgactacgagggcgacgaggagaccgccggcttccaggagggcgtgagcatggaggtgctggagagaaaccccaacggctggtggtactgccagatcctggacggcgtgaagcccttcaagggctgggtgcccagcaactacctggagaagaagaactag

SEQ ID NO: 12869 - DNA, 2907 bp, Artificial Sequence
  Description of Artificial Sequence: Synthetic coding sequence
atgatcctggagcagtacgtggtggtgagcaactacaagaagcaggagaacagcgagctgagcctgcaggccggcgaggtggtggacgtgatcgagaagaacgagagcggctggtggttcgtgagcaccagcgaggagcagggctgggtgcccgccacctacctggaggcccagaacggcaccagagacgacagcgacatcaacaccagcaagaccggcgaggtgagcaagagaagaaaggcccacctgagaagactggacagaagatggaccctgggcggcatggtgaacagacagcacagcagagaggagaagtacgtgaccgtgcagccctacaccagccagagcaaggacgagatcggcttcgagaagggcgtgaccgtggaggtgatcagaaagaacctggagggctggtggtacatcagatacctgggcaaggagggctgggcccccgccagctacctgaagaaggccaaggacgacctgcccaccagaaagaagaacctggccggccccgtggagatcatcggcaacatcatggagatcagcaacctgctgaacaagaaggccagcggcgacaaggagaccccccccgccgagggcgagggccacgaggcccccatcgccaagaaggagatcagcctgcccatcctgtgcaacgccagcaacggcagcgccgtgggcgtgcccgacagaaccgtgagcagactggcccagggcagccccgccgtggccagaatcgccccccagagagcccagatcagcagccccaacctgagaaccagacccccccccagaagagagagcagcctgggcttccagctgcccaagccccccgagccccccagcgtggaggtggagtactacaccatcgccgagttccagagctgcatcagcgacggcatcagcttcagaggcggccagaaggccgaggtgatcgacaagaacagcggcggctggtggtacgtgcagatcggcgagaaggagggctgggcccccgccagctacatcgacaagagaaagaagcccaacctgagcagaagaaccagcaccctgaccagacccaaggtgcccccccccgccccccccagcaagcccaaggaggccgaggagggccccaccggcgccagcgagagccaggacagccccagaaagctgaagtacgaggagcccgagtacgacatccccgccttcggcttcgacagcgagcccgagctgagcgaggagcccgtggaggacagagccagcggcgagagaagacccgcccagccccacagacccagccccgccagcagcctgcagagagccagattcaaggtgggcgagagcagcgaggacgtggccctggaggaggagaccatctacgagaacgagggcttcagaccctacgccgaggacaccctgagcgccagaggcagcagcggcgacagcgacagccccggcagcagcagcctgagcctgaccagaaagaacagccccaagagcggcagccccaagagcagcagcctgctgaagctgaaggccgagaagaacgcccaggccgagatgggcaagaaccacagcagcgccagcttcagcagcagcatcaccatcaacaccacctgctgcagcagcagcagcagcagcagcagcagcctgagcaagaccagcggcgacctgaagcccagaagcgccagcgacgccggcatcagaggcacccccaaggtgagagccaagaaggacgccgacgccaacgccggcctgaccagctgccccagagccaagcccagcgtgagacccaagcccttcctgaacagagccgagagccagagccaggagaagatggacatcagcaccctgagaagacagctgagacccaccggccagctgagaggcggcctgaagggcagcaagagcgaggacagcgagctgcccccccagaccgccagcgaggcccccagcgagggcagcagaagaagcagcagcgacctgatcaccctgcccgccaccacccccccctgccccaccaagaaggagtgggagggccccgccaccagctacatgacctgcagcgcctaccagaaggtgcaggacagcgagatcagcttccccgccggcgtggaggtgcaggtgctggagaagcaggagagcggctggtggtacgtgagattcggcgagctggagggctgggcccccagccactacctggtgctggacgagaacgagcagcccgaccccagcggcaaggagctggacaccgtgcccgccaagggcagacagaacgagggcaagagcgacagcctggagaagatcgagagaagagtgcaggccctgaacaccgtgaaccagagcaagaaggccaccccccccatccccagcaagccccccggcggcttcggcaagaccagcggcacccccgccgtgaagatgagaaacggcgtgagacaggtggccgtgagaccccagagcgtgttcgtgagccccccccccaaggacaacaacctgagctgcgccctgagaagaaacgagagcctgaccgccaccgacggcctgagaggcgtgagaagaaacagcagcttcagcaccgccagaagcgccgccgccgaggccaagggcagactggccgagagagccgccagccagggcagcgacagccccctgctgcccgcccagagaaacagcatccccgtgagccccgtgagacccaagcccatcgagaagagccagttcatccacaacaacctgaaggacgtgtacgtgagcatcgccgactacgagggcgacgaggagaccgccggcttccaggagggcgtgagcatggaggtgctggagagaaaccccaacggctggtggtactgccagatcctggacggcgtgaagcccttcaagggctgggtgcccagcaactacctggagaagaagaactag

SEQ ID NO: 12870 - DNA, 3003 bp, Artificial Sequence
  Description of Artificial Sequence: Synthetic coding sequence
atgaacggcagcttcctgctgagactgctgttccccgtggccagcatcctgcccgagaccgtgctgctgagaggcgccgacgccaccgccgagcccatgatcctggagcagtacgtggtggtgagcaactacaagaagcaggagaacagcgagctgagcctgcaggccggcgaggtggtggacgtgatcgagaagaacgagagcggctggtggttcgtgagcaccagcgaggagcagggctgggtgcccgccacctacctggaggcccagaacggcaccagagacgacagcgacatcaacaccagcaagaccggcgaggtgagcaagagaagaaaggcccacctgagaagactggacagaagatggaccctgggcggcatggtgaacagacagcacagcagagaggagaagtacgtgaccgtgcagccctacaccagccagagcaaggacgagatcggcttcgagaagggcgtgaccgtggaggtgatcagaaagaacctggagggctggtggtacatcagatacctgggcaaggagggctgggcccccgccagctacctgaagaaggccaaggacgacctgcccaccagaaagaagaacctggccggccccgtggagatcatcggcaacatcatggagatcagcaacctgctgaacaagaaggccagcggcgacaaggagaccccccccgccgagggcgagggccacgaggcccccatcgccaagaaggagatcagcctgcccatcctgtgcaacgccagcaacggcagcgccgtgggcgtgcccgacagaaccgtgagcagactggcccagggcagccccgccgtggccagaatcgccccccagagagcccagatcagcagccccaacctgagaaccagacccccccccagaagagagagcagcctgggcttccagctgcccaagccccccgagccccccagcgtggaggtggagtactacaccatcgccgagttccagagctgcatcagcgacggcatcagcttcagaggcggccagaaggccgaggtgatcgacaagaacagcggcggctggtggtacgtgcagatcggcgagaaggagggctgggcccccgccagctacatcgacaagagaaagaagcccaacctgagcagaagaaccagcaccctgaccagacccaaggtgcccccccccgccccccccagcaagcccaaggaggccgaggagggccccaccggcgccagcgagagccaggacagccccagaaagctgaagtacgaggagcccgagtacgacatccccgccttcggcttcgacagcgagcccgagctgagcgaggagcccgtggaggacagagccagcggcgagagaagacccgcccagccccacagacccagccccgccagcagcctgcagagagccagattcaaggtgggcgagagcagcgaggacgtggccctggaggaggagaccatctacgagaacgagggcttcagaccctacgccgaggacaccctgagcgccagaggcagcagcggcgacagcgacagccccggcagcagcagcctgagcctgaccagaaagaacagccccaagagcggcagccccaagagcagcagcctgctgaagctgaaggccgagaagaacgcccaggccgagatgggcaagaaccacagcagcgccagcttcagcagcagcatcaccatcaacaccacctgctgcagcagcagcagcagcagcagcagcagcctgagcaagaccagcggcgacctgaagcccagaagcgccagcgacgccggcatcagaggcacccccaaggtgagagccaagaaggacgccgacgccaacgccggcctgaccagctgccccagagccaagcccagcgtgagacccaagcccttcctgaacagagccgagagccagagccaggagaagatggacatcagcaccctgagaagacagctgagacccaccggccagctgagaggcggcctgaagggcagcaagagcgaggacagcgagctgcccccccagaccgccagcgaggcccccagcgagggcagcagaagaagcagcagcgacctgatcaccctgcccgccaccacccccccctgccccaccaagaaggagtgggagggccccgccaccagctacatgacctgcagcgcctaccagaaggtgcaggacagcgagatcagcttccccgccggcgtggaggtgcaggtgctggagaagcaggagagcggctggtggtacgtgagattcggcgagctggagggctgggcccccagccactacctggtgctggacgagaacgagcagcccgaccccagcggcaaggagctggacaccgtgcccgccaagggcagacagaacgagggcaagagcgacagcctggagaagatcgagagaagagtgcaggccctgaacaccgtgaaccagagcaagaaggccaccccccccatccccagcaagccccccggcggcttcggcaagaccagcggcacccccgccgtgaagatgagaaacggcgtgagacaggtggccgtgagaccccagagcgtgttcgtgagccccccccccaaggacaacaacctgagctgcgccctgagaagaaacgagagcctgaccgccaccgacggcctgagaggcgtgagaagaaacagcagcttcagcaccgccagaagcgccgccgccgaggccaagggcagactggccgagagagccgccagccagggcagcgacagccccctgctgcccgcccagagaaacagcatccccgtgagccccgtgagacccaagcccatcgagaagagccagttcatccacaacaacctgaaggacgtgtacgtgagcatcgccgactacgagggcgacgaggagaccgccggcttccaggagggcgtgagcatggaggtgctggagagaaaccccaacggctggtggtactgccagatcctggacggcgtgaagcccttcaagggctgggtgcccagcaactacctggagaagaagaactag

SEQ ID NO: 12871 - DNA, 414 bp, Artificial Sequence
  Description of Artificial Sequence: Synthetic coding sequence
atgaacaagctgagcggcggcggcggcagaagaaccagagtggagggcggccagctgggcggcgaggagtggaccagacacggcagcttcgtgaacaagcccaccagaggctggctgcaccccaacgacaaggtgatgggccccggcgtgagctacctggtgagatacatgggctgcgtggaggtgctgcagagcatgagagccctggacttcaacaccagaacccaggtgaccagagaggccatcagcctggtgtgcgaggccgtgcccggcgccaagggcgccaccagaagaagaaagccctgcagcagacccctgagcagcatcctgggcagaagcaacctgaagttcgccggcatgcccatcaccctgaccgtgagcaccagcagcctgaacctgatggccgccgactag

SEQ ID NO: 12872 - DNA, 918 bp, Artificial Sequence
  Description of Artificial Sequence: Synthetic coding sequence
atggccggcttcgacggcagcgcctgggacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccggcagagagctgttcgacgaccccagctacgtgaacgtgcagaacctggacaaggccagacaggccgtgggcggcgccggcccccccaaccccgccatcaacggcagcgcccccagagacctgttcgacatgaagcccttcgaggacgccctgagagtgcccccccccccccagagcgtgagcatggccgagcagctgagaggcgagccctggttccacggcaagctgagcagaagagaggccgaggccctgctgcagctgaacggcgacttcctggtgagagagagcaccaccacccccggccagtacgtgctgaccggcctgcagagcggccagcccaagcacctgctgctggtggaccccgagggcgtgagatggggcttcgccatgctgcccaagctgttcctgaacagcagagcccaggtgatcagactgcccagaccccccagagtgctgggcctgcaggccagaaccaccatgcccagcctgcacatcttcttctgcaccgtgtacaccctgctgagacacgccaacttcctgcaggtgaagaagggcgtgtacagcagccagctgcacagcttcagagccgacgtggccttcgccttcagccacttcaccgacctgagcatccccaccaccgtgagcttctag

SEQ ID NO: 12873 - DNA, 1563 bp, Artificial Sequence
  Description of Artificial Sequence: Synthetic coding sequence
atgagcaacctgagactggccaaccccgccggcggcagacccggcagcaagggcgagcccggcagagccgccgacgacggcgagggcatcgtgggcgccgccatgcccgacagcggccccctgcccctgctgcaggacatgaacaagctgagcggcggcggcggcagaagaaccagagtggagggcggccagctgggcggcgaggagtggaccagacacggcagcttcgtgaacaagcccaccagaggctggctgcaccccaacgacaaggtgatgggccccggcgtgagctacctggtgagatacatgggctgcgtggaggtgctgcagagcatgagagccctggacttcaacaccagaacccaggtgaccagagaggccatcagcctggtgtgcgaggccgtgcccggcgccaagggcgccaccagaagaagaaagccctgcagcagacccctgagcagcatcctgggcagaagcaacctgaagttcgccggcatgcccatcaccctgaccgtgagcaccagcagcctgaacctgatggccgccgactgcaagcagatcatcgccaaccaccacatgcagagcatcagcttcgccagcggcggcgaccccgacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagaatggccggcttcgacggcagcgcctgggacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccgccggcagagagctgttcgacgaccccagctacgtgaacgtgcagaacctggacaaggccagacaggccgtgggcggcgccggcccccccaaccccgccatcaacggcagcgcccccagagacctgttcgacatgaagcccttcgaggacgccctgagagtgcccccccccccccagagcgtgagcatggccgagcagctgagaggcgagccctggttccacggcaagctgagcagaagagaggccgaggccctgctgcagctgaacggcgacttcctggtgagagagagcaccaccacccccggccagtacgtgctgaccggcctgcagagcggccagcccaagcacctgctgctggtggaccccgagggcgtggtgagaaccaaggaccacagattcgagagcgtgagccacctgatcagctaccacatggacaaccacctgcccatcatcagcgccggcagcgagctgtgcctgcagcagcccgtggagagaaagctgtag

SEQ ID NO: 12874 - DNA, 1752 bp, Artificial Sequence
  Description of Artificial Sequence: Synthetic coding sequence
atggacctgctgccccccaagcccaagtacaaccccctgagaaacgagagcctgagcagcctggaggagggcgccagcggcagcaccccccccgaggagctgcccagccccagcgccagcagcctgggccccatcctgccccccctgcccggcgacgacagccccaccaccctgtgcagcttcttccccagaatgagcaacctgagactggccaaccccgccggcggcagacccggcagcaagggcgagcccggcagagccgccgacgacggcgagggcatcgtgggcgccgccatgcccgacagcggccccctgcccctgctgcaggacatgaacaagctgagcggcggcggcggcagaagaaccagagtggagggcggccagctgggcggcgaggagtggaccagacacggcagcttcgtgaacaagcccaccagaggctggctgcaccccaacgacaaggtgatgggccccggcgtgagctacctggtgagatacatgggctgcgtggaggtgctgcagagcatgagagccctggacttcaacaccagaacccaggtgaccagagaggccatcagcctggtgtgcgaggccgtgcccggcgccaagggcgccaccagaagaagaaagccctgcagcagacccctgagcagcatcctgggcagaagcaacctgaagttcgccggcatgcccatcaccctgaccgtgagcaccagcagcctgaacctgatggccgccgactgcaagcagatcatcgccaaccaccacatgcagagcatcagcttcgccagcggcggcgaccccgacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagaatggccggcttcgacggcagcgcctgggacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccggcagagagctgttcgacgaccccagctacgtgaacgtgcagaacctggacaaggccagacaggccgtgggcggcgccggcccccccaaccccgccatcaacggcagcgcccccagagacctgttcgacatgaagcccttcgaggacgccctgagagtgcccccccccccccagagcgtgagcatggccgagcagctgagaggcgagccctggttccacggcaagctgagcagaagagaggccgaggccctgctgcagctgaacggcgacttcctggtgagagagagcaccaccacccccggccagtacgtgctgaccggcctgcagagcggccagcccaagcacctgctgctggtggaccccgagggcgtggtgagaaccaaggaccacagattcgagagcgtgagccacctgatcagctaccacatggacaaccacctgcccatcatcagcgccggcagcgagctgtgcctgcagcagcccgtggagagaaagctgtag

SEQ ID NO: 12875 - DNA, 1155 bp, Artificial Sequence
  Description of Artificial Sequence: Synthetic coding sequence
atggacctgctgccccccaagcccaagtacaaccccctgagaaacgagagcctgagcatcctgggcagaagcaacctgaagttcgccggcatgcccatcaccctgaccgtgagcaccagcagcctgaacctgatggccgccgactgcaagcagatcatcgccaaccaccacatgcagagcatcagcttcgccagcggcggcgaccccgacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagaatggccggcttcgacggcagcgcctgggacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccggcagagagctgttcgacgaccccagctacgtgaacgtgcagaacctggacaaggccagacaggccgtgggcggcgccggcccccccaaccccgccatcaacggcagcgcccccagagacctgttcgacatgaagcccttcgaggacgccctgagagtgcccccccccccccagagcgtgagcatggccgagcagctgagaggcgagccctggttccacggcaagctgagcagaagagaggccgaggccctgctgcagctgaacggcgacttcctggtgagagagagcaccaccacccccggccagtacgtgctgaccggcctgcagagcggccagcccaagcacctgctgctggtggaccccgagggcgtggtgagaaccaaggaccacagattcgagagcgtgagccacctgatcagctaccacatggacaaccacctgcccatcatcagcgccggcagcgagctgtgcctgcagcagcccgtggagagaaagctgtag

SEQ ID NO: 12876 - DNA, 1422 bp, Artificial Sequence
  Description of Artificial Sequence: Synthetic coding sequence
atgaacaagctgagcggcggcggcggcagaagaaccagagtggagggcggccagctgggcggcgaggagtggaccagacacggcagcttcgtgaacaagcccaccagaggctggctgcaccccaacgacaaggtgatgggccccggcgtgagctacctggtgagatacatgggctgcgtggaggtgctgcagagcatgagagccctggacttcaacaccagaacccaggtgaccagagaggccatcagcctggtgtgcgaggccgtgcccggcgccaagggcgccaccagaagaagaaagccctgcagcagacccctgagcagcatcctgggcagaagcaacctgaagttcgccggcatgcccatcaccctgaccgtgagcaccagcagcctgaacctgatggccgccgactgcaagcagatcatcgccaaccaccacatgcagagcatcagcttcgccagcggcggcgaccccgacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagaatggccggcttcgacggcagcgcctgggacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccggcagagagctgttcgacgaccccagctacgtgaacgtgcagaacctggacaaggccagacaggccgtgggcggcgccggcccccccaaccccgccatcaacggcagcgcccccagagacctgttcgacatgaagcccttcgaggacgccctgagagtgcccccccccccccagagcgtgagcatggccgagcagctgagaggcgagccctggttccacggcaagctgagcagaagagaggccgaggccctgctgcagctgaacggcgacttcctggtgagagagagcaccaccacccccggccagtacgtgctgaccggcctgcagagcggccagcccaagcacctgctgctggtggaccccgagggcgtggtgagaaccaaggaccacagattcgagagcgtgagccacctgatcagctaccacatggacaaccacctgcccatcatcagcgccggcagcgagctgtgcctgcagcagcccgtggagagaaagctgtag

SEQ ID NO: 12877 - DNA, 1425 bp, Artificial Sequence
  Description of Artificial Sequence: Synthetic coding sequence
atgaacaagctgagcggcggcggcggcagaagaaccagagtggagggcggccagctgggcggcgaggagtggaccagacacggcagcttcgtgaacaagcccaccagaggctggctgcaccccaacgacaaggtgatgggccccggcgtgagctacctggtgagatacatgggctgcgtggaggtgctgcagagcatgagagccctggacttcaacaccagaacccaggtgaccagagaggccatcagcctggtgtgcgaggccgtgcccggcgccaagggcgccaccagaagaagaaagccctgcagcagacccctgagcagcatcctgggcagaagcaacctgaagttcgccggcatgcccatcaccctgaccgtgagcaccagcagcctgaacctgatggccgccgactgcaagcagatcatcgccaaccaccacatgcagagcatcagcttcgccagcggcggcgaccccgacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagaatggccggcttcgacggcagcgcctgggacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccgccggcagagagctgttcgacgaccccagctacgtgaacgtgcagaacctggacaaggccagacaggccgtgggcggcgccggcccccccaaccccgccatcaacggcagcgcccccagagacctgttcgacatgaagcccttcgaggacgccctgagagtgcccccccccccccagagcgtgagcatggccgagcagctgagaggcgagccctggttccacggcaagctgagcagaagagaggccgaggccctgctgcagctgaacggcgacttcctggtgagagagagcaccaccacccccggccagtacgtgctgaccggcctgcagagcggccagcccaagcacctgctgctggtggaccccgagggcgtggtgagaaccaaggaccacagattcgagagcgtgagccacctgatcagctaccacatggacaaccacctgcccatcatcagcgccggcagcgagctgtgcctgcagcagcccgtggagagaaagctgtag

SEQ ID NO: 12878 - DNA, 603 bp, Artificial Sequence
  Description of Artificial Sequence: Synthetic coding sequence
atgaacaagctgagcggcggcggcggcagaagaaccagagtggagggcggccagctgggcggcgaggagtggaccagacacggcagcttcgtgaacaagcccaccagaggctggctgcaccccaacgacaaggtgatgggccccggcgtgagctacctggtgagatacatgggctgcgtggaggtgctgcagagcatgagagccctggacttcaacaccagaacccaggtgaccagagaggccatcagcctggtgtgcgaggccgtgcccggcgccaagggcgccaccagaagaagaaagccctgcagcagacccctgagcagcatcctgggcagaagcaacctgaagttcgccggcatgcccatcaccctgaccgtgagcaccagcagcctgaacctgatggccgccgactgcaagcaggacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagatag

SEQ ID NO: 12879 - DNA, 603 bp, Artificial Sequence
  Description of Artificial Sequence: Synthetic coding sequence
atgcccatcaccctgaccgtgagcaccagcagcctgaacctgatggccgccgactgcaagcaggacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagaatggccggcttcgacggcagcgcctgggacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccgccggcagagagctgttcgacgaccccagctacgtgaacgtgcagaacctggacaaggccagacaggccgtgggcggcgccggccccccctag

SEQ ID NO: 12880 - DNA, 393 bp, Artificial Sequence
  Description of Artificial Sequence: Synthetic coding sequence
atgcccatcaccctgaccgtgagcaccagcagcctgaacctgatggccgccgactgcaagcagatcatcgccaaccaccacatgcagagcatcagcttcgccagcggcggcgaccccgacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagaatggccggcttcgacggcagcgcctgggacgaggaggaggaggagccccccgaccaccagtactacaacgacttccccggcaaggagcccccctag

SEQ ID NO: 12881 - DNA, 894 bp, Artificial Sequence
  Description of Artificial Sequence: Synthetic coding sequence
tgagacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccggcagagagctgttcgacgaccccagctacgtgaacgtgcagaacctggacaaggccagacaggccgtgggcggcgccggcccccccaaccccgccatcaacggcagcgcccccagagacctgttcgacatgaagcccttcgaggacgccctgagagtgcccccccccccccagagcgtgagcatggccgagcagctgagaggcgagccctggttccacggcaagctgagcagaagagaggccgaggccctgctgcagctgaacggcgacttcctggtgagagagagcaccaccacccccggccagtacgtgctgaccggcctgcagagcggccagcccaagcacctgctgctggtggaccccgagggcgtgagatggggcttcgccatgctgcccaagctgttcctgaacagcagagcccaggtgatcagactgcccagaccccccagagtgctgggcctgcaggccagaaccaccatgcccagcctgcacatcttcttctgcaccgtgtacaccctgctgagacacgccaacttcctgcaggtgaagaagggcgtgtacagcagccagctgcacagcttcagagccgacgtggccttcgccttcagccacttcaccgacctgagcatccccaccaccgtgagcttctag

SEQ ID NO: 12882 - DNA, 1755 bp, Artificial Sequence
  Description of Artificial Sequence: Synthetic coding sequence
atggacctgctgccccccaagcccaagtacaaccccctgagaaacgagagcctgagcagcctggaggagggcgccagcggcagcaccccccccgaggagctgcccagccccagcgccagcagcctgggccccatcctgccccccctgcccggcgacgacagccccaccaccctgtgcagcttcttccccagaatgagcaacctgagactggccaaccccgccggcggcagacccggcagcaagggcgagcccggcagagccgccgacgacggcgagggcatcgtgggcgccgccatgcccgacagcggccccctgcccctgctgcaggacatgaacaagctgagcggcggcggcggcagaagaaccagagtggagggcggccagctgggcggcgaggagtggaccagacacggcagcttcgtgaacaagcccaccagaggctggctgcaccccaacgacaaggtgatgggccccggcgtgagctacctggtgagatacatgggctgcgtggaggtgctgcagagcatgagagccctggacttcaacaccagaacccaggtgaccagagaggccatcagcctggtgtgcgaggccgtgcccggcgccaagggcgccaccagaagaagaaagccctgcagcagacccctgagcagcatcctgggcagaagcaacctgaagttcgccggcatgcccatcaccctgaccgtgagcaccagcagcctgaacctgatggccgccgactgcaagcagatcatcgccaaccaccacatgcagagcatcagcttcgccagcggcggcgaccccgacaccgccgagtacgtggcctacgtggccaaggaccccgtgaaccagagagcctgccacatcctggagtgccccgagggcctggcccaggacgtgatcagcaccatcggccaggccttcgagctgagattcaagcagtacctgagaaacccccccaagctggtgaccccccacgacagaatggccggcttcgacggcagcgcctgggacgaggaggaggaggagccccccgaccaccagtactacaacgacttccccggcaaggagccccccctgggcggcgtggtggacatgagactgagagagggcgccgcccccggcgccgccagacccaccgcccccaacgcccagacccccagccacctgggcgccaccctgcccgtgggccagcccgtgggcggcgaccccgaggtgagaaagcagatgccccccccccccccctgccccgccggcagagagctgttcgacgaccccagctacgtgaacgtgcagaacctggacaaggccagacaggccgtgggcggcgccggcccccccaaccccgccatcaacggcagcgcccccagagacctgttcgacatgaagcccttcgaggacgccctgagagtgcccccccccccccagagcgtgagcatggccgagcagctgagaggcgagccctggttccacggcaagctgagcagaagagaggccgaggccctgctgcagctgaacggcgacttcctggtgagagagagcaccaccacccccggccagtacgtgctgaccggcctgcagagcggccagcccaagcacctgctgctggtggaccccgagggcgtggtgagaaccaaggaccacagattcgagagcgtgagccacctgatcagctaccacatggacaaccacctgcccatcatcagcgccggcagcgagctgtgcctgcagcagcccgtggagagaaagctgtag

SEQ ID NO: 12883 - DNA, 1749 bp, Artificial Sequence
  Description of Artificial Sequence: Synthetic coding sequence
atgacccagggccccggcggcagagccccccccgccccccccgccccccccgagcccgaggcccccaccaccttctgcgccctgctgcccagaatgccccagtggaagttcgccgcccccggcggcttcctgggcagaggccccgccgccgccagagccgccggcgccagcggcggcgccgacccccagcccgagcccgccggccccggcggcgtgcccgccctggccgccgccgtgctgggcgcctgcgagcccagatgcgccgccccctgccccctgcccgccctgagcagatgcagaggcgccggcagcagaggcagcagaggcggcagaggcgccgccggcagcggcgacgccgccgccgccgccgagtggatcagaaagggcagcttcatccacaagcccgcccacggctggctgcaccccgacgccagagtgctgggccccggcgtgagctacgtggtgagatacatgggctgcatcgaggtgctgagaagcatgagaagcctggacttcaacaccagaacccaggtgaccagagaggccatcaacagactgcacgaggccgtgcccggcgtgagaggcagctggaagaagaaggcccccaacaaggccctggccagcgtgctgggcaagagcaacctgagattcgccggcatgagcatcagcatccacatcagcaccgacggcctgagcctgagcgtgcccgccaccagacaggtgatcgccaaccaccacatgcccagcatcagcttcgccagcggcggcgacaccgacatgaccgactacgtggcctacgtggccaaggaccccatcaaccagagagcctgccacatcctggagtgctgcgagggcctggcccagagcatcatcagcaccgtgggccaggccttcgagctgagattcaagcagtacctgcacagcccccccaaggtggccctgccccccgagagactggccggccccgaggagagcgcctggggcgacgaggaggacagcctggagcacaactactacaacagcatccccggcaaggagccccccctgggcggcctggtggacagcagactggccctgacccagccctgcgccctgaccgccctggaccagggccccagccccagcctgagagacgcctgcagcctgccctgggacgtgggcagcaccggcaccgccccccccggcgacggctacgtgcaggccgacgccagaggcccccccgaccacgaggagcacctgtacgtgaacacccagggcctggacgcccccgagcccgaggacagccccaagaaggacctgttcgacatgagacccttcgaggacgccctgaagctgcacgagtgcagcgtggccgccggcgtgaccgccgcccccctgcccctggaggaccagtggcccagcccccccaccagaagagcccccgtggcccccaccgaggagcagctgagacaggagccctggtaccacggcagaatgagcagaagagccgccgagagaatgctgagagccgacggcgacttcctggtgagagacagcgtgaccaaccccggccagtacgtgctgaccggcatgcacgccggccagcccaagcacctgctgctggtggaccccgagggcgtggtgagaaccaaggacgtgctgttcgagagcatcagccacctgatcgaccaccacctgcagaacggccagcccatcgtggccgccgagagcgagctgcacctgagaggcgtggtgagcagagagccctag

SEQ ID NO: 12884 - DNA, 1833 bp, Artificial Sequence
  Description of Artificial Sequence: Synthetic coding sequence
atgctggacttcttcaccatcttcagcaagggcggcctggtgctgtggtgcttccagggcgtgagcgacagctgcaccggccccgtgaacgccctgatcagaagcgtgctgctgcaggtgggcttccagaagatcctgaccctgacctacgtggacaagctgatcgacgacgtgcacagactgttcagagacaagtacagaaccgagatccagcagcagagcgccctgagcctgctgaacggcaccttcgacttccagaacgacttcctgagactgctgagagaggccgaggagagcagcaagatcagagcccccaccaccatgaagaagttcgaggacagcgagaaggccaagaagcccgtgagaagcatgatcgagaccagaggcgagaagcccaaggagaaggccaagaacagcaagaagaagggcgccaagaaggagggcagcgacggccccctggccaccagcaagcccgtgcccgccgagaagagcggcctgcccgtgggccccgagaacggcgtggagctgagcaaggaggagctgatcagaagaaagagagaggagttcatccagaagcacggcagaggcatggagaagagcaacaagagcaccaagagcgacgcccccaaggagaagggcaagaaggcccccagagtgtgggagctgggcggctgcgccaacaaggaggtgctggactacagcacccccaccaccaacggcacccccgaggccgccctgagcgaggacatcaacctgatcagaggcaccggcagcggcggccagctgcaggacctggactgcagcagcagcgacgacgagggcgccgcccagaacagcaccaagcccagcgccaccaagggcaccctgggcggcatgttcggcatgctgaagggcctggtgggcagcaagagcctgagcagagaggacatggagagcgtgctggacaagatgagagaccacctgatcgccaagaacgtggccgccgacatcgccgtgcagctgtgcgagagcgtggccaacaagctggagggcaaggtgatgggcaccttcagcaccgtgaccagcaccgtgaagcaggccctgcaggagagcctggtgcagatcctgcagccccagagaagagtggacatgctgagagacatcatggacgcccagagaagacagagaccctacgtggtgaccttctgcggcgtgaacggcgtgggcaagagcaccaacctggccaagatcagcttctggctgctggagaacggcttcagcgtgctgatcgccgcctgcgacaccttcagagccggcgccgtggagcagctgagaacccacaccagaagactgagcgccctgcacccccccgagaagcacggcggcagaaccatggtgcagctgttcgagaagggctacggcaaggacgccgccggcatcgccatggaggccatcgccttcgccagaaaccagggcttcgacgtggtgctggtggacaccgccggcagaatgcaggacaacgcccccctgatgaccgccctggccaagctgatcaccgtgaacacccccgacctggtgctgttcgtgggcgaggccctggtgggcaacgaggccgtggaccagctggtgaagttcaacagagccctggccgaccacagcatggcccagacccccagactgatcgacggcatcgtgctgaccaagttcgacaccatcgacgacaaggtgggcgccgccatcagcatgacctacatcaccagcaagcccatcgtgttcgtgggcaccggccagacctactgcgacctgagaagcctgaacgccaaggccgtggtggccgccctgatgaaggcctag

SEQ ID NO: 12885 - DNA, 2253 bp, Artificial Sequence
  Description of Artificial Sequence: Synthetic coding sequence
atgagccagtggtacgagctgcagcagctggacagcaagttcctggagcaggtgcaccagctgtacgacgacagcttccccatggagatcagacagtacctggcccagtggctggagaagcaggactgggagcacgccgccaacgacgtgagcttcgccaccatcagattccacgacctgctgagccagctggacgaccagtacagcagattcagcctggagaacaacttcctgctgcagcacaacatcagaaagagcaagagaaacctgcaggacaacttccaggaggaccccatccagatgagcatgatcatctacagctgcctgaaggaggagagaaagatcctggagaacgcccagagattcaaccaggcccagagcggcaacatccagagcaccgtgatgctggacaagcagaaggagctggacagcaaggtgagaaacgtgaaggacaaggtgatgtgcatcgagcacgagatcaagagcctggaggacctgcaggacgagtacgacttcaagtgcaagaccctgcagaacagagagcacgagaccaacggcgtggccaagagcgaccagaagcaggagcagctgctgctgaagaagatgtacctgatgctggacaacaagagaaaggaggtggtgcacaagatcatcgagctgctgaacgtgaccgagctgacccagaacgccctgatcaacgacgagctggtggagtggaagagaagacagcagagcgcctgcatcggcggcccccccaacgcctgcctggaccagctgcagaactggttcaccatcgtggccgagagcctgcagcaggtgagacagcagctgaagaagctggaggagctggagcagaagtacacctacgagcacgaccccatcaccaagaacaagcaggtgctgtgggacagaaccttcagcctgttccagcagctgatccagagcagcttcgtggtggagagacagccctgcatgcccacccacccccagagacccctggtgctgaagaccggcgtgcagttcaccgtgaagctgagactgctggtgaagctgcaggagctgaactacaacctgaaggtgaaggtgctgttcgacaaggacgtgaacgagagaaacaccgtgaagggcttcagaaagttcaacatcctgggcacccacaccaaggtgatgaacatggaggagagcaccaacggcagcctggccgccgagttcagacacctgcagctgaaggagcagaagaacgccggcaccagaaccaacgagggccccctgatcgtgaccgaggagctgcacagcctgagcttcgagacccagctgtgccagcccggcctggtgatcgacctggagaccaccagcctgcccgtggtggtgatcagcaacgtgagccagctgcccagcggctgggccagcatcctgtggtacaacatgctggtggccgagcccagaaacctgagcttcttcctgacccccccctgcgccagatgggcccagctgagcgaggtgctgagctggcagttcagcagcgtgaccaagagaggcctgaacgtggaccagctgaacatgctgggcgagaagctgctgggccccaacgccagccccgacggcctgatcccctggaccagattctgcaaggagaacatcaacgacaagaacttccccttctggctgtggatcgagagcatcctggagctgatcaagaagcacctgctgcccctgtggaacgacggctgcatcatgggcttcatcagcaaggagagagagagagccctgctgaaggaccagcagcccggcaccttcctgctgagattcagcgagagcagcagagagggcgccatcaccttcacctgggtggagagaagccagaacggcggcgagcccgacttccacgccgtggagccctacaccaagaaggagctgagcgccgtgaccttccccgacatcatcagaaactacaaggtgatggccgccgagaacatccccgagaaccccctgaagtacctgtaccccaacatcgacaaggaccacgccttcggcaagtactacagcagacccaaggaggcccccgagcccatggagctggacggccccaagggcaccggctacatcaagaccgagctgatcagcgtgagcgaggtgcaccccagcagactgcagaccaccgacaacctgctgcccatgagccccgaggagttcgacgaggtgagcagaatcgtgggcagcgtggagttcgacagcatgatgaacaccgtgtag

SEQ ID NO: 12886 - DNA, 2139 bp, Artificial Sequence
  Description of Artificial Sequence: Synthetic coding sequence
atgagccagtggtacgagctgcagcagctggacagcaagttcctggagcaggtgcaccagctgtacgacgacagcttccccatggagatcagacagtacctggcccagtggctggagaagcaggactgggagcacgccgccaacgacgtgagcttcgccaccatcagattccacgacctgctgagccagctggacgaccagtacagcagattcagcctggagaacaacttcctgctgcagcacaacatcagaaagagcaagagaaacctgcaggacaacttccaggaggaccccatccagatgagcatgatcatctacagctgcctgaaggaggagagaaagatcctggagaacgcccagagattcaaccaggcccagagcggcaacatccagagcaccgtgatgctggacaagcagaaggagctggacagcaaggtgagaaacgtgaaggacaaggtgatgtgcatcgagcacgagatcaagagcctggaggacctgcaggacgagtacgacttcaagtgcaagaccctgcagaacagagagcacgagaccaacggcgtggccaagagcgaccagaagcaggagcagctgctgctgaagaagatgtacctgatgctggacaacaagagaaaggaggtggtgcacaagatcatcgagctgctgaacgtgaccgagctgacccagaacgccctgatcaacgacgagctggtggagtggaagagaagacagcagagcgcctgcatcggcggcccccccaacgcctgcctggaccagctgcagaactggttcaccatcgtggccgagagcctgcagcaggtgagacagcagctgaagaagctggaggagctggagcagaagtacacctacgagcacgaccccatcaccaagaacaagcaggtgctgtgggacagaaccttcagcctgttccagcagctgatccagagcagcttcgtggtggagagacagccctgcatgcccacccacccccagagacccctggtgctgaagaccggcgtgcagttcaccgtgaagctgagactgctggtgaagctgcaggagctgaactacaacctgaaggtgaaggtgctgttcgacaaggacgtgaacgagagaaacaccgtgaagggcttcagaaagttcaacatcctgggcacccacaccaaggtgatgaacatggaggagagcaccaacggcagcctggccgccgagttcagacacctgcagctgaaggagcagaagaacgccggcaccagaaccaacgagggccccctgatcgtgaccgaggagctgcacagcctgagcttcgagacccagctgtgccagcccggcctggtgatcgacctggagaccaccagcctgcccgtggtggtgatcagcaacgtgagccagctgcccagcggctgggccagcatcctgtggtacaacatgctggtggccgagcccagaaacctgagcttcttcctgacccccccctgcgccagatgggcccagctgagcgaggtgctgagctggcagttcagcagcgtgaccaagagaggcctgaacgtggaccagctgaacatgctgggcgagaagctgctgggccccaacgccagccccgacggcctgatcccctggaccagattctgcaaggagaacatcaacgacaagaacttccccttctggctgtggatcgagagcatcctggagctgatcaagaagcacctgctgcccctgtggaacgacggctgcatcatgggcttcatcagcaaggagagagagagagccctgctgaaggaccagcagcccggcaccttcctgctgagattcagcgagagcagcagagagggcgccatcaccttcacctgggtggagagaagccagaacggcggcgagcccgacttccacgccgtggagccctacaccaagaaggagctgagcgccgtgaccttccccgacatcatcagaaactacaaggtgatggccgccgagaacatccccgagaaccccctgaagtacctgtaccccaacatcgacaaggaccacgccttcggcaagtactacagcagacccaaggaggcccccgagcccatggagctggacggccccaagggcaccggctacatcaagaccgagctgatcagcgtgagcgaggtgtag

SEQ ID NO: 12887 - DNA, 2145 bp, Artificial Sequence
  Description of Artificial Sequence: Synthetic coding sequence
atgtggatgagccagtggtacgagctgcagcagctggacagcaagttcctggagcaggtgcaccagctgtacgacgacagcttccccatggagatcagacagtacctggcccagtggctggagaagcaggactgggagcacgccgccaacgacgtgagcttcgccaccatcagattccacgacctgctgagccagctggacgaccagtacagcagattcagcctggagaacaacttcctgctgcagcacaacatcagaaagagcaagagaaacctgcaggacaacttccaggaggaccccatccagatgagcatgatcatctacagctgcctgaaggaggagagaaagatcctggagaacgcccagagattcaaccaggcccagagcggcaacatccagagcaccgtgatgctggacaagcagaaggagctggacagcaaggtgagaaacgtgaaggacaaggtgatgtgcatcgagcacgagatcaagagcctggaggacctgcaggacgagtacgacttcaagtgcaagaccctgcagaacagagagcacgagaccaacggcgtggccaagagcgaccagaagcaggagcagctgctgctgaagaagatgtacctgatgctggacaacaagagaaaggaggtggtgcacaagatcatcgagctgctgaacgtgaccgagctgacccagaacgccctgatcaacgacgagctggtggagtggaagagaagacagcagagcgcctgcatcggcggcccccccaacgcctgcctggaccagctgcagaactggttcaccatcgtggccgagagcctgcagcaggtgagacagcagctgaagaagctggaggagctggagcagaagtacacctacgagcacgaccccatcaccaagaacaagcaggtgctgtgggacagaaccttcagcctgttccagcagctgatccagagcagcttcgtggtggagagacagccctgcatgcccacccacccccagagacccctggtgctgaagaccggcgtgcagttcaccgtgaagctgagactgctggtgaagctgcaggagctgaactacaacctgaaggtgaaggtgctgttcgacaaggacgtgaacgagagaaacaccgtgaagggcttcagaaagttcaacatcctgggcacccacaccaaggtgatgaacatggaggagagcaccaacggcagcctggccgccgagttcagacacctgcagctgaaggagcagaagaacgccggcaccagaaccaacgagggccccctgatcgtgaccgaggagctgcacagcctgagcttcgagacccagctgtgccagcccggcctggtgatcgacctggagaccaccagcctgcccgtggtggtgatcagcaacgtgagccagctgcccagcggctgggccagcatcctgtggtacaacatgctggtggccgagcccagaaacctgagcttcttcctgacccccccctgcgccagatgggcccagctgagcgaggtgctgagctggcagttcagcagcgtgaccaagagaggcctgaacgtggaccagctgaacatgctgggcgagaagctgctgggccccaacgccagccccgacggcctgatcccctggaccagattctgcaaggagaacatcaacgacaagaacttccccttctggctgtggatcgagagcatcctggagctgatcaagaagcacctgctgcccctgtggaacgacggctgcatcatgggcttcatcagcaaggagagagagagagccctgctgaaggaccagcagcccggcaccttcctgctgagattcagcgagagcagcagagagggcgccatcaccttcacctgggtggagagaagccagaacggcggcgagcccgacttccacgccgtggagccctacaccaagaaggagctgagcgccgtgaccttccccgacatcatcagaaactacaaggtgatggccgccgagaacatccccgagaaccccctgaagtacctgtaccccaacatcgacaaggaccacgccttcggcaagtactacagcagacccaaggaggcccccgagcccatggagctggacggccccaagggcaccggctacatcaagaccgagctgatcagcgtgagcgaggtgtag

SEQ ID NO: 12888 - DNA, 2253 bp, Artificial Sequence; identical to SEQ ID NO: 12885
  Description of Artificial Sequence: Synthetic coding sequence

SEQ ID NO: 12889 - DNA, 543 bp, Artificial Sequence
  Description of Artificial Sequence: Synthetic coding sequence
atgagccagtggtacgagctgcagcagctggacagcaagttcctggagcaggtgcaccagctgtacgacgacagcttccccatggagatcagacagtacctggcccagtggctggagaagcaggactgggagcacgccgccaacgacgtgagcttcgccaccatcagattccacgacctgctgagccagctggacgaccagtacagcagattcagcctggagaacaacttcctgctgcagcacaacatcagaaagagcaagagaaacctgcaggacaacttccaggaggaccccatccagatgagcatgatcatctacagctgcctgaaggaggagagaaagatcctggagaacgcccagagattcaaccaggcccagagcggcaacatccagagcaccgtgatgctggacaagcagaaggagctggacagcaaggtgagaaacgtgaaggacaaggtgatgtgcatcgagcacgagatcaagagcctggaggacctgcaggacgagtacgacttcaagtgcaagaccctgcagaacagatag

SEQ ID NO: 12890 - DNA, 213 bp, Artificial Sequence
  Description of Artificial Sequence: Synthetic coding sequence
atgagccagtggtacgagctgcagcagctggacagcaagttcctggagcaggtgcaccagctgtacgacgacagcttccccatggagatcagacagtacctggcccagtggctggagaagcaggactgggagcacgccgccaacgacgtgagcttcgccaccatcagattccacgacctgctgagccagctggacgaccagtacagcagatag

SEQ ID NO: 12891 - DNA, 582 bp, Artificial Sequence
  Description of Artificial Sequence: Synthetic coding sequence
atgagccagtggtacgagctgcagcagctggacagcaagttcctggagcaggtgcaccagctgtacgacgacagcttccccatggagatcagacagtacctggcccagtggctggagaagcaggactgggagcacgccgccaacgacgtgagcttcgccaccatcagattccacgacctgctgagccagctggacgaccagtacagcagattcagcctggagaacaacttcctgctgcagcacaacatcagaaagagcaagagaaacctgcaggacaacttccaggaggaccccatccagatgagcatgatcatctacagctgcctgaaggaggagagaaagatcctggagaacgcccagagattcaaccaggcccagagcggcaacatccagagcaccgtgatgctggacaagcagaaggagctggacagcaaggtgagaaacgtgaaggacaaggtgatgtgcatcgagcacgagatcaagagcctggaggacctgcaggacgagtacgacttcaagtgcaagaccctgcagaacagaggcagcagcagccagaacaacagagtggccgagtgccactag

SEQ ID NO: 12892 - DNA, 453 bp, Artificial Sequence
  Description of Artificial Sequence: Synthetic coding sequence
atgagccagtggtacgagctgcagcagctggacagcaagttcctggagcaggtgcaccagctgtacgacgacagcttccccatggagatcagacagtacctggcccagtggctggagaagcaggactgggagcacgccgccaacgacgtgagcttcgccaccatcagattccacgacctgctgagccagctggacgaccagtacagcagattcagcctggagaacaacttcctgctgcagcacaacatcagaaagagcaagagaaacctgcaggacaacttccaggaggaccccatccagatgagcatgatcatctacagctgcctgaaggaggagagaaagatcctggagaacgcccagagattcaaccaggcccagagcggcaacatccagagcaccgtgatgctggacaagcagaaggagctggacagcaaggtgagaaacgtgaagtag

SEQ ID NO: 12893 - DNA, 582 bp, Artificial Sequence; identical to SEQ ID NO: 12891
  Description of Artificial Sequence: Synthetic coding sequence

SEQ ID NO: 12894 - DNA, 483 bp, Artificial Sequence
  Description of Artificial Sequence: Synthetic coding sequence
gagtgccacgaggaccccatccagatgagcatgatcatctacagctgcctgaaggaggagagaaagatcctggagaacgcccagagattcaaccaggcccagagcggcaacatccagagcaccgtgatgctggacaagcagaaggagctggacagcaaggtgagaaacgtgaaggacaaggtgatgtgcatcgagcacgagatcaagagcctggaggacctgcaggacgagtacgacttcaagtgcaagaccctgcagaacagagagcacgagaccaacggcgtggccaagagcgaccagaagcaggagcagctgctgctgaagaagatgtacctgatgctggacaacaagagaaaggaggtggtgcacaagatcatcgagctgctgaacgtgaccgagctgacccagaacgccctgatcaacgacgagctggtggagtggaagagaagacagcagagcgcctgcatcggcggccccccctag

SEQ ID NO: 12895 - DNA, 2556 bp, Artificial Sequence
  Description of Artificial Sequence: Synthetic coding sequence
atggcccagtgggagatgctgcagaacctggacagccccttccaggaccagctgcaccagctgtacagccacagcctgctgcccgtggacatcagacagtacctggccgtgtggatcgaggaccagaactggcaggaggccgccctgggcagcgacgacagcaaggccaccatgctgttcttccacttcctggaccagctgaactacgagtgcggcagatgcagccaggaccccgagagcctgctgctgcagcacaacctgagaaagttctgcagagacatccagcccttcagccaggaccccacccagctggccgagatgatcttcaacctgctgctggaggagaagagaatcctgatccaggcccagagagcccagctggagcagggcgagcccgtgctggagacccccgtggagagccagcagcacgagatcgagagcagaatcctggacctgagagccatgatggagaagctggtgaagagcatcagccagctgaaggaccagcaggacgtgttctgcttcagatacaagatccaggccaagggcaagacccccagcctggacccccaccagaccaaggagcagaagatcctgcaggagaccctgaacgagctggacaagagaagaaaggaggtgctggacgccagcaaggccctgctgggcagactgaccaccctgatcgagctgctgctgcccaagctggaggagtggaaggcccagcagcagaaggcctgcatcagagcccccatcgaccacggcctggagcagctggagacctggttcaccgccggcgccaagctgctgttccacctgagacagctgctgaaggagctgaagggcctgagctgcctggtgagctaccaggacgaccccctgaccaagggcgtggacctgagaaacgcccaggtgaccgagctgctgcagagactgctgcacagagccttcgtggtggagacccagccctgcatgccccagaccccccacagacccctgatcctgaagaccggcagcaagttcaccgtgagaaccagactgctggtgagactgcaggagggcaacgagagcctgaccgtggaggtgagcatcgacagaaaccccccccagctgcagggcttcagaaagttcaacatcctgaccagcaaccagaagaccctgacccccgagaagggccagagccagggcctgatctgggacttcggctacctgaccctggtggagcagagaagcggcggcagcggcaagggcagcaacaagggccccctgggcgtgaccgaggagctgcacatcatcagcttcaccgtgaagtacacctaccagggcctgaagcaggagctgaagaccgacaccctgcccgtggtgatcatcagcaacatgaaccagctgagcatcgcctgggccagcgtgctgtggttcaacctgctgagccccaacctgcagaaccagcagttcttcagcaacccccccaaggccccctggagcctgctgggccccgccctgagctggcagttcagcagctacgtgggcagaggcctgaacagcgaccagctgagcatgctgagaaacaagctgttcggccagaactgcagaaccgaggaccccctgctgagctgggccgacttcaccaagagagagagcccccccggcaagctgcccttctggacctggctggacaagatcctggagctggtgcacgaccacctgaaggacctgtggaacgacggcagaatcatgggcttcgtgagcagaagccaggagagaagactgctgaagaagaccatgagcggcaccttcctgctgagattcagcgagagcagcgagggcggcatcacctgcagctgggtggagcaccaggacgacgacaaggtgctgatctacagcgtgcagccctacaccaaggaggtgctgcagagcctgcccctgaccgagatcatcagacactaccagctgctgaccgaggagaacatccccgagaaccccctgagattcctgtaccccagaatccccagagacgaggccttcggctgctactaccaggagaaggtgaacctgcaggagagaagaaagtacctgaagcacagactgatcgtggtgagcaacagacaggtggacgagctgcagcagcccctggagctgaagcccgagcccgagctggagagcctggagctggagctgggcctggtgcccgagcccgagctgagcctggacctggagcccctgctgaaggccggcctggacctgggccccgagctggagagcgtgctggagagcaccctggagcccgtgatcgagcccaccctgtgcatggtgagccagaccgtgcccgagcccgaccagggccccgtgagccagcccgtgcccgagcccgacctgccctgcgacctgagacacctgaacaccgagcccatggagatcttcagaaactgcgtgaagatcgaggagatcatgcccaacggcgaccccctgctggccggccagaacaccgtggacgaggtgtacgtgagcagacccagccacttctacaccgacggccccctgatgcccagcgacttctag

SEQ ID NO: 12896 - DNA, 1383 bp, Artificial Sequence
  Description of Artificial Sequence: Synthetic coding sequence
atggcccagtgggagatgctgcagaacctggacagccccttccaggaccagctgcaccagctgtacagccacagcctgctgcccgtggacatcagacagtacctggccgtgtggatcgaggaccagaactggcaggaggccgccctgggcagcgacgacagcaaggccaccatgctgttcttccacttcctggaccagctgaactacgagtgcggcagatgcagccaggaccccgagagcctgctgctgcagcacaacctgagaaagttctgcagagacatccaggaccccacccagctggccgagatgatcttcaacctgctgctggaggagaagagaatcctgatccaggcccagagagcccagctggagcagggcgagcccgtgctggagacccccgtggagagccagcagcacgagatcgagagcagaatcctggacctgagagccatgatggagaagctggtgaagagcatcagccagctgaaggaccagcaggacgtgttctgcttcagatacaagatccaggccaagggcaagacccccagcctggacccccaccagaccaaggagcagaagatcctgcaggagaccctgaacgagctggacaagagaagaaaggaggtgctggacgccagcaaggccctgctgggcagactgaccaccctgatcgagctgctgctgcccaagctggaggagtggaaggcccagcagcagaaggcctgcatcagagcccccatcgaccacggcctggagcagctggagacctggttcaccgccggcgccaagctgctgttccacctgagacagctgctgaaggagctgaagggcctgagctgcctggtgagctaccaggacgaccccctgaccaagggcgtggacctgagaaacgcccaggtgaccgagctgctgcagagactgctgcacagagccttcgtggtggagacccagccctgcatgccccagaccccccacagacccctgatcctgaagaccggcagcaagttcaccgtgagaaccagactgctggtgagactgcaggagggcaacgagagcctgaccgtggaggtgagcatcgacagaaaccccccccagctgcagggcttcagaaagttcaacatcctgaccagcaaccagaagaccctgacccccgagaagggccagagccagggcctgatctgggacttcggctacctgaccctggtggagcagagaagcggcggcagcggcaagggcagcaacaagggccccctgggcgtgaccgaggagctgcacatcatcagcttcaccgtgaagtacacctaccagggcctgaagcaggagctgaaggtgagcgagaacggcggccagggcgagagaaagcagctgtggaagaaggcctag

SEQ ID NO: 12897 - DNA, 2544 bp, Artificial Sequence
  Description of Artificial Sequence: Synthetic coding sequence
atggcccagtgggagatgctgcagaacctggacagccccttccaggaccagctgcaccagctgtacagccacagcctgctgcccgtggacatcagacagtacctggccgtgtggatcgaggaccagaactggcaggaggccgccctgggcagcgacgacagcaaggccaccatgctgttcttccacttcctggaccagctgaactacgagtgcggcagatgcagccaggaccccgagagcctgctgctgcagcacaacctgagaaagttctgcagagacatccaggaccccacccagctggccgagatgatcttcaacctgctgctggaggagaagagaatcctgatccaggcccagagagcccagctggagcagggcgagcccgtgctggagacccccgtggagagccagcagcacgagatcgagagcagaatcctggacctgagagccatgatggagaagctggtgaagagcatcagccagctgaaggaccagcaggacgtgttctgcttcagatacaagatccaggccaagggcaagacccccagcctggacccccaccagaccaaggagcagaagatcctgcaggagaccctgaacgagctggacaagagaagaaaggaggtgctggacgccagcaaggccctgctgggcagactgaccaccctgatcgagctgctgctgcccaagctggaggagtggaaggcccagcagcagaaggcctgcatcagagcccccatcgaccacggcctggagcagctggagacctggttcaccgccggcgccaagctgctgttccacctgagacagctgctgaaggagctgaagggcctgagctgcctggtgagctaccaggacgaccccctgaccaagggcgtggacctgagaaacgcccaggtgaccgagctgctgcagagactgctgcacagagccttcgtggtggagacccagccctgcatgccccagaccccccacagacccctgatcctgaagaccggcagcaagttcaccgtgagaaccagactgctggtgagactgcaggagggcaacgagagcctgaccgtggaggtgagcatcgacagaaaccccccccagctgcagggcttcagaaagttcaacatcctgaccagcaaccagaagaccctgacccccgagaagggccagagccagggcctgatctgggacttcggctacctgaccctggtggagcagagaagcggcggcagcggcaagggcagcaacaagggccccctgggcgtgaccgaggagctgcacatcatcagcttcaccgtgaagtacacctaccagggcctgaagcaggagctgaagaccgacaccctgcccgtggtgatcatcagcaacatgaaccagctgagcatcgcctgggccagcgtgctgtggttcaacctgctgagccccaacctgcagaaccagcagttcttcagcaacccccccaaggccccctggagcctgctgggccccgccctgagctggcagttcagcagctacgtgggcagaggcctgaacagcgaccagctgagcatgctgagaaacaagctgttcggccagaactgcagaaccgaggaccccctgctgagctgggccgacttcaccaagagagagagcccccccggcaagctgcccttctggacctggctggacaagatcctggagctggtgcacgaccacctgaaggacctgtggaacgacggcagaatcatgggcttcgtgagcagaagccaggagagaagactgctgaagaagaccatgagcggcaccttcctgctgagattcagcgagagcagcgagggcggcatcacctgcagctgggtggagcaccaggacgacgacaaggtgctgatctacagcgtgcagccctacaccaaggaggtgctgcagagcctgcccctgaccgagatcatcagacactaccagctgctgaccgaggagaacatccccgagaaccccctgagattcctgtaccccagaatccccagagacgaggccttcggctgctactaccaggagaaggtgaacctgcaggagagaagaaagtacctgaagcacagactgatcgtggtgagcaacagacaggtggacgagctgcagcagcccctggagctgaagcccgagcccgagctggagagcctggagctggagctgggcctggtgcccgagcccgagctgagcctggacctggagcccctgctgaaggccggcctggacctgggccccgagctggagagcgtgctggagagcaccctggagcccgtgatcgagcccaccctgtgcatggtgagccagaccgtgcccgagcccgaccagggccccgtgagccagcccgtgcccgagcccgacctgccctgcgacctgagacacctgaacaccgagcccatggagatcttcagaaactgcgtgaagatcgaggagatcatgcccaacggcgaccccctgctggccggccagaacaccgtggacgaggtgtacgtgagcagacccagccacttctacaccgacggccccctgatgcccagcgacttctag

SEQ ID NO: 12898 - DNA, 2313 bp, Artificial Sequence
  Description of Artificial Sequence: Synthetic coding sequence
atggcccagtggaaccagctgcagcagctggacaccagatacctggagcagctgcaccagctgtacagcgacagcttccccatggagctgagacagttcctggccccctggatcgagagccaggactgggcctacgccgccagcaaggagagccacgccaccctggtgttccacaacctgctgggcgagatcgaccagcagtacagcagattcctgcaggagagcaacgtgctgtaccagcacaacctgagaagaatcaagcagttcctgcagagcagatacctggagaagcccatggagatcgccagaatcgtggccagatgcctgtgggaggagagcagactgctgcagaccgccgccaccgccgcccagcagggcggccaggccaaccaccccaccgccgccgtggtgaccgagaagcagcagatgctggagcagcacctgcaggacgtgagaaagagagtgcaggacctggagcagaagatgaaggtggtggagaacctgcaggacgacttcgacttcaactacaagaccctgaagagccagggcgacatgcaggacctgaacggcaacaaccagagcgtgaccagacagaagatgcagcagctggagcagatgctgaccgccctggaccagatgagaagaagcatcgtgagcgagctggccggcctgctgagcgccatggagtacgtgcagaagaccctgaccgacgaggagctggccgactggaagagaagacagcagatcgcctgcatcggcggcccccccaacatctgcctggacagactggagaactggatcaccagcctggccgagagccagctgcagaccagacagcagatcaagaagctggaggagctgcagcagaaggtgagctacaagggcgaccccatcgtgcagcacagacccatgctggaggagagaatcgtggagctgttcagaaacctgatgaagagcgccttcgtggtggagagacagccctgcatgcccatgcaccccgacagacccctggtgatcaagaccggcgtgcagttcaccaccaaggtgagactgctggtgaagttccccgagctgaactaccagctgaagatcaaggtgtgcatcgacaaggacagcggcgacgtggccgccctgagaggcagcagaaagttcaacatcctgggcaccaacaccaaggtgatgaacatggaggagagcaacaacggcagcctgagcgccgagttcaagcacctgaccctgagagagcagagatgcggcaacggcggcagagccaactgcgacgccagcctgatcgtgaccgaggagctgcacctgatcaccttcgagaccgaggtgtaccaccagggcctgaagatcgacctggagacccacagcctgcccgtggtggtgatcagcaacatctgccagatgcccaacgcctgggccagcatcctgtggtacaacatgctgaccaacaaccccaagaacgtgaacttcttcaccaagccccccatcggcacctgggaccaggtggccgaggtgctgagctggcagttcagcagcaccaccaagagaggcctgagcatcgagcagctgaccaccctggccgagaagctgctgggccccggcgtgaactacagcggctgccagatcacctgggccaagttctgcaaggagaacatggccggcaagggcttcagcttctgggtgtggctggacaacatcatcgacctggtgaagaagtacatcctggccctgtggaacgagggctacatcatgggcttcatcagcaaggagagagagagagccatcctgagcaccaagccccccggcaccttcctgctgagattcagcgagagcagcaaggagggcggcgtgaccttcacctgggtggagaaggacatcagcggcaagacccagatccagagcgtggagccctacaccaagcagcagctgaacaacatgagcttcgccgagatcatcatgggctacaagatcatggacgccaccaacatcctggtgagccccctggtgtacctgtaccccgacatccccaaggaggaggccttcggcaagtactgcagacccgagagccaggagcaccccgaggccgaccccggcagcgccgccccctacctgaagaccaagttcatctgcgtgacccccaccacctgcagcaacaccatcgacctgcccatgagccccagaaccctggacagcctgatgcagttcggcaacaacggcgagggcgccgagcccagcgccggcggccagttcgagagcctgaccttcgacatggagctgaccagcgagtgcgccaccagccccatgtag

SEQ ID NO: 12899 - DNA, 2019 bp, Artificial Sequence
  Description of Artificial Sequence: Synthetic coding sequence
atggagatcgccagaatcgtggccagatgcctgtgggaggagagcagactgctgcagaccgccgccaccgccgcccagcagggcggccaggccaaccaccccaccgccgccgtggtgaccgagaagcagcagatgctggagcagcacctgcaggacgtgagaaagagagtgcaggacctggagcagaagatgaaggtggtggagaacctgcaggacgacttcgacttcaactacaagaccctgaagagccagggcgacatgcaggacctgaacggcaacaaccagagcgtgaccagacagaagatgcagcagctggagcagatgctgaccgccctggaccagatgagaagaagcatcgtgagcgagctggccggcctgctgagcgccatggagtacgtgcagaagaccctgaccgacgaggagctggccgactggaagagaagacagcagatcgcctgcatcggcggcccccccaacatctgcctggacagactggagaactggatcaccagcctggccgagagccagctgcagaccagacagcagatcaagaagctggaggagctgcagcagaaggtgagctacaagggcgaccccatcgtgcagcacagacccatgctggaggagagaatcgtggagctgttcagaaacctgatgaagagcgccttcgtggtggagagacagccctgcatgcccatgcaccccgacagacccctggtgatcaagaccggcgtgcagttcaccaccaaggtgagactgctggtgaagttccccgagctgaactaccagctgaagatcaaggtgtgcatcgacaaggacagcggcgacgtggccgccctgagaggcagcagaaagttcaacatcctgggcaccaacaccaaggtgatgaacatggaggagagcaacaacggcagcctgagcgccgagttcaagcacctgaccctgagagagcagagatgcggcaacggcggcagagccaactgcgacgccagcctgatcgtgaccgaggagctgcacctgatcaccttcgagaccgaggtgtaccaccagggcctgaagatcgacctggagacccacagcctgcccgtggtggtgatcagcaacatctgccagatgcccaacgcctgggccagcatcctgtggtacaacatgctgaccaacaaccccaagaacgtgaacttcttcaccaagccccccatcggcacctgggaccaggtggccgaggtgctgagctggcagttcagcagcaccaccaagagaggcctgagcatcgagcagctgaccaccctggccgagaagctgctgggccccggcgtgaactacagcggctgccagatcacctgggccaagttctgcaaggagaacatggccggcaagggcttcagcttctgggtgtggctggacaacatcatcgacctggtgaagaagtacatcctggccctgtggaacgagggctacatcatgggcttcatcagcaaggagagagagagagccatcctgagcaccaagccccccggcaccttcctgctgagattcagcgagagcagcaaggagggcggcgtgaccttcacctgggtggagaaggacatcagcggcaagacccagatccagagcgtggagccctacaccaagcagcagctgaacaacatgagcttcgccgagatcatcatgggctacaagatcatggacgccaccaacatcctggtgagccccctggtgtacctgtaccccgacatccccaaggaggaggccttcggcaagtactgcagacccgagagccaggagcaccccgaggccgaccccggcagcgccgccccctacctgaagaccaagttcatctgcgtgacccccaccacctgcagcaacaccatcgacctgcccatgagccccagaaccctggacagcctgatgcagttcggcaacaacggcgagggcgccgagcccagcgccggcggccagttcgagagcctgaccttcgacatggagctgaccagcgagtgcgccaccagccccatgtag

SEQ ID NO: 12900 - DNA, 2310 bp, Artificial Sequence
  Description of Artificial Sequence: Synthetic coding sequence
atggcccagtggaaccagctgcagcagctggacaccagatacctggagcagctgcaccagctgtacagcgacagcttccccatggagctgagacagttcctggccccctggatcgagagccaggactgggcctacgccgccagcaaggagagccacgccaccctggtgttccacaacctgctgggcgagatcgaccagcagtacagcagattcctgcaggagagcaacgtgctgtaccagcacaacctgagaagaatcaagcagttcctgcagagcagatacctggagaagcccatggagatcgccagaatcgtggccagatgcctgtgggaggagagcagactgctgcagaccgccgccaccgccgcccagcagggcggccaggccaaccaccccaccgccgccgtggtgaccgagaagcagcagatgctggagcagcacctgcaggacgtgagaaagagagtgcaggacctggagcagaagatgaaggtggtggagaacctgcaggacgacttcgacttcaactacaagaccctgaagagccagggcgacatgcaggacctgaacggcaacaaccagagcgtgaccagacagaagatgcagcagctggagcagatgctgaccgccctggaccagatgagaagaagcatcgtgagcgagctggccggcctgctgagcgccatggagtacgtgcagaagaccctgaccgacgaggagctggccgactggaagagaagacagcagatcgcctgcatcggcggcccccccaacatctgcctggacagactggagaactggatcaccagcctggccgagagccagctgcagaccagacagcagatcaagaagctggaggagctgcagcagaaggtgagctacaagggcgaccccatcgtgcagcacagacccatgctggaggagagaatcgtggagctgttcagaaacctgatgaagagcgccttcgtggtggagagacagccctgcatgcccatgcaccccgacagacccctggtgatcaagaccggcgtgcagttcaccaccaaggtgagactgctggtgaagttccccgagctgaactaccagctgaagatcaaggtgtgcatcgacaaggacagcggcgacgtggccgccctgagaggcagcagaaagttcaacatcctgggcaccaacaccaaggtgatgaacatggaggagagcaacaacggcagcctgagcgccgagttcaagcacctgaccctgagagagcagagatgcggcaacggcggcagagccaactgcgacgccagcctgatcgtgaccgaggagctgcacctgatcaccttcgagaccgaggtgtaccaccagggcctgaagatcgacctggagacccacagcctgcccgtggtggtgatcagcaacatctgccagatgcccaacgcctgggccagcatcctgtggtacaacatgctgaccaacaaccccaagaacgtgaacttcttcaccaagccccccatcggcacctgggaccaggtggccgaggtgctgagctggcagttcagcagcaccaccaagagaggcctgagcatcgagcagctgaccaccctggccgagaagctgctgggccccggcgtgaactacagcggctgccagatcacctgggccaagttctgcaaggagaacatggccggcaagggcttcagcttctgggtgtggctggacaacatcatcgacctggtgaagaagtacatcctggccctgtggaacgagggctacatcatgggcttcatcagcaaggagagagagagagccatcctgagcaccaagccccccggcaccttcctgctgagattcagcgagagcagcaaggagggcggcgtgaccttcacctgggtggagaaggacatcagcggcaagacccagatccagagcgtggagccctacaccaagcagcagctgaacaacatgagcttcgccgagatcatcatgggctacaagatcatggacgccaccaacatcctggtgagccccctggtgtacctgtaccccgacatccccaaggaggaggccttcggcaagtactgcagacccgagagccaggagcaccccgaggccgaccccggcgccgccccctacctgaagaccaagttcatctgcgtgacccccaccacctgcagcaacaccatcgacctgcccatgagccccagaaccctggacagcctgatgcagttcggcaacaacggcgagggcgccgagcccagcgccggcggccagttcgagagcctgaccttcgacatggagctgaccagcgagtgcgccaccagccccatgtag

SEQ ID NO: 12901 - DNA, 2169 bp, Artificial Sequence
  Description of Artificial Sequence: Synthetic coding sequence
atggcccagtggaaccagctgcagcagctggacaccagatacctggagcagctgcaccagctgtacagcgacagcttccccatggagctgagacagttcctggccccctggatcgagagccaggactgggcctacgccgccagcaaggagagccacgccaccctggtgttccacaacctgctgggcgagatcgaccagcagtacagcagattcctgcaggagagcaacgtgctgtaccagcacaacctgagaagaatcaagcagttcctgcagagcagatacctggagaagcccatggagatcgccagaatcgtggccagatgcctgtgggaggagagcagactgctgcagaccgccgccaccgccgcccagcagggcggccaggccaaccaccccaccgccgccgtggtgaccgagaagcagcagatgctggagcagcacctgcaggacgtgagaaagagagtgcaggacctggagcagaagatgaaggtggtggagaacctgcaggacgacttcgacttcaactacaagaccctgaagagccagggcgacatgcaggacctgaacggcaacaaccagagcgtgaccagacagaagatgcagcagctggagcagatgctgaccgccctggaccagatgagaagaagcatcgtgagcgagctggccggcctgctgagcgccatggagtacgtgcagaagaccctgaccgacgaggagctggccgactggaagagaagacagcagatcgcctgcatcggcggcccccccaacatctgcctggacagactggagaactggatcaccagcctggccgagagccagctgcagaccagacagcagatcaagaagctggaggagctgcagcagaaggtgagctacaagggcgaccccatcgtgcagcacagacccatgctggaggagagaatcgtggagctgttcagaaacctgatgaagagcgccttcgtggtggagagacagccctgcatgcccatgcaccccgacagacccctggtgatcaagaccggcgtgcagttcaccaccaaggtgagactgctggtgaagttccccgagctgaactaccagctgaagatcaaggtgtgcatcgacaaggacagcggcgacgtggccgccctgagaggcagcagaaagttcaacatcctgggcaccaacaccaaggtgatgaacatggaggagagcaacaacggcagcctgagcgccgagttcaagcacctgaccctgagagagcagagatgcggcaacggcggcagagccaactgcgacgccagcctgatcgtgaccgaggagctgcacctgatcaccttcgagaccgaggtgtaccaccagggcctgaagatcgacctggagacccacagcctgcccgtggtggtgatcagcaacatctgccagatgcccaacgcctgggccagcatcctgtggtacaacatgctgaccaacaaccccaagaacgtgaacttcttcaccaagccccccatcggcacctgggaccaggtggccgaggtgctgagctggcagttcagcagcaccaccaagagaggcctgagcatcgagcagctgaccaccctggccgagaagctgctgggccccggcgtgaactacagcggctgccagatcacctgggccaagttctgcaaggagaacatggccggcaagggcttcagcttctgggtgtggctggacaacatcatcgacctggtgaagaagtacatcctggccctgtggaacgagggctacatcatgggcttcatcagcaaggagagagagagagccatcctgagcaccaagccccccggcaccttcctgctgagattcagcgagagcagcaaggagggcggcgtgaccttcacctgggtggagaaggacatcagcggcaagacccagatccagagcgtggagccctacaccaagcagcagctgaacaacatgagcttcgccgagatcatcatgggctacaagatcatggacgccaccaacatcctggtgagccccctggtgtacctgtaccccgacatccccaaggaggaggccttcggcaagtactgcagacccgagagccaggagcaccccgaggccgaccccggcagcgccgccccctacctgaagaccaagttcatctgcgtgacccccttcatcgacgccgtgtggaagtag

SEQ ID NO: 12902 - DNA, 2247 bp, Artificial Sequence
  Description of Artificial Sequence: Synthetic coding sequence
atgagccagtggaaccaggtgcagcagctggagatcaagttcctggagcaggtggaccagttctacgacgacaacttccccatggagatcagacacctgctggcccagtggatcgagaaccaggactgggaggccgccagcaacaacgagaccatggccaccatcctgctgcagaacctgctgatccagctggacgagcagctgggcagagtgagcaaggagaagaacctgctgctgatccacaacctgaagagaatcagaaaggtgctgcagggcaagttccacggcaaccccatgcacgtggccgtggtgatcagcaactgcctgagagaggagagaagaatcctggccgccgccaacatgcccgtgcagggccccctggagaagagcctgcagagcagcagcgtgagcgagagacagagaaacgtggagcacaaggtggccgccatcaagaacagcgtgcagatgaccgagcaggacaccaagtacctggaggacctgcaggacgagttcgactacagatacaagaccatccagaccatggaccagagcgacaagaacagcgccatggtgaaccaggaggtgctgaccctgcaggagatgctgaacagcctggacttcaagagaaaggaggccctgagcaagatgacccagatcatccacgagaccgacctgctgatgaacaccatgctgatcgaggagctgcaggactggaagagaagacagcagatcgcctgcatcggcggccccctgcacaacggcctggaccagctgcagaactgcttcaccctgctggccgagagcctgttccagctgagaagacagctggagaagctggaggagcagagcaccaagatgacctacgagggcgaccccatccccatgcagagaacccacatgctggagagagtgaccttcctgatctacaacctgttcaagaacagcttcgtggtggagagacagccctgcatgcccacccacccccagagacccctggtgctgaagaccctgatccagttcaccgtgaagctgagactgctgatcaagctgcccgagctgaactaccaggtgaaggtgaaggccagcatcgacaagaacgtgagcaccctgagcaacagaagattcgtgctgtgcggcaccaacgtgaaggccatgagcatcgaggagagcagcaacggcagcctgagcgtggagttcagacacctgcagcccaaggagatgaagagcagcgccggcggcaagggcaacgagggctgccacatggtgaccgaggagctgcacagcatcaccttcgagacccagatctgcctgtacggcctgaccatcgacctggagaccagcagcctgcccgtggtgatgatcagcaacgtgagccagctgcccaacgcctgggccagcatcatctggtacaacgtgagcaccaacgacagccagaacctggtgttcttcaacaaccccccccccgccaccctgagccagctgctggaggtgatgagctggcagttcagcagctacgtgggcagaggcctgaacagcgaccagctgcacatgctggccgagaagctgaccgtgcagagcagctacagcgacggccacctgacctgggccaagttctgcaaggagcacctgcccggcaagagcttcaccttctggacctggctggaggccatcctggacctgatcaagaagcacatcctgcccctgtggatcgacggctacgtgatgggcttcgtgagcaaggagaaggagagactgctgctgaaggacaagatgcccggcaccttcctgctgagattcagcgagagccacctgggcggcatcaccttcacctgggtggaccacagcgagagcggcgaggtgagattccacagcgtggagccctacaacaagggcagactgagcgccctgcccttcgccgacatcctgagagactacaaggtgatcatggccgagaacatccccgagaaccccctgaagtacctgtaccccgacatccccaaggacaaggccttcggcaagcactacagcagccagccctgcgaggtgagcagacccaccgagagaggcgacaagggctacgtgcccagcgtgttcatccccatcagcaccatcagaagcgacagcaccgagccccacagccccagcgacctgctgcccatgagccccagcgtgtacgccgtgctgagagagaacctgagccccaccaccatcgagaccgccatgaagagcccctacagcgccgagtag

SEQ ID NO: 12903 - DNA, 2247 bp, Artificial Sequence; identical to SEQ ID NO: 12902
  Description of Artificial Sequence: Synthetic coding sequence

SEQ ID NO: 12904 - DNA, 354 bp, Artificial Sequence
  Description of Artificial Sequence: Synthetic coding sequence
atgagccagtggaaccaggtgcagcagctggagatcaagttcctggagcaggtggaccagttctacgacgacaacttccccatggagatcagacacctgctggcccagtggatcgagaaccaggactgggaggccgccagcaacaacgagaccatggccaccatcctgctgcagaacctgctgatccagctggacgagcagctgggcagagtgagcaaggagaagaacctgctgctgatccacaacctgaagagaatcagaaaggtgctgcagagccccggcctggccaccgcccagctgcccctggacagacacggcgagacctgcatccagagaagcaagagctgcccctag

SEQ ID NO: 12905 - DNA, 78 bp, Artificial Sequence
  Description of Artificial Sequence: Synthetic coding sequence
atgagccagtggaaccaggtgcagcagctggagatcaagttcctggagcaggtggaccagttctacgacgacaactag

SEQ ID NO: 12906 - DNA, 240 bp, Artificial Sequence
  Description of Artificial Sequence: Synthetic coding sequence
atgagccagtggaaccaggtgcagcagctggagatcaagttcctggagcaggtggaccagttctacgacgacaacttccccatggagatcagacacctgctggcccagtggatcgagaaccaggactgggaggccgccagcaacaacgagaccatggccaccatcctgctgcagaacctgctgatccagctggacgagcagctgggcagagtgagcaaggagaagaacctgctgctgtag

SEQ ID NO: 12907 - DNA, 2385 bp, Artificial Sequence
  Description of Artificial Sequence: Synthetic coding sequence
atggccggctggatccaggcccagcagctgcagggcgacgccctgagacagatgcaggtgctgtacggccagcacttccccatcgaggtgagacactacctggcccagtggatcgagagccagccctgggacgccatcgacctggacaacccccaggacagagcccaggccacccagctgctggagggcctggtgcaggagctgcagaagaaggccgagcaccaggtgggcgaggacggcttcctgctgaagatcaagctgggccactacgccacccagctgcagaagacctacgacagatgccccctggagctggtgagatgcatcagacacatcctgtacaacgagcagagactggtgagagaggccaacaactgcagcagccccgccggcatcctggtggacgccatgagccagaagcacctgcagatcaaccagaccttcgaggagctgagactggtgacccaggacaccgagaacgagctgaagaagctgcagcagacccaggagtacttcatcatccagtaccaggagagcctgagaatccaggcccagttcgcccagctggcccagctgagcccccaggagagactgagcagagagaccgccctgcagcagaagcaggtgagcctggaggcctggctgcagagagaggcccagaccctgcagcagtacagagtggagctggccgagaagcaccagaagaccctgcagctgctgagaaagcagcagaccatcatcctggacgacgagctgatccagtggaagagaagacagcagctggccggcaacggcggcccccccgagggcagcctggacgtgctgcagagctggtgcgagaagctggccgagatcatctggcagaacagacagcagatcagaagagccgagcacctgtgccagcagctgcccatccccggccccgtggaggagatgctggccgaggtgaacgccaccatcaccgacatcatcagcgccctggtgaccagcaccttcatcatcgagaagcagcccccccaggtgctgaagacccagaccaagttcgccgccaccgtgagactgctggtgggcggcaagctgaacgtgcacatgaaccccccccaggtgaaggccaccatcatcagcgagcagcaggccaagagcctgctgaagaacgagaacaccagaaacgagtgcagcggcgagatcctgaacaactgctgcgtgatggagtaccaccaggccaccggcaccctgagcgcccacttcagaaacatgagcctgaagagaatcaagagagccgacagaagaggcgccgagagcgtgaccgaggagaagttcaccgtgctgttcgagagccagttcagcgtgggcagcaacgagctggtgttccaggtgaagaccctgagcctgcccgtggtggtgatcgtgcacggcagccaggaccacaacgccaccgccaccgtgctgtgggacaacgccttcgccgagcccggcagagtgcccttcgccgtgcccgacaaggtgctgtggccccagctgtgcgaggccctgaacatgaagttcaaggccgaggtgcagagcaacagaggcctgaccaaggagaacctggtgttcctggcccagaagctgttcaacaacagcagcagccacctggaggactacagcggcctgagcgtgagctggagccagttcaacagagagaacctgcccggctggaactacaccttctggcagtggttcgacggcgtgatggaggtgctgaagaagcaccacaagccccactggaacgacggcgccatcctgggcttcgtgaacaagcagcaggcccacgacctgctgatcaacaagcccgacggcaccttcctgctgagattcagcgacagcgagatcggcggcatcaccatcgcctggaagttcgacagccccgagagaaacctgtggaacctgaagcccttcaccaccagagacttcagcatcagaagcctggccgacagactgggcgacctgagctacctgatctacgtgttccccgacagacccaaggacgaggtgttcagcaagtactacacccccgtgctggccaaggccgtggacggctacgtgaagccccagatcaagcaggtggtgcccgagttcgtgaacgccagcgccgacgccggcggcagcagcgccacctacatggaccaggcccccagccccgccgtgtgcccccaggccccctacaacatgtacccccagaaccccgaccacgtgctggaccaggacggcgagttcgacctggacgagaccatggacgtggccagacacgtggaggagctgctgagaagacccatggacagcctggacagcagactgagcccccccgccggcctgttcaccagcgccagaggcagcctgagctag

SEQ ID NO: 12908 - DNA, 378 bp, Artificial Sequence
  Description of Artificial Sequence: Synthetic coding sequence
atggccggctggatccaggcccagcagctgcagggcgacgccctgagacagatgcaggtgctgtacggccagcacttccccatcgaggtgagacactacctggcccagtggatcgagagccagccctgggacgccatcgacctggacaacccccaggacagagcccaggccacccagctgctggagggcctggtgcaggagctgcagaagaaggccgagcaccaggtgggcgaggacggcttcctgctgaagatcaagctgggccactacgccacccagctgcagaagacctacgacagatgccccctggagctggtgagatgcatcagacacatcctgtacaacgagcagagactggtgagagaggccaacaactag

SEQ ID NO: 12909 - DNA, 2376 bp, Artificial Sequence
  Description of Artificial Sequence: Synthetic coding sequence
atggccggctggatccaggcccagcagctgcagggcgacgccctgagacagatgcaggtgctgtacggccagcacttccccatcgaggtgagacactacctggcccagtggatcgagagccagccctgggacgccatcgacctggacaacccccaggacagagcccaggccacccagctgctggagggcctggtgcaggagctgcagaagaaggccgagcaccaggtgggcgaggacggcttcctgctgaagatcaagctgggccactacgccacccagctgcagaagacctacgacagatgccccctggagctggtgagatgcatcagacacatcctgtacaacgagcagagactggtgagagaggccaacaactgcagcagccccgccggcatcctggtggacgccatgagccagaagcacctgcagatcaaccagaccttcgaggagctgagactggtgacccaggacaccgagaacgagctgaagaagctgcagcagacccaggagtacttcatcatccagtaccaggagagcctgagaatccaggcccagttcgcccagctggcccagctgagcccccaggagagactgagcagagagaccgccctgcagcagaagcaggtgagcctggaggcctggctgcagagagaggcccagaccctgcagcagtacagagtggagctggccgagaagcaccagaagaccctgcagctgctgagaaagcagcagaccatcatcctggacgacgagctgatccagtggaagagaagacagcagctggccggcaacggcggcccccccgagggcagcctggacgtgctgcagagctggtgcgagaagctggccgagatcatctggcagaacagacagcagatcagaagagccgagcacctgtgccagcagctgcccatccccggccccgtggaggagatgctggccgaggtgaacgccaccatcaccgacatcatcagcgccctggtgaccagcaccttcatcatcgagaagcagcccccccaggtgctgaagacccagaccaagttcgccgccaccgtgagactgctggtgggcggcaagctgaacgtgcacatgaaccccccccaggtgaaggccaccatcatcagcgagcagcaggccaagagcctgctgaagaacgagaacaccagaaacgagtgcagcggcgagatcctgaacaactgctgcgtgatggagtaccaccaggccaccggcaccctgagcgcccacttcagaaacatgagcctgaagagaatcaagagagccgacagaagaggcgccgagagcgtgaccgaggagaagttcaccgtgctgttcgagagccagttcagcgtgggcagcaacgagctggtgttccaggtgaagaccctgagcctgcccgtggtggtgatcgtgcacggcagccaggaccacaacgccaccgccaccgtgctgtgggacaacgccttcgccgagcccggcagagtgcccttcgccgtgcccgacaaggtgctgtggccccagctgtgcgaggccctgaacatgaagttcaaggccgaggtgcagagcaacagaggcctgaccaaggagaacctggtgttcctggcccagaagctgttcaacaacagcagcagccacctggaggactacagcggcctgagcgtgagctggagccagttcaacagagagaacctgcccggctggaactacaccttctggcagtggttcgacggcgtgatggaggtgctgaagaagcaccacaagccccactggaacgacggcggcttcgtgaacaagcagcaggcccacgacctgctgatcaacaagcccgacggcaccttcctgctgagattcagcgacagcgagatcggcggcatcaccatcgcctggaagttcgacagccccgagagaaacctgtggaacctgaagcccttcaccaccagagacttcagcatcagaagcctggccgacagactgggcgacctgagctacctgatctacgtgttccccgacagacccaaggacgaggtgttcagcaagtactacacccccgtgctggccaaggccgtggacggctacgtgaagccccagatcaagcaggtggtgcccgagttcgtgaacgccagcgccgacgccggcggcagcagcgccacctacatggaccaggcccccagccccgccgtgtgcccccaggccccctacaacatgtacccccagaaccccgaccacgtgctggaccaggacggcgagttcgacctggacgagaccatggacgtggccagacacgtggaggagctgctgagaagacccatggacagcctggacagcagactgagcccccccgccggcctgttcaccagcgccagaggcagcctgagctag

SEQ ID NO: 12910 - DNA, 2298 bp, Artificial Sequence
  Description of Artificial Sequence: Synthetic coding sequence
accgccatggccggctggatccaggcccagcagctgcagggcgacgccctgagacagatgcaggtgctgtacggccagcacttccccatcgaggtgagacactacctggcccagtggatcgagagccagccctgggacgccatcgacctggacaacccccaggacagagcccaggccacccagctgctggagggcctggtgcaggagctgcagaagaaggccgagcaccaggtgggcgaggacggcttcctgctgaagatcaagctgggccactacgccacccagctgcagaagacctacgacagatgccccctggagctggtgagatgcatcagacacatcctgtacaacgagcagagactggtgagagaggccaacaactgcagcagccccgccggcatcctggtggacgccatgagccagaagcacctgcagatcaaccagaccttcgaggagctgagactggtgacccaggacaccgagaacgagctgaagaagctgcagcagacccaggagtacttcatcatccagtaccaggagagcctgagaatccaggcccagttcgcccagctggcccagctgagcccccaggagagactgagcagagagaccgccctgcagcagaagcaggtgagcctggaggcctggctgcagagagaggcccagaccctgcagcagtacagagtggagctggccgagaagcaccagaagaccctgcagctgctgagaaagcagcagaccatcatcctggacgacgagctgatccagtggaagagaagacagcagctggccggcaacggcggcccccccgagggcagcctggacgtgctgcagagctggtgcgagaagctggccgagatcatctggcagaacagacagcagatcagaagagccgagcacctgtgccagcagctgcccatccccggccccgtggaggagatgctggccgaggtgaacgccaccatcaccgacatcatcagcgccctggtgaccagcaccttcatcatcgagaagcagcccccccaggtgctgaagacccagaccaagttcgccgccaccgtgagactgctggtgggcggcaagctgaacgtgcacatgaaccccccccaggtgaaggccaccatcatcagcgagcagcaggccaagagcctgctgaagaacgagaacaccagaaacgagtgcagcggcgagatcctgaacaactgctgcgtgatggagtaccaccaggccaccggcaccctgagcgcccacttcagaaacatgagcctgaagagaatcaagagagccgacagaagaggcgccgagagcgtgaccgaggagaagttcaccgtgctgttcgagagccagttcagcgtgggcagcaacgagctggtgttccaggtgaagggcagagtgcccttcgccgtgcccgacaaggtgctgtggccccagctgtgcgaggccctgaacatgaagttcaaggccgaggtgcagagcaacagaggcctgaccaaggagaacctggtgttcctggcccagaagctgttcaacaacagcagcagccacctggaggactacagcggcctgagcgtgagctggagccagttcaacagagagaacctgcccggctggaactacaccttctggcagtggttcgacggcgtgatggaggtgctgaagaagcaccacaagccccactggaacgacggcgccatcctgggcttcgtgaacaagcagcaggcccacgacctgctgatcaacaagcccgacggcaccttcctgctgagattcagcgacagcgagatcggcggcatcaccatcgcctggaagttcgacagccccgagagaaacctgtggaacctgaagcccttcaccaccagagacttcagcatcagaagcctggccgacagactgggcgacctgagctacctgatctacgtgttccccgacagacccaaggacgaggtgttcagcaagtactacacccccgtgctggccaaggccgtggacggctacgtgaagccccagatcaagcaggtggtgcccgagttcgtgaacgccagcgccgacgccggcggcagcagcgccacctacatggaccaggcccccagccccgccgtgtgcccccaggccccctacaacatgtacccccagaaccccgaccacgtgctggaccaggacggcgagttcgacctggacgagaccatggacgtggccagacacgtggaggagctgctgagaagacccatggacagcctggacagcagactgagcccccccgccggcctgttcaccagcgccagaggcagcctgagctag

SEQ ID NO: 12911 - DNA, 2295 bp, Artificial Sequence
  Description of Artificial Sequence: Synthetic coding sequence
atggccggctggatccaggcccagcagctgcagggcgacgccctgagacagatgcaggtgctgtacggccagcacttccccatcgaggtgagacactacctggcccagtggatcgagagccagccctgggacgccatcgacctggacaacccccaggacagagcccaggccacccagctgctggagggcctggtgcaggagctgcagaagaaggccgagcaccaggtgggcgaggacggcttcctgctgaagatcaagctgggccactacgccacccagctgcagtgcagcagccccgccggcatcctggtggacgccatgagccagaagcacctgcagatcaaccagaccttcgaggagctgagactggtgacccaggacaccgagaacgagctgaagaagctgcagcagacccaggagtacttcatcatccagtaccaggagagcctgagaatccaggcccagttcgcccagctggcccagctgagcccccaggagagactgagcagagagaccgccctgcagcagaagcaggtgagcctggaggcctggctgcagagagaggcccagaccctgcagcagtacagagtggagctggccgagaagcaccagaagaccctgcagctgctgagaaagcagcagaccatcatcctggacgacgagctgatccagtggaagagaagacagcagctggccggcaacggcggcccccccgagggcagcctggacgtgctgcagagctggtgcgagaagctggccgagatcatctggcagaacagacagcagatcagaagagccgagcacctgtgccagcagctgcccatccccggccccgtggaggagatgctggccgaggtgaacgccaccatcaccgacatcatcagcgccctggtgaccagcaccttcatcatcgagaagcagcccccccaggtgctgaagacccagaccaagttcgccgccaccgtgagactgctggtgggcggcaagctgaacgtgcacatgaaccccccccaggtgaaggccaccatcatcagcgagcagcaggccaagagcctgctgaagaacgagaacaccagaaacgagtgcagcggcgagatcctgaacaactgctgcgtgatggagtaccaccaggccaccggcaccctgagcgcccacttcagaaacatgagcctgaagagaatcaagagagccgacagaagaggcgccgagagcgtgaccgaggagaagttcaccgtgctgttcgagagccagttcagcgtgggcagcaacgagctggtgttccaggtgaagaccctgagcctgcccgtggtggtgatcgtgcacggcagccaggaccacaacgccaccgccaccgtgctgtgggacaacgccttcgccgagcccggcagagtgcccttcgccgtgcccgacaaggtgctgtggccccagctgtgcgaggccctgaacatgaagttcaaggccgaggtgcagagcaacagaggcctgaccaaggagaacctggtgttcctggcccagaagctgttcaacaacagcagcagccacctggaggactacagcggcctgagcgtgagctggagccagttcaacagagagaacctgcccggctggaactacaccttctggcagtggttcgacggcgtgatggaggtgctgaagaagcaccacaagccccactggaacgacggcgccatcctgggcttcgtgaacaagcagcaggcccacgacctgctgatcaacaagcccgacggcaccttcctgctgagattcagcgacagcgagatcggcggcatcaccatcgcctggaagttcgacagccccgagagaaacctgtggaacctgaagcccttcaccaccagagacttcagcatcagaagcctggccgacagactgggcgacctgagctacctgatctacgtgttccccgacagacccaaggacgaggtgttcagcaagtactacacccccgtgctggccaaggccgtggacggctacgtgaagccccagatcaagcaggtggtgcccgagttcgtgaacgccagcgccgacgccggcggcagcagcgccacctacatggaccaggcccccagccccgccgtgtgcccccaggccccctacaacatgtacccccagaaccccgaccacgtgctggaccaggacggcgagttcgacctggacgagaccatggacgtggccagacacgtggaggagctgctgagaagacccatggacagcctggacagcagactgagcccccccgccggcctgttcaccagcgccagaggcagcctgagctag

SEQ ID NO: 12912 - DNA, 2295 bp, Artificial Sequence; identical to SEQ ID NO: 12911
  Description of Artificial Sequence: Synthetic coding sequence

SEQ ID NO: 12913 - DNA, 2364 bp, Artificial Sequence
  Description of Artificial Sequence: Synthetic coding sequence
atggccgtgtggatccaggcccagcagctgcagggcgaggccctgcaccagatgcaggccctgtacggccagcacttccccatcgaggtgagacactacctgagccagtggatcgagagccaggcctgggacagcgtggacctggacaacccccaggagaacatcaaggccacccagctgctggagggcctggtgcaggagctgcagaagaaggccgagcaccaggtgggcgaggacggcttcctgctgaagatcaagctgggccactacgccacccagctgcagaacacctacgacagatgccccatggagctggtgagatgcatcagacacatcctgtacaacgagcagagactggtgagagaggccaacaacggcagcagccccgccggcagcctggccgacgccatgagccagaagcacctgcagatcaaccagaccttcgaggagctgagactggtgacccaggacaccgagaacgagctgaagaagctgcagcagacccaggagtacttcatcatccagtaccaggagagcctgagaatccaggcccagttcggccccctggcccagctgagcccccaggagagactgagcagagagaccgccctgcagcagaagcaggtgagcctggaggcctggctgcagagagaggcccagaccctgcagcagtacagagtggagctggccgagaagcaccagaagaccctgcagctgctgagaaagcagcagaccatcatcctggacgacgagctgatccagtggaagagaagacagcagctggccggcaacggcggcccccccgagggcagcctggacgtgctgcagagctggtgcgagaagctggccgagatcatctggcagaacagacagcagatcagaagagccgagcacctgtgccagcagctgcccatccccggccccgtggaggagatgctggccgaggtgaacgccaccatcaccgacatcatcagcgccctggtgaccagcaccttcatcatcgagaagcagcccccccaggtgctgaagacccagaccaagttcgccgccaccgtgagactgctggtgggcggcaagctgaacgtgcacatgaaccccccccaggtgaaggccaccatcatcagcgagcagcaggccaagagcctgctgaagaacgagaacaccagaaacgactacagcggcgagatcctgaacaactgctgcgtgatggagtaccaccaggccaccggcaccctgagcgcccacttcagaaacatgagcctgaagagaatcaagagaagcgacagaagaggcgccgagagcgtgaccgaggagaagttcaccatcctgttcgagagccagttcagcgtgggcggcaacgagctggtgttccaggtgaagaccctgagcctgcccgtggtggtgatcgtgcacggcagccaggacaacaacgccaccgccaccgtgctgtgggacaacgccttcgccgagcccggcagagtgcccttcgccgtgcccgacaaggtgctgtggccccagctgtgcgaggccctgaacatgaagttcaaggccgaggtgcagagcaacagaggcctgaccaaggagaacctggtgttcctggcccagaagctgttcaacaacagcagcagccacctggaggactacagcggcctgagcgtgagctggagccagttcaacagagagaacctgcccggcagaaactacaccttctggcagtggttcgacggcgtgatggaggtgctgaagaagcacctgaagccccactggaacgacggcgccatcctgggcttcgtgaacaagcagcaggcccacgacctgctgatcaacaagcccgacggcaccttcctgctgagattcagcgacagcgagatcggcggcatcaccatcgcctggaagttcgacagccaggagagaatgttctggaacctgatgcccttcaccaccagagacttcagcatcagaagcctggccgacagactgggcgacctgaactacctgatctacgtgttccccgacagacccaaggacgaggtgtacagcaagtactacacccccgtgccctgcgagagcgccaccgccaaggccgtggacggctacgtgaagccccagatcaagcaggtggtgcccgagttcgtgaacgccagcgccgacgccggcggcggcagcgccacctacatggaccaggcccccagccccgccgtgtgcccccaggcccactacaacatgtacccccagaaccccgacagcgtgctggacaccgacggcgacttcgacctggaggacaccatggacgtggccagaagagtggaggagctgctgggcagacccatggacagccagtggatcccccacgcccagagctag

SEQ ID NO: 12914 - DNA, 471 bp, Artificial Sequence
  Description of Artificial Sequence: Synthetic coding sequence
atggccgtgtggatccaggcccagcagctgcagggcgaggccctgcaccagatgcaggccctgtacggccagcacttccccatcgaggtgagacactacctgagccagtggatcgagagccaggcctgggacagcgtggacctggacaacccccaggagaacatcaaggccacccagctgctggagggcctggtgcaggagctgcagaagaaggccgagcaccaggtgggcgaggacggcttcctgctgaagatcaagctgggccactacgccacccagctgcagaacacctacgacagatgccccatggagctggtgagatgcatcagacacatcctgtacaacgagcagagactggtgagagaggccaacaacggcagcagccccgccggcagcctggccgacgccatgagccagaagcacctgcagatcaaccagaccttcgaggagctgagactggtgacccagtag

SEQ ID NO: 12915 - DNA, 534 bp, Artificial Sequence
  Description of Artificial Sequence: Synthetic coding sequence
atgccccaggccttcctgctgggcagcatccacgagcccgccggcgccctgatggagccccagccctgccccggcagcctggccgagagcttcctggaggaggagctgagactgaacgccgagctgagccagctgcagttcagcgagcccgtgggcatcatctacaaccccgtggagtacgcctgggagccccacagaaactacgtgaccagatactgccagggccccaaggaggtgctgttcctgggcatgaaccccggccccttcggcatggcccagaccggcgtgcccttcggcgaggtgagcatggtgagagactggctgggcatcgtgggccccgtgctgacccccccccaggagcaccccaagagacccgtgctgggcctggagtgcccccagagcgagggccccagacagagcatgggccacgagatcaagagcgagctgctgatgggcggctgcagctggatcagaggcaagatccagtgcgacagagtgcaggtgagaagacccggcttcagcagccagctgtag

SEQ ID NO: 12916 - DNA, 813 bp, Artificial Sequence
  Description of Artificial Sequence: Synthetic coding sequence
atgccccaggccttcctgctgggcagcatccacgagcccgccggcgccctgatggagccccagccctgccccggcagcctggccgagagcttcctggaggaggagctgagactgaacgccgagctgagccagctgcagttcagcgagcccgtgggcatcatctacaaccccgtggagtacgcctgggagccccacagaaactacgtgaccagatactgccagggccccaaggaggtgctgttcctgggcatgaaccccggccccttcggcatggcccagaccggcgtgcccttcggcgaggtgagcatggtgagagactggctgggcatcgtgggccccgtgctgacccccccccaggagcaccccaagagacccgtgctgggcctggagtgcccccagagcgaggtgagcggcgccagattctggggcttcttcagaaacctgtgcggccagcccgaggtgttcttccaccactgcttcgtgcacaacctgtgccccctgctgttcctggcccccagcggcagaaacctgacccccgccgagctgcccgccaagcagagagagcagctgctgggcatctgcgacgccgccctgtgcagacaggtgcagctgctgggcgtgagactggtggtgggcgtgggcagactggccgagcagagagccagaagagccctggccggcctgatgcccgaggtgcaggtggagggcctgctgcaccccagccccagaaacccccaggccaacaagggctgggaggccgtggccaaggagagactgaacgagctgggcctgctgcccctgctgctgaagtag

SEQ ID NO: 12917 - DNA, 813 bp, Artificial Sequence; identical to SEQ ID NO: 12916
  Description of Artificial Sequence: Synthetic coding sequence

SEQ ID NO: 12918 - DNA, 249 bp, Artificial Sequence
  Description of Artificial Sequence: Synthetic coding sequence
atgccccaggccttcctgctgggcagcatccacgagcccgccggcgccctgatggagccccagccctgccccggcagcctggccgagagcttcctggaggaggagctgagactgaacgccgagctgagccagctgcagttcagcgagcccgtgggcatcatctacaaccccgtggagtacgcctgggagccccacagaaactacgtgaccagatactgccagggccccaaggaggtgctgttcctgtag

SEQ ID NO: 12919 - DNA, 519 bp, Artificial Sequence
  Description of Artificial Sequence: Synthetic coding sequence
atgccccaggccttcctgctgggcagcatccacgagcccgccggcgccctgatggagccccagccctgccccggcagcctggccgagagcttcctggaggaggagctgagactgaacgccgagctgagccagctgcagttcagcgagcccgtgggcatcatctacaaccccgtggagtacgcctgggagccccacagaaactacgtgaccagatactgccagggccccaaggaggtgctgttcctgggcatgaaccccggccccttcggcatggcccagaccggcgtgcccttcggcgaggtgagcatggtgagagactggctgggcatcgtgggccccgtgctgacccccccccaggagcaccccaagagacccgtgctgggcctggagtgcccccagagcgaggtgagcggcgccagattctggggcttcttcagaaacctgtgcggccagcccgaggtgttcttccaccactgcttcgtgcacaacctgtgccccctgctgttcctggccccctag

SEQ ID NO: 12920 - DNA, 291 bp, Artificial Sequence
  Description of Artificial Sequence: Synthetic coding sequence
atgccccaggccttcctgctgggcagcatccacgagcccgccggcgccctgatggagccccagccctgccccggcagcctggccgagagcttcctggaggaggagctgagactgaacgccgagctgagccagctgcagttcagcgagcccgtgggcatcatctacaaccccgtggagtacgcctgggagccccacagaaactacgtgaccagatactgccagggccccaaggaggtgctgttcctgggcatgaaccccggccccttcggcatggcccagaccggcgtgtag

SEQ ID NO: 12921 - DNA, 273 bp, Artificial Sequence
  Description of Artificial Sequence: Synthetic coding sequence
atgccccaggccttcctgctgggcagcatccacgagcccgccggcgccctgatggagccccagccctgccccggcagcctggccgagagcttcctggaggaggagctgagactgaacgccgagctgagccagctgcagttcagcgagcccgtgggcatcatctacaaccccgtggagtacgcctgggagccccacagaaactacgtgaccagatactgccagggccccaaggaggtgctgttcctgggcatgaaccccggccccttcggctag

SEQ ID NO: 12922 - DNA, 534 bp, Artificial Sequence; identical to SEQ ID NO: 12915
  Description of Artificial Sequence: Synthetic coding sequence

SEQ ID NO: 12923 - DNA, 327 bp, Artificial Sequence
  Description of Artificial Sequence: Synthetic coding sequence
atgccccaggccttcctgctgggcagcatccacgagcccgccggcgccctgatggagccccagccctgccccggcagcctggccgagagcttcctggaggaggagctgagactgaacgccgagctgagccagctgcagttcagcgagcccgtgggcatcatctacaaccccgtggagtacgcctgggagccccacagaaactacgtgaccagatactgccagggccccaaggaggtgctgttcctgggcatgaaccccggccccttcggcatggcccagaccggcgtgcccttcggcgaggtgagcatggtgagagactggctgtag

SEQ ID NO: 12924 - DNA, 813 bp, Artificial Sequence; identical to SEQ ID NO: 12916
  Description of Artificial Sequence: Synthetic coding sequence

SEQ ID NO: 12925 - DNA, 534 bp, Artificial Sequence; identical to SEQ ID NO: 12915
  Description of Artificial Sequence: Synthetic coding sequence

SEQ ID NO: 12926 - DNA, 534 bp, Artificial Sequence; identical to SEQ ID NO: 12915
  Description of Artificial Sequence: Synthetic coding sequence

SEQ ID NO: 12927 - DNA, 1170 bp, Artificial Sequence
  Description of Artificial Sequence: Synthetic coding sequence
atggccgagcccgaccccagccaccccctggagacccaggccggcaaggtgcaggaggcccaggacagcgacagcgacagcgagggcggcgccgccggcggcgaggccgacatggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtaccacctgccctaccccgaggccatcttcgagatcagctacttcaagaagcaccccgagcccttcttcgccctggccaaggagctgtaccccggccagttcaagcccaccatctgccactacttcatgagactgctgaaggacaagggcctgctgctgagatgctacacccagaacatcgacaccctggagagaatcgccggcctggagcaggaggacctggtggaggcccacggcaccttctacaccagccactgcgtgagcgccagctgcagacacgagtaccccctgagctggatgaaggagaagatcttcagcgaggtgacccccaagtgcgaggactgccagagcctggtgaagcccgacatcgtgttcttcggcgagagcctgcccgccagattcttcagctgcatgcagagcgacttcctgaaggtggacctgctgctggtgatgggcaccagcctgcaggtgcagcccttcgccagcctgatcagcaaggcccccctgagcacccccagactgctgatcaacaaggagaaggccggccagagcgaccccttcctgggcatgatcatgggcctgggcggcggcatggacttcgacagcaagaaggcctacagagacgtggcctggctgggcgagtgcgaccagggctgcctggccctggccgagctgctgggctggaagaaggagctggaggacctggtgagaagagagcacgccagcatcgacgcccagagcggcgccggcgtgcccaaccccagcaccagcgccagccccaagaagagccccccccccgccaaggacgaggccagaaccaccgagagagagaagccccagtag

SEQ ID NO: 12928 - DNA, 816 bp, Artificial Sequence
  Description of Artificial Sequence: Synthetic coding sequence
atggccgagcccgaccccagccaccccctggagacccaggccggcaaggtgcaggaggcccaggacagcgacagcgacagcgagggcggcgccgccggcggcgaggccgacatggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtaccacctgccctaccccgaggccatcttcgagatcagctacttcaagaagcaccccgagcccttcttcgccctggccaaggagctgtaccccggccagttcaagcccaccatctgccactacttcatgagactgctgaaggacaagggcctgctgctgagatgctacacccagaacatcgacaccctggagagaatcgccggcctggagcaggaggacctggtggaggcccacggcaccttctacaccagccactgcgtgagcgccagctgcagacacgagtaccccctgagctggatgaaggagaagatcttcagcgaggtgacccccaagtgcgaggactgccagagcctggtgaagcccgacatcgtgttcttcggcgagagcctgcccgccagattcttcagctgcatgcagagcgacttcctgaaggtggacctgctgctggtgatgggcaccagcctgcagggcagaggcctggccggctag

SEQ ID NO: 12929 - DNA, 393 bp, Artificial Sequence
  Description of Artificial Sequence: Synthetic coding sequence
atggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtaccacctgccctaccccgaggccatcttcgagatcagctacttcaagaagcaccccgagcccttcttcgccctggccaaggagctgtaccccggccagttcaagcccaccatctgccactacttcatgagactgctgaaggacaagggcctgctgctgagatgctacacccagtag

SEQ ID NO: 12930 - DNA, 1059 bp, Artificial Sequence
  Description of Artificial Sequence: Synthetic coding sequence
atggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtaccacctgccctaccccgaggccatcttcgagatcagctacttcaagaagcaccccgagcccttcttcgccctggccaaggagctgtaccccggccagttcaagcccaccatctgccactacttcatgagactgctgaaggacaagggcctgctgctgagatgctacacccagaacatcgacaccctggagagaatcgccggcctggagcaggaggacctggtggaggcccacggcaccttctacaccagccactgcgtgagcgccagctgcagacacgagtaccccctgagctggatgaaggagaagatcttcagcgaggtgacccccaagtgcgaggactgccagagcctggtgaagcccgacatcgtgttcttcggcgagagcctgcccgccagattcttcagctgcatgcagagcgacttcctgaaggtggacctgctgctggtgatgggcaccagcctgcaggtgcagcccttcgccagcctgatcagcaaggcccccctgagcacccccagactgctgatcaacaaggagaaggccggccagagcgaccccttcctgggcatgatcatgggcctgggcggcggcatggacttcgacagcaagaaggcctacagagacgtggcctggctgggcgagtgcgaccagggctgcctggccctggccgagctgctgggctggaagaaggagctggaggacctggtgagaagagagcacgccagcatcgacgcccagagcggcgccggcgtgcccaaccccagcaccagcgccagccccaagaagagccccccccccgccaaggacgaggccagaaccaccgagagagagaagccccagtag

SEQ ID NO: 12931 - DNA, 510 bp, Artificial Sequence
  Description of Artificial Sequence: Synthetic coding sequence
atggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtaccacctgccctaccccgaggccatcttcgagatcagctacttcaagaagcaccccgagcccttcttcgccctggccaaggagctgtaccccggccagttcaagcccaccatctgccactacttcatgagactgctgaaggacaagggcctgctgctgagatgctacacccagaacatcgacaccctggagagaatcgccggcctggagcaggaggacctggtggaggcccacggcaccttctacaccagccactgcgtgagcgccagctgcagacacgagtaccccctgtag

SEQ ID NO: 12932 - DNA, 714 bp, Artificial Sequence
  Description of Artificial Sequence: Synthetic coding sequence
atggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtaccacctgccctaccccgaggccatcttcgagatcagctacttcaagaagcaccccgagcccttcttcgccctggccaaggagctgtaccccggccagttcaagcccaccatctgccactacttcatgagactgctgaaggacaagggcctgctgctgagatgctacacccagaacatcgacaccctggagagaatcgccggcctggagcaggaggacctggtggaggcccacggcaccttctacaccagccactgcgtgagcgccagctgcagacacgagtaccccctgagctggatgaaggagaagatcttcagcgaggtgacccccaagtgcgaggactgccagagcctggtgaagcccgacatcgtgttcttcggcgagagcctgcccgccagattcttcagctgcatgcagagcgacttcctgaaggtggacctgctgctggtgatgggcaccagcctgcaggtgcagcccttcgccagcctgatcagctag

SEQ ID NO: 12933 - DNA, 237 bp, Artificial Sequence
  Description of Artificial Sequence: Synthetic coding sequence
atggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtaccacctgccctacccctag

SEQ ID NO: 12934 - DNA, 222 bp, Artificial Sequence
  Description of Artificial Sequence: Synthetic coding sequence
atggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtactag

SEQ ID NO: 12935 - DNA, 1170 bp, Artificial Sequence
  Description of Artificial Sequence: Synthetic coding sequence
atgagcgacgaggccgaggacagcgacagcgacagcgagggcggcgccgccggcggcgaggccgacatggacttcctgagaaacctgttcagccagaccctgagcctgggcagccagaaggagagactgctggacgagctgaccctggagggcgtggccagatacatgcagagcgagagatgcagaagagtgatctgcctggtgggcgccggcatcagcaccagcgccggcatccccgacttcagaagccccagcaccggcctgtacgacaacctggagaagtaccacctgccctaccccgaggccatcttcgagatcagctacttcaagaagcaccccgagcccttcttcgccctggccaaggagctgtaccccggccagttcaagcccaccatctgccactacttcatgagactgctgaaggacaagggcctgctgctgagatgctacacccagaacatcgacaccctggagagaatcgccggcctggagcaggaggacctggtggaggcccacggcaccttctacaccagccactgcgtgagcgccagctgcagacacgagtaccccctgagctggatgaaggagaagatcttcagcgaggtgacccccaagtgcgaggactgccagagcctggtgaagcccgacatcgtgttcttcggcgagagcctgcccgccagattcttcagctgcatgcagagcgacttcctgaaggtggacctgctgctggtgatgggcaccagcctgcaggtgcagcccttcgccagcctgatcagcaaggcccccctgagcacccccagactgctgatcaacaaggagaaggccggccagagcgaccccttcctgggcatgatcatgggcctgggcggcggcatggacttcgacagcaagaaggcctacagagacgtggcctggctgggcgagtgcgaccagggctgcctggccctggccgagctgctgggctggaagaaggagctggaggacctggtgagaagagagcacgccagcatcgacgcccagggcggcggcggcccccagccccagcacttcagcttcccccaggaggtgcccgccacctgccagggcagaggccaggacaacagagagggcgagacccccgtgaccgccgccagccccagaagagacgccgagctgctgagagacagctag

SEQ ID NO: 12936 - DNA, 1227 bp, Artificial Sequence
  Description of Artificial Sequence: Synthetic coding sequence
atggccgagaacggcgacaacgagaagatggccgccctggaggccaagatctgccaccagatcgagtactacttcggcgacttcaacctgcccagagacaagttcctgaaggagcagatcaagctggacgagggctgggtgcccctggagatcatgatcaagttcaacagactgaacagactgaccaccgacttcaacgtgatcgtggaggccctgagcaagagcaaggccgagctgatggagatcagcgaggacaagaccaagatcagaagaagccccagcaagcccctgcccgaggtgaccgacgagtacaagaacgacgtgaagaacagaagcgtgtacatcaagggcttccccaccgacgccaccctggacgacatcaaggagtggctggaggacaagggccaggtgctgaacatccagatgagaagaaccctgcacaaggccttcaagggcagcatcttcgtggtgttcgacagcatcgagagcgccaagaagttcgtggagacccccggccagaagtacaaggagaccgacctgctgatcctgttcaaggacgactacttcgccaagaagaacgaggagagaaagcagaacaaggtggaggccaagctgagagccaagcaggagcaggaggccaagcagaagctggaggaggacgccgagatgaagagcctggaggagaagatcggctgcctgctgaagttcagcggcgacctggacgaccagacctgcagagaggacctgcacatcctgttcagcaaccacggcgagatcaagtggatcgacttcgtgagaggcgccaaggagggcatcatcctgttcaaggagaaggccaaggaggccctgggcaaggccaaggacgccaacaacggcaacctgcagctgagaaacaaggaggtgacctgggaggtgctggagggcgaggtggagaaggaggccctgaagaagatcatcgaggaccagcaggagagcctgaacaagtggaagagcaagggcagaagattcaagggcaagggcaagggcaacaaggccgcccagcccggcagcggcaagggcaaggtgcagttccagggcaagaagaccaagttcgccagcgacgacgagcacgacgagcacgacgagaacggcgccaccggccccgtgaagagagccagagaggagaccgacaaggaggagcccgccagcaagcagcagaagaccgagaacggcgccggcgaccagtag

SEQ ID NO: 12937 - DNA, 1086 bp, Artificial Sequence
  Description of Artificial Sequence: Synthetic coding sequence
atggccgagaacggcgacaacgagaagatggccgccctggaggccaagatctgccaccagatcgagtactacttcggcgacttcaacctgcccagagacaagttcctgaaggagcagatcaagctggacgagggctgggtgcccctggagatcatgatcaagttcaacagactgaacagactgaccaccgacttcaacgtgatcgtggaggccctgagcaagagcaaggccgagctgatggagatcagcgaggacaagaccaagatcagaagaagccccagcaagcccctgcccgaggtgaccgacgagtacaagaacgacgtgaagaacagaagcgtgtacatcaagggcttccccaccgacgccaccctggacgacatcaaggagtggctggaggacaagggccaggtgctgaacatccagatgagaagaaccctgcacaaggccttcaagggcagcatcttcgtggtgttcgacagcatcgagagcgccaagaagttcgtggagacccccggccagaagtacaaggagaccgacctgctgatcctgttcaaggacgactacttcgccaagaagaacgaggagagaaagcagaacaaggtggaggccaagctgagagccaagcaggagcaggaggccaagcagaagctggaggaggacgccgagatgaagagcctggaggagaagatcggctgcctgctgaagttcagcggcgacctggacgaccagacctgcagagaggacctgcacatcctgttcagcaaccacggcgagatcaagtggatcgacttcgtgagaggcgccaaggagggcatcatcctgttcaaggagaaggccaaggaggccctgggcaaggccaaggacgccaacaacggcaacctgcagctgagaaacaaggaggtgacctgggaggtgctggagggcgaggtggagaaggaggccctgaagaagatcatcgaggaccagcaggagagcctgaacaagtggaagagcaagggccccgtgaagagagccagagaggagaccgacaaggaggagcccgccagcaagcagcagaagaccgagaacggcgccggcgaccagtag

SEQ ID NO: 12938 - DNA, 1227 bp, Artificial Sequence; identical to SEQ ID NO: 12936
  Description of Artificial Sequence: Synthetic coding sequence

SEQ ID NO: 12939 - DNA, 405 bp, Artificial Sequence
  Description of Artificial Sequence: Synthetic coding sequence
atggccgagaacggcgacaacgagaagatggccgccctggaggccaagatctgccaccagatcgagtactacttcggcgacttcaacctgcccagagacaagttcctgaaggagcagatcaagctggacgagggctgggtgcccctggagatcatgatcaagttcaacagactgaacagactgaccaccgacttcaacgtgatcgtggaggccctgagcaagagcaaggccgagctgatggagatcagcgaggacaagaccaagatcagaagaagccccagcaagcccctgcccgaggtgaccgacgagtacaagaacgacgtgaagaacagaagcgtgtacatcagccaccccgtggcccacgtgggcgtgcagtggtgcgaccacggccccctgcagagctag

SEQ ID NO: 12940 - DNA, 363 bp, Artificial Sequence
  Description of Artificial Sequence: Synthetic coding sequence
atgatcaagttcaacagactgaacagactgaccaccgacttcaacgtgatcgtggaggccctgagcaagagcaaggccgagctgatggagatcagcgaggacaagaccaagatcagaagaagccccagcaagcccctgcccgaggtgaccgacgagtacaagaacgacgtgaagaacagaagcgtgtacatcaagggcttccccaccgacgccaccctggacgacatcaaggagtggctggaggacaagggccaggtgctgaacatccagatgagaagaaccctgcacaaggccttcaagggcagcatcttcgtggtgttcgacagcatcgagagcgccaagaagttcgtggagaccccctag

SEQ ID NO: 12941 - DNA, 555 bp, Artificial Sequence
  Description of Artificial Sequence: Synthetic coding sequence
atggccgagaacggcgacaacgagaagatggccgccctggaggccaagatctgccaccagatcgagtactacttcggcgacttcaacctgcccagagacaagttcctgaaggagcagatcaagctggacgagggctgggtgcccctggagatcatgatcaagttcaacagactgaacagactgaccaccgacttcaacgtgatcgtggaggccctgagcaagagcaaggccgagctgatggagatcagcgaggacaagaccaagatcagaagaagccccagcaagcccctgcccgaggtgaccgacgagtacaagaacgacgtgaagaacagaagcgtgtacatcaagggcttccccaccgacgccaccctggacgacatcaaggagtggctggaggacaagggccaggtgctgaacatccagatgagaagaaccctgcacaaggccttcaagggcagcatcttcgtggtgttcgacagcatcgagagcgccaagaagttcgtggagacccccggccagaagtacaaggagaccgacctgctgatcctgttctag

SEQ ID NO: 12942 - DNA, 252 bp, Artificial Sequence
  Description of Artificial Sequence: Synthetic coding sequence
atgagaagaaccctgcacaaggccttcaagggcagcatcttcgtggtgttcgacagcatcgagagcgccaagaagttcgtggagacccccggccagaagtacaaggagaccgacctgctgatcctgttcaaggacgactacttcgccaagaagaacgaggagagaaagcagaacaaggtggaggccaagctgagagccaagcaggagcaggaggccaagcagaagctggaggaggacgccgagatgaagtag

SEQ ID NO: 12943 - DNA, 5505 bp, Artificial Sequence
  Description of Artificial Sequence: Synthetic coding sequence
atgaagctgagcgtgaacgaggcccagctgggcttctacctgggcagcctgagccacctgagcgcctgccccggcatcgaccccagaagcagcgaggaccagcccgagagcctgaagaccggccagatgatggacgagagcgacgaggacttcaaggagctgtgcgccagcttcttccagagagtgaagaagcacggcatcaaggaggtgagcggcgagagaaagacccagaaggccgccagcaacggcacccagatcagaagcaagctgaagagaaccaagcagaccgccaccaagaccaagaccctgcagggccccgccgagaagaagccccccagcggcagccaggcccccagaaccaagaagcagagagtgaccaagtggcaggccagcgagcccgcccacagcgtgaacggcgagggcggcgtgctggccagcgcccccgacccccccgtgctgagagagaccgcccagaacacccagaccggcaaccagcaggagcccagccccaacctgagcagagagaagaccagagagaacgtgcccaacagcgacagccagcccccccccagctgcctgaccaccgccgtgcccagccccagcaagcccagaaccgcccagctggtgctgcagagaatgcagcagttcaagagagccgaccccgagagactgagacacgccagcgaggagtgcagcctggaggccgccagagaggagaacgtgcccaaggacccccaggaggagatgatggccggcaacgtgtacggcctgggcccccccgcccccgagagcgacgccgccgtggccctgaccctgcagcaggagttcgccagagtgggcgccagcgcccacgacgacagcctggaggagaagggcctgttcttctgccagatctgccagaagaacctgagcgccatgaacgtgaccagaagagagcagcacgtgaacagatgcctggacgaggccgagaagaccctgagacccagcgtgccccagatccccgagtgccccatctgcggcaagcccttcctgaccctgaagagcagaaccagccacctgaagcagtgcgccgtgaagatggaggtgggcccccagctgctgctgcaggccgtgagactgcagaccgcccagcccgagggcagcagcagcccccccatgttcagcttcagcgaccacagcagaggcctgaagagaagaggccccaccagcaagaaggagcccagaaagagaagaaaggtggacgaggcccccagcgaggacctgctggtggccatggccctgagcagaagcgagatggagcccggcgccgccgtgcccgccctgagactggagagcgccttcagcgagagaatcagacccgaggccgagaacaagagcagaaagaagaagccccccgtgagcccccccctgctgctggtgcaggacagcgagaccaccggcagacagatcgaggacagagtggccctgctgctgagcgaggaggtggagctgagcagcaccccccccctgcccgccagcagaatcctgaaggagggctgggagagagccggccagtgcccccccccccccgagagaaagcagagcttcctgtgggagggcagcgccctgaccggcgcctgggccatggaggacttctacaccgccagactggtgccccccctggtgccccagagacccgcccagggcctgatgcaggagcccgtgccccccctggtgccccccgagcacagcgagctgagcgagagaagaagccccgccctgcacggcacccccaccgccggctgcggcagcagaggccccagccccagcgccagccagagagagcaccaggccctgcaggacctggtggacctggccagagagggcctgagcgccagcccctggcccggcagcggcggcctggccggcagcgagggcaccgccggcctggacgtggtgcccggcggcctgcccctgaccggcttcgtggtgcccagccaggacaagcaccccgacagaggcggcagaaccctgctgagcctgggcctgctggtggccgacttcggcgccatggtgaacaacccccacctgagcgacgtgcagttccagaccgacagcggcgaggtgctgtacgcccacaagttcgtgctgtacgccagatgccccctgctgatccagtacgtgaacaacgagggcttcagcgccgtggaggacggcgtgctgacccagagagtgctgctgggcgacgtgagcaccgaggccgccagaaccttcctgcactacctgtacaccgccgacaccggcctgccccccggcctgagcagcgagctgagcagcctggcccacagattcggcgtgagcgagctggtgcacctgtgcgagcaggtgcccatcgccaccgacagcgagggcaagccctgggaggagaaggaggccgagaactgcgagagcagagccgagaacttccaggagctgctgagaagcatgtgggccgacgaggaggaggaggccgagaccctgctgaagagcaaggaccacgaggaggaccaggagaacgtgaacgaggccgagatggaggagatctacgagttcgccgccacccagagaaagctgctgcaggaggagagagccgccggcgccggcgaggacgccgactggctggagggcggcagccccgtgagcggccagctgctggccggcgtgcaggtgcagaagcagtgggacaaggtggaggagatggagcccctggagcccggcagagacgaggccgccaccacctgggagaagatgggccagtgcgccctgccccccccccagggccagcacagcggcgccagaggcgccgaggcccccgagcaggaggcccccgaggaggccctgggccacagcagctgcagcagccccagcagagactgccaggccgagagaaaggagggcagcctgccccacagcgacgacgccggcgactacgagcagctgttcagcagcacccagggcgagatcagcgagcccagccagatcaccagcgagcccgaggagcagagcggcgccgtgagagagagaggcctggaggtgagccacagactggccccctggcaggccagccccccccacccctgcagattcctgctgggccccccccagggcggcagccccagaggcagccaccacaccagcggcagcagcctgagcacccccagaagcagaggcggcaccagccaggtgggcagccccaccctgctgagccccgccgtgcccagcaagcagaagagagacagaagcatcctgaccctgagcaaggagcccggccaccagaagggcaaggagagaagaagcgtgctggagtgcagaaacaagggcgtgctgatgttccccgagaagagccccagcatcgacctgacccagagcaaccccgaccacagcagcagcagaagccagaagagcagcagcaagctgaacgaggaggacgaggtgatcctgctgctggacagcgacgaggagctggagctggagcagaccaagatgaagagcatcagcagcgaccccctggaggagaagaaggccctggagatcagccccagaagctgcgagctgttcagcatcatcgacgtggacgccgaccaggagcccagccagagcccccccagaagcgaggccgtgctgcagcaggaggacgagggcgccctgcccgagaacagaggcagcctgggcagaagaggcgccccctggctgttctgcgacagagagagcagccccagcgaggccagcaccaccgacaccagctggctggtgcccgccacccccctggccagcagaagcagagactgcagcagccagacccagatcagcagcctgagaagcggcctggccgtgcaggccgtgacccagcacacccccagagccagcgtgggcaacagagagggcaacgaggtggcccagaagttcagcgtgatcagaccccagaccccccccccccagacccccagcagctgcctgacccccgtgagccccggcaccagcgacggcagaagacagggccacagaagccccagcagaccccaccccggcggccacccccacagcagccccctggccccccaccccatcagcggcgacagagcccacttcagcagaagattcctgaagcacagcccccccggccccagcttcctgaaccagacccccgccggcgaggtggtggaggtgggcgacagcgacgacgagcaggaggtggccagccaccaggccaacagaagcccccccctggacagcgacccccccatccccatcgacgactgctgctggcacatggagcccctgagccccatccccatcgaccactggaacctggagagaaccggccccctgagcaccagcagccccagcagaagaatgaacgaggccgccgacagcagagactgcagaagccccggcctgctggacaccacccccatcagaggcagctgcaccacccagagaaagctgcaggagaagagcagcggcgccggcagcctgggcaacagcagacccagcttcctgaacagcgccctgtgggacgtgtgggacggcgaggagcagagaccccccgagacccccccccccgcccagatgcccagcgccggcggcgcccagaagcccgagggcctggagacccccaagggcgccaacagaaagaagaacctgccccccaaggtgcccatcacccccatgccccagtacagcatcatggagacccccgtgctgaagaaggagctggacagattcggcgtgagacccctgcccaagagacagatggtgctgaagctgaaggagatcttccagtacacccaccagaccctggacagcgacagcgaggacgagagccagagcagccagcccctgctgcaggccccccactgccagaccctggccagccagacctacaagcccagcagagccggcgtgcacgcccagcaggaggccaccaccggccccggcgcccacagacccaagggccccgccaagaccaagggccccagacaccagagaaagcaccacgagagcatcaccccccccagcagaagccccaccaaggaggccccccccggcctgaacgacgacgcccagatccccgccagccaggagagcgtggccaccagcgtggacggcagcgacagcagcctgagcagccagagcagcagcagctgcgagttcggcgccgccttcgagagcgccggcgaggaggagggcgagggcgaggtgagcgccagccaggccgccgtgcaggccgccgacaccgacgaggccctgagatgctacatcagaagcaagcccgccctgtaccagaaggtgctgctgtaccagcccttcgagctgagagagctgcaggccgagctgagacagaacggcctgagagtgagcagcagaagactgctggacttcctggacacccactgcatcaccttcaccaccgccgccaccagaagagagaagctgcagggcagaagaagacagcccagaggcaagaagaaggtggagagaaactag

SEQ ID NO: 12944 - DNA, 1404 bp, Artificial Sequence
  Description of Artificial Sequence: Synthetic coding sequence
atgagcagcatcctgcccttcaccccccccgtggtgaagagactgctgggctggaagaagagcgccggcggcagcggcggcgccggcggcggcgagcagaacggccaggaggagaagtggtgcgagaaggccgtgaagagcctggtgaagaagctgaagaagaccggcagactggacgagctggagaaggccatcaccacccagaactgcaacaccaagtgcgtgaccatccccagcacctgcagcgagatctggggcctgagcacccccaacaccatcgaccagtgggacaccaccggcctgtacagcttcagcgagcagaccagaagcctggacggcagactgcaggtgagccacagaaagggcctgccccacgtgatctactgcagactgtggagatggcccgacctgcacagccaccacgagctgaaggccatcgagaactgcgagtacgccttcaacctgaagaaggacgaggtgtgcgtgaacccctaccactaccagagagtggagacccccgtgctgccccccgtgctggtgcccagacacaccgagatcctgaccgagctgccccccctggacgactacacccacagcatccccgagaacaccaacttccccgccggcatcgagccccagagcaactacatccccgagacccccccccccggctacatcagcgaggacggcgagaccagcgaccagcagctgaaccagagcatggacaccggcagccccgccgagctgagccccaccaccctgagccccgtgaaccacagcctggacctgcagcccgtgacctacagcgagcccgccttctggtgcagcatcgcctactacgagctgaaccagagagtgggcgagaccttccacgccagccagcccagcctgaccgtggacggcttcaccgaccccagcaacagcgagagattctgcctgggcctgctgagcaacgtgaacagaaacgccaccgtggagatgaccagaagacacatcggcagaggcgtgagactgtactacatcggcggcgaggtgttcgccgagtgcctgagcgacagcgccatcttcgtgcagagccccaactgcaaccagagatacggctggcaccccgccaccgtgtgcaagatcccccccggctgcaacctgaagatcttcaacaaccaggagttcgccgccctgctggcccagagcgtgaaccagggcttcgaggccgtgtaccagctgaccagaatgtgcaccatcagaatgagcttcgtgaagggctggggcgccgagtacagaagacagaccgtgaccagcaccccctgctggatcgagctgcacctgaacggccccctgcagtggctggacaaggtgctgacccagatgggcagccccagcgtgagatgcagcagcatgagctag

SEQ ID NO: 12945 - DNA, 1314 bp, Artificial Sequence
  Description of Artificial Sequence: Synthetic coding sequence
atgagcagcatcctgcccttcaccccccccgtggtgaagagactgctgggctggaagaagagcgccggcggcagcggcggcgccggcggcggcgagcagaacggccaggaggagaagtggtgcgagaaggccgtgaagagcctggtgaagaagctgaagaagaccggcagactggacgagctggagaaggccatcaccacccagaactgcaacaccaagtgcgtgaccatccccagaagcctggacggcagactgcaggtgagccacagaaagggcctgccccacgtgatctactgcagactgtggagatggcccgacctgcacagccaccacgagctgaaggccatcgagaactgcgagtacgccttcaacctgaagaaggacgaggtgtgcgtgaacccctaccactaccagagagtggagacccccgtgctgccccccgtgctggtgcccagacacaccgagatcctgaccgagctgccccccctggacgactacacccacagcatccccgagaacaccaacttccccgccggcatcgagccccagagcaactacatccccgagacccccccccccggctacatcagcgaggacggcgagaccagcgaccagcagctgaaccagagcatggacaccggcagccccgccgagctgagccccaccaccctgagccccgtgaaccacagcctggacctgcagcccgtgacctacagcgagcccgccttctggtgcagcatcgcctactacgagctgaaccagagagtgggcgagaccttccacgccagccagcccagcctgaccgtggacggcttcaccgaccccagcaacagcgagagattctgcctgggcctgctgagcaacgtgaacagaaacgccaccgtggagatgaccagaagacacatcggcagaggcgtgagactgtactacatcggcggcgaggtgttcgccgagtgcctgagcgacagcgccatcttcgtgcagagccccaactgcaaccagagatacggctggcaccccgccaccgtgtgcaagatcccccccggctgcaacctgaagatcttcaacaaccaggagttcgccgccctgctggcccagagcgtgaaccagggcttcgaggccgtgtaccagctgaccagaatgtgcaccatcagaatgagcttcgtgaagggctggggcgccgagtacagaagacagaccgtgaccagcaccccctgctggatcgagctgcacctgaacggccccctgcagtggctggacaaggtgctgacccagatgggcagccccagcgtgagatgcagcagcatgagctag

SEQ ID NO: 12946 - DNA, 1404 bp, Artificial Sequence; identical to SEQ ID NO: 12944
  Description of Artificial Sequence: Synthetic coding sequence

SEQ ID NO: 12947 - DNA, 1278 bp, Artificial Sequence
  Description of Artificial Sequence: Synthetic coding sequence
atgagcagcatcctgcccttcaccccccccatcgtgaagagactgctgggctggaagaagggcgagcagaacggccaggaggagaagtggtgcgagaaggccgtgaagagcctggtgaagaagctgaagaagaccggccagctggacgagctggagaaggccatcaccacccagaacgtgaacaccaagtgcatcaccatccccagaagcctggacggcagactgcaggtgagccacagaaagggcctgccccacgtgatctactgcagactgtggagatggcccgacctgcacagccaccacgagctgagagccatggagctgtgcgagttcgccttcaacatgaagaaggacgaggtgtgcgtgaacccctaccactaccagagagtggagacccccgtgctgccccccgtgctggtgcccagacacaccgagatccccgccgagttcccccccctggacgactacagccacagcatccccgagaacaccaacttccccgccggcatcgagccccagagcaacatccccgagacccccccccccggctacctgagcgaggacggcgagaccagcgaccaccagatgaaccacagcatggacgccggcagccccaacctgagccccaaccccatgagccccgcccacaacaacctggacctgcagcccgtgacctactgcgagcccgccttctggtgcagcatcagctactacgagctgaaccagagagtgggcgagaccttccacgccagccagcccagcatgaccgtggacggcttcaccgaccccagcaacagcgagagattctgcctgggcctgctgagcaacgtgaacagaaacgccgccgtggagctgaccagaagacacatcggcagaggcgtgagactgtactacatcggcggcgaggtgttcgccgagtgcctgagcgacagcgccatcttcgtgcagagccccaactgcaaccagagatacggctggcaccccgccaccgtgtgcaagatcccccccggctgcaacctgaagatcttcaacaaccaggagttcgccgccctgctggcccagagcgtgaaccagggcttcgaggccgtgtaccagctgaccagaatgtgcaccatcagaatgagcttcgtgaagggctggggcgccgagtacagaagacagaccgtgaccagcaccccctgctggatcgagctgcacctgaacggccccctgcagtggctggacaaggtgctgacccagatgggcagccccagcatcagatgcagcagcgtgagctag

SEQ ID NO: 12948 - DNA, 1146 bp, Artificial Sequence
  Description of Artificial Sequence: Synthetic coding sequence
atgagctgcctgcaccccagacagacctggaagggcgccgccctggtgcacagaaaggcctggtggatgggcagaagcctggacggcagactgcaggtgagccacagaaagggcctgccccacgtgatctactgcagactgtggagatggcccgacctgcacagccaccacgagctgagagccatggagctgtgcgagttcgccttcaacatgaagaaggacgaggtgtgcgtgaacccctaccactaccagagagtggagacccccgtgctgccccccgtgctggtgcccagacacaccgagatccccgccgagttcccccccctggacgactacagccacagcatccccgagaacaccaacttccccgccggcatcgagccccagagcaacatccccgagacccccccccccggctacctgagcgaggacggcgagaccagcgaccaccagatgaaccacagcatggacgccggcagccccaacctgagccccaaccccatgagccccgcccacaacaacctggacctgcagcccgtgacctactgcgagcccgccttctggtgcagcatcagctactacgagctgaaccagagagtgggcgagaccttccacgccagccagcccagcatgaccgtggacggcttcaccgaccccagcaacagcgagagattctgcctgggcctgctgagcaacgtgaacagaaacgccgccgtggagctgaccagaagacacatcggcagaggcgtgagactgtactacatcggcggcgaggtgttcgccgagtgcctgagcgacagcgccatcttcgtgcagagccccaactgcaaccagagatacggctggcaccccgccaccgtgtgcaagatcccccccggctgcaacctgaagatcttcaacaaccaggagttcgccgccctgctggcccagagcgtgaaccagggcttcgaggccgtgtaccagctgaccagaatgtgcaccatcagaatgagcttcgtgaagggctggggcgccgagtacagaagacagaccgtgaccagcaccccctgctggatcgagctgcacctgaacggccccctgcagtggctggacaaggtgctgacccagatgggcagccccagcatcagatgcagcagcgtgagctag

SEQ ID NO: 12949 - DNA, 1278 bp, Artificial Sequence; identical to SEQ ID NO: 12947
  Description of Artificial Sequence: Synthetic coding sequence

SEQ ID NO: 12950 - DNA, 693 bp, Artificial Sequence
  Description of Artificial Sequence: Synthetic coding sequence
atgaaccacagcatggacgccggcagccccaacctgagccccaaccccatgagccccgcccacaacaacctggacctgcagcccgtgacctactgcgagcccgccttctggtgcagcatcagctactacgagctgaaccagagagtgggcgagaccttccacgccagccagcccagcatgaccgtggacggcttcaccgaccccagcaacagcgagagattctgcctgggcctgctgagcaacgtgaacagaaacgccgccgtggagctgaccagaagacacatcggcagaggcgtgagactgtactacatcggcggcgaggtgttcgccgagtgcctgagcgacagcgccatcttcgtgcagagccccaactgcaaccagagatacggctggcaccccgccaccgtgtgcaagatcccccccggctgcaacctgaagatcttcaacaaccaggagttcgccgccctgctggcccagagcgtgaaccagggcttcgaggccgtgtaccagctgaccagaatgtgcaccatcagaatgagcttcgtgaagggctggggcgccgagtacagaagacagaccgtgaccagcaccccctgctggatcgagctgcacctgaacggccccctgcagtggctggacaaggtgctgacccagatgggcagccccagcatcagatgcagcagcgtgagctag

SEQ ID NO: 12951 - DNA, 963 bp, Artificial Sequence
  Description of Artificial Sequence: Synthetic coding sequence
atggagctgtgcgagttcgccttcaacatgaagaaggacgaggtgtgcgtgaacccctaccactaccagagagtggagacccccgtgctgccccccgtgctggtgcccagacacaccgagatccccgccgagttcccccccctggacgactacagccacagcatccccgagaacaccaacttccccgccggcatcgagccccagagcaacatccccgagacccccccccccggctacctgagcgaggacggcgagaccagcgaccaccagatgaaccacagcatggacgccggcagccccaacctgagccccaaccccatgagccccgcccacaacaacctggacctgcagcccgtgacctactgcgagcccgccttctggtgcagcatcagctactacgagctgaaccagagagtgggcgagaccttccacgccagccagcccagcatgaccgtggacggcttcaccgaccccagcaacagcgagagattctgcctgggcctgctgagcaacgtgaacagaaacgccgccgtggagctgaccagaagacacatcggcagaggcgtgagactgtactacatcggcggcgaggtgttcgccgagtgcctgagcgacagcgccatcttcgtgcagagccccaactgcaaccagagatacggctggcaccccgccaccgtgtgcaagatcccccccggctgcaacctgaagatcttcaacaaccaggagttcgccgccctgctggcccagagcgtgaaccagggcttcgaggccgtgtaccagctgaccagaatgtgcaccatcagaatgagcttcgtgaagggctggggcgccgagtacagaagacagaccgtgaccagcaccccctgctggatcgagctgcacctgaacggccccctgcagtggctggacaaggtgctgacccagatgggcagccccagcatcagatgcagcagcgtgagctag

SEQ ID NO: 12952 - DNA, 1281 bp, Artificial Sequence
  Description of Artificial Sequence: Synthetic coding sequence
atgttcagaaccaagagaagcgccctggtgagaagactgtggagaagcagagcccccggcggcgaggacgaggaggagggcgccggcggcggcggcggcggcggcgagctgagaggcgagggcgccaccgacagcagagcccacggcgccggcggcggcggccccggcagagccggctgctgcctgggcaaggccgtgagaggcgccaagggccaccaccacccccacccccccgccgccggcgccggcgccgccggcggcgccgaggccgacctgaaggccctgacccacagcgtgctgaagaagctgaaggagagacagctggagctgctgctgcaggccgtggagagcagaggcggcaccagaaccgcctgcctgctgctgcccggcagactggactgcagactgggccccggcgcccccgccggcgcccagcccgcccagccccccagcagctacagcctgcccctgctgctgtgcaaggtgttcagatggcccgacctgagacacagcagcgaggtgaagagactgtgctgctgcgagagctacggcaagatcaaccccgagctggtgtgctgcaacccccaccacctgagcagactgtgcgagctggagagccccccccccccctacagcagataccccatggacttcctgaagcccaccgccgactgccccgacgccgtgcccagcagcgccgagaccggcggcaccaactacctggcccccggcggcctgagcgacagccagctgctgctggagcccggcgacagaagccactggtgcgtggtggcctactgggaggagaagaccagagtgggcagactgtactgcgtgcaggagcccagcctggacatcttctacgacctgccccagggcaacggcttctgcctgggccagctgaacagcgacaacaagagccagctggtgcagaaggtgagaagcaagatcggctgcggcatccagctgaccagagaggtggacggcgtgtgggtgtacaacagaagcagctaccccatcttcatcaagagcgccaccctggacaaccccgacagcagaaccctgctggtgcacaaggtgttccccggcttcagcatcaaggccttcgactacgagaaggcctacagcctgcagagacccaacgaccacgagttcatgcagcagccctggaccggcttcaccgtgcagatcagcttcgtgaagggctggggccagtgctacaccagacagttcatcagcagctgcccctgctggctggaggtgatcttcaacagcagatag

SEQ ID NO: 12953 - DNA, 636 bp, Artificial Sequence
  Description of Artificial Sequence: Synthetic coding sequence
atggacttcctgaagcccaccgccgactgccccgacgccgtgcccagcagcgccgagaccggcggcaccaactacctggcccccggcggcctgagcgacagccagctgctgctggagcccggcgacagaagccactggtgcgtggtggcctactgggaggagaagaccagagtgggcagactgtactgcgtgcaggagcccagcctggacatcttctacgacctgccccagggcaacggcttctgcctgggccagctgaacagcgacaacaagagccagctggtgcagaaggtgagaagcaagatcggctgcggcatccagctgaccagagaggtggacggcgtgtgggtgtacaacagaagcagctaccccatcttcatcaagagcgccaccctggacaaccccgacagcagaaccctgctggtgcacaaggtgttccccggcttcagcatcaaggccttcgactacgagaaggcctacagcctgcagagacccaacgaccacgagttcatgcagcagccctggaccggcttcaccgtgcagatcagcttcgtgaagggctggggccagtgctacaccagacagttcatcagcagctgcccctgctggctggaggtgatcttcaacagcagatag

SEQ ID NO: 12954 - DNA, 636 bp, Artificial Sequence; identical to SEQ ID NO: 12953
  Description of Artificial Sequence: Synthetic coding sequence

SEQ ID NO: 12955 - DNA, 270 bp, Artificial Sequence
  Description of Artificial Sequence: Synthetic coding sequence
atgaacagccagcagcagaagcagccctgcaccccccccccccagccccagcagcagcaggtgaagcagccctgccagccccccccccaggagccctgcatccccaagaccaaggagccctgccaccccaaggtgcccgagccctgccaccccaaggtgcccgagccctgccagcccaaggtgcccgagccctgccagcccaaggtgcccgagccctgccccagcaccgtgacccccgcccccgcccagcagaagaccaagcagaagtag

SEQ ID NO: 12956 - DNA, 270 bp, Artificial Sequence; identical to SEQ ID NO: 12955
  Description of Artificial Sequence: Synthetic coding sequence

SEQ ID NO: 12957 - DNA, 4260 bp, Artificial Sequence
  Description of Artificial Sequence: Synthetic coding sequence
atggccgagggcctggagagagtgagaatcagcgccagcgagctgagaggcatcctggccaccctggccccccaggccggcagcagagagaacatgaaggagctgaaggaggccagacccagaaaggacaacagaagacccgacctggagatctacaagcccggcctgagcagactgagaaacaagcccaagatcaaggagccccccggcagcgaggagttcaaggacgagatcgtgaacgacagagactgcagcgccgtggagaacggcacccagcccgtgaaggacgtgtgcaaggagctgaacaaccaggagcagaacggccccatcgaccccgagaacaacagaggccaggagagcttccccagaaccgccggccaggaggacagaagcctgaagatcatcaagagaaccaagaagcccgacctgcagatctaccagcccggcagaagactgcagaccgtgagcaaggagagcgccagcagagtggaggaggaggaggtgctgaaccaggtggagcagctgagagtggaggaggacgagtgcagaggcaacgtggccaaggaggaggtggccaacaagcccgacagagccgagatcgagaagagccccggcggcggcagagtgggcgccgccaagggcgagaagggcaagagaatgggcaagggcgagggcgtgagagagacccacgacgaccccgccagaggcagacccggcagcgccaagagatacagcagaagcgacaagagaagaaacagatacagaaccagaagcaccagcagcgccggcagcaacaacagcgccgagggcgccggcctgaccgacaacggctgcagaagaagaagacaggacagaaccaaggagagacccagactgaagaagcaggtgagcgtgagcagcaccgacagcctggacgaggacagaatcgacgagcccgacggcctgggccccagaagaagcagcgagagaaagagacacctggagagaaactggagcggcagaggcgagggcgagcagaagaacagcgccaaggagtacagaggcaccctgagagtgaccttcgacgccgaggccatgaacaaggagagccccatggtgagaagcgccagagacgacatggacagaggcaagcccgacaagggcctgagcagcggcggcaagggcagcgagaagcaggagagcaagaaccccaagcaggagctgagaggcagaggcagaggcatcctgatcctgcccgcccacaccaccctgagcgtgaacagcgccggcagccccgagagcgcccccctgggccccagactgctgttcggcagcggcagcaagggcagcagaagctggggcagaggcggcaccaccagaagactgtgggaccccaacaaccccgaccagaagcccgccctgaagacccagaccccccagctgcacttcctggacaccgacgacgaggtgagccccaccagctggggcgacagcagacaggcccaggccagctactacaagttccagaacagcgacaacccctactactaccccagaacccccggccccgccagccagtacccctacaccggctacaaccccctgcagtaccccgtgggccccaccaacggcgtgtaccccggcccctactaccccggctaccccacccccagcggccagtacgtgtgcagccccctgcccaccagcaccatgagccccgaggaggtggagcagcacatgagaaacctgcagcagcaggagctgcacagactgctgagagtggccgacaaccaggagctgcagctgagcaacctgctgagcagagacagaatcagccccgagggcctggagaagatggcccagctgagagccgagctgctgcagctgtacgagagatgcatcctgctggacatcgagttcagcgacaaccagaacgtggaccagatcctgtggaagaacgccttctaccaggtgatcgagaagttcagacagctggtgaaggaccccaacgtggagaaccccgagcagatcagaaacagactgctggagctgctggacgagggcagcgacttcttcgacagcctgctgcagaagctgcaggtgacctacaagttcaagctggaggactacatggacggcctggccatcagaagcaagcccctgagaaagaccgtgaagtacgccctgatcagcgcccagagatgcatgatctgccagggcgacatcgccagatacagagagcaggccagcgacaccgccaactacggcaaggccagaagctggtacctgaaggcccagcacatcgcccccaagaacggcagaccctacaaccagctggccctgctggccgtgtacaccagaagaaagctggacgccgtgtactactacatgagaagcctggccgccagcaaccccatcctgaccgccaaggagagcctgatgagcctgttcgaggagaccaagagaaaggccgagcagatggagaagaagcagcacgaggagttcgacctgagccccgaccagtggagaaagggcaagaagagcaccttcagacacgtgggcgacgacaccaccagactggagatctggatccaccccagccaccccagaagcagccagggcaccgagagcggcaaggacagcgagcaggagaacggcctgggcagcctgagccccagcgacctgaacaagagattcatcctgagcttcctgcacgcccacggcaagctgttcaccagaatcggcatggagaccttccccgccgtggccgagaaggtgctgaaggagttccaggtgctgctgcagcacagccccagccccatcggcagcaccagaatgctgcagctgatgaccatcaacatgttcgccgtgcacaacagccagctgaaggactgcttcagcgaggagtgcagaagcgtgatccaggagcaggccgccgccctgggcctggccatgttcagcctgctggtgagaagatgcacctgcctgctgaaggagagcgccaaggcccagctgagcagccccgaggaccaggacgaccaggacgacatcaaggtgagcagcttcgtgcccgacctgaaggagctgctgcccagcgtgaaggtgtggagcgactggatgctgggctaccccgacacctggaaccccccccccaccagcctggacctgcccagccacgtggccgtggacgtgtggagcaccctggccgacttctgcaacatcctgaccgccgtgaaccagagcgaggtgcccctgtacaaggaccccgacgacgacctgaccctgctgatcctggaggaggacagactgctgagcggcttcgtgcccctgctggccgccccccaggacccctgctacgtggagaagaccagcgacaaggtgatcgccgccgactgcaagagagtgaccgtgctgaagtacttcctggaggccctgtgcggccaggaggagcccctgctggccttcaagggcggcaagtacgtgagcgtggcccccgtgcccgacaccatgggcaaggagatgggcagccaggagggcaccagactggaggacgaggaggaggacgtggtgatcgaggacttcgaggaggacagcgaggccgagggcagcggcggcgaggacgacatcagagagctgagagccaagaagctggccctggccagaaagatcgccgagcagcagagaagacaggagaagatccaggccgtgctggaggaccacagccagatgagacagatggagctggagatcagacccctgttcctggtgcccgacaccaacggcttcatcgaccacctggccagcctggccagactgctggagagcagaaagtacatcctggtggtgcccctgatcgtgatcaacgagctggacggcctggccaagggccaggagaccgaccacagagccggcggctacgccagagtggtgcaggagaaggccagaaagagcatcgagttcctggagcagagattcgagagcagagacagctgcctgagagccctgaccagcagaggcaacgagctggagagcatcgccttcagaagcgaggacatcaccggccagctgggcaacaacgacgacctgatcctgagctgctgcctgcactactgcaaggacaaggccaaggacttcatgcccgccagcaaggaggagcccatcagactgctgagagaggtggtgctgctgaccgacgacagaaacctgagagtgaaggccctgaccagaaacgtgcccgtgagagacatccccgccttcctgacctgggcccaggtgggctag

SEQ ID NO: 12958 - DNA, 993 bp, Artificial Sequence
  Description of Artificial Sequence: Synthetic coding sequence
atgagattcagactgtgccaccagagaggctgctgcccccacgagagagagaacacctgcacctgcaagatgatcatcagcagcctgcaggtgatcgccgccgactgcaagagagtgaccgtgctgaagtacttcctggaggccctgtgcggccaggaggagcccctgctggccttcaagggcggcaagtacgtgagcgtggcccccgtgcccgacaccatgggcaaggagatgggcagccaggagggcaccagactggaggacgaggaggaggacgtggtgatcgaggacttcgaggaggacagcgaggccgagggcagcggcggcgaggacgacatcagagagctgagagccaagaagctggccctggccagaaagatcgccgagcagcagagaagacaggagaagatccaggccgtgctggaggaccacagccagatgagacagatggagctggagatcagacccctgttcctggtgcccgacaccaacggcttcatcgaccacctggccagcctggccagactgctggagagcagaaagtacatcctggtggtgcccctgatcgtgatcaacgagctggacggcctggccaagggccaggagaccgaccacagagccggcggctacgccagagtggtgcaggagaaggccagaaagagcatcgagttcctggagcagagattcgagagcagagacagctgcctgagagccctgaccagcagaggcaacgagctggagagcatcgccttcagaagcgaggacatcaccggccagctgggcaacaacgacgacctgatcctgagctgctgcctgcactactgcaaggacaaggccaaggacttcatgcccgccagcaaggaggagcccatcagactgctgagagaggtggtgctgctgaccgacgacagaaacctgagagtgaaggccctgaccagaaacgtgcccgtgagagacatccccgccttcctgacctgggcccaggtgggctag

SEQ ID NO: 12959 - DNA, 1536 bp, Artificial Sequence
  Description of Artificial Sequence: Synthetic coding sequence
atggagaccttccccgccgtggccgagaaggtgctgaaggagttccaggtgctgctgcagcacagccccagccccatcggcagcaccagaatgctgcagctgatgaccatcaacatgttcgccgtgcacaacagccagctgaaggactgcttcagcgaggagtgcagaagcgtgatccaggagcaggccgccgccctgggcctggccatgttcagcctgctggtgagaagatgcacctgcctgctgaaggagagcgccaaggcccagctgagcagccccgaggaccaggacgaccaggacgacatcaaggtgagcagcttcgtgcccgacctgaaggagctgctgcccagcgtgaaggtgtggagcgactggatgctgggctaccccgacacctggaaccccccccccaccagcctggacctgcccagccacgtggccgtggacgtgtggagcaccctggccgacttctgcaacatcctgaccgccgtgaaccagagcgaggtgcccctgtacaaggaccccgacgacgacctgaccctgctgatcctggaggaggacagactgctgagcggcttcgtgcccctgctggccgccccccaggacccctgctacgtggagaagaccagcgacaaggtgatcgccgccgactgcaagagagtgaccgtgctgaagtacttcctggaggccctgtgcggccaggaggagcccctgctggccttcaagggcggcaagtacgtgagcgtggcccccgtgcccgacaccatgggcaaggagatgggcagccaggagggcaccagactggaggacgaggaggaggacgtggtgatcgaggacttcgaggaggacagcgaggccgagggcagcggcggcgaggacgacatcagagagctgagagccaagaagctggccctggccagaaagatcgccgagcagcagagaagacaggagaagatccaggccgtgctggaggaccacagccagatgagacagatggagctggagatcagacccctgttcctggtgcccgacaccaacggcttcatcgaccacctggccagcctggccagactgctggagagcagaaagtacatcctggtggtgcccctgatcgtgatcaacgagctggacggcctggccaagggccaggagaccgaccacagagccggcggctacgccagagtggtgcaggagaaggccagaaagagcatcgagttcctggagcagagattcgagagcagagacagctgcctgagagccctgaccagcagaggcaacgagctggagagcatcgccttcagaagcgaggacatcaccggccagctgggcaacaacgacgacctgatcctgagctgctgcctgcactactgcaaggacaaggccaaggacttcatgcccgccagcaaggaggagcccatcagactgctgagagaggtggtgctgctgaccgacgacagaaacctgagagtgaaggccctgaccagaaacgtgcccgtgagagacatccccgccttcctgacctgggcccaggtgggctag

SEQ ID NO: 12960 - DNA, 4167 bp, Artificial Sequence
  Description of Artificial Sequence: Synthetic coding sequence
atgaaggagctgaaggaggccagacccagaaaggacaacagaagacccgacctggagatctacaagcccggcctgagcagactgagaaacaagcccaagatcaaggagccccccggcagcgaggagttcaaggacgagatcgtgaacgacagagactgcagcgccgtggagaacggcacccagcccgtgaaggacgtgtgcaaggagctgaacaaccaggagcagaacggccccatcgaccccgagaacaacagaggccaggagagcttccccagaaccgccggccaggaggacagaagcctgaagatcatcaagagaaccaagaagcccgacctgcagatctaccagcccggcagaagactgcagaccgtgagcaaggagagcgccagcagagtggaggaggaggaggtgctgaaccaggtggagcagctgagagtggaggaggacgagtgcagaggcaacgtggccaaggaggaggtggccaacaagcccgacagagccgagatcgagaagagccccggcggcggcagagtgggcgccgccaagggcgagaagggcaagagaatgggcaagggcgagggcgtgagagagacccacgacgaccccgccagaggcagacccggcagcgccaagagatacagcagaagcgacaagagaagaaacagatacagaaccagaagcaccagcagcgccggcagcaacaacagcgccgagggcgccggcctgaccgacaacggctgcagaagaagaagacaggacagaaccaaggagagacccagactgaagaagcaggtgagcgtgagcagcaccgacagcctggacgaggacagaatcgacgagcccgacggcctgggccccagaagaagcagcgagagaaagagacacctggagagaaactggagcggcagaggcgagggcgagcagaagaacagcgccaaggagtacagaggcaccctgagagtgaccttcgacgccgaggccatgaacaaggagagccccatggtgagaagcgccagagacgacatggacagaggcaagcccgacaagggcctgagcagcggcggcaagggcagcgagaagcaggagagcaagaaccccaagcaggagctgagaggcagaggcagaggcatcctgatcctgcccgcccacaccaccctgagcgtgaacagcgccggcagccccgagagcgcccccctgggccccagactgctgttcggcagcggcagcaagggcagcagaagctggggcagaggcggcaccaccagaagactgtgggaccccaacaaccccgaccagaagcccgccctgaagacccagaccccccagctgcacttcctggacaccgacgacgaggtgagccccaccagctggggcgacagcagacaggcccaggccagctactacaagttccagaacagcgacaacccctactactaccccagaacccccggccccgccagccagtacccctacaccggctacaaccccctgcagtaccccgtgggccccaccaacggcgtgtaccccggcccctactaccccggctaccccacccccagcggccagtacgtgtgcagccccctgcccaccagcaccatgagccccgaggaggtggagcagcacatgagaaacctgcagcagcaggagctgcacagactgctgagagtggccgacaaccaggagctgcagctgagcaacctgctgagcagagacagaatcagccccgagggcctggagaagatggcccagctgagagccgagctgctgcagctgtacgagagatgcatcctgctggacatcgagttcagcgacaaccagaacgtggaccagatcctgtggaagaacgccttctaccaggtgatcgagaagttcagacagctggtgaaggaccccaacgtggagaaccccgagcagatcagaaacagactgctggagctgctggacgagggcagcgacttcttcgacagcctgctgcagaagctgcaggtgacctacaagttcaagctggaggactacatggacggcctggccatcagaagcaagcccctgagaaagaccgtgaagtacgccctgatcagcgcccagagatgcatgatctgccagggcgacatcgccagatacagagagcaggccagcgacaccgccaactacggcaaggccagaagctggtacctgaaggcccagcacatcgcccccaagaacggcagaccctacaaccagctggccctgctggccgtgtacaccagaagaaagctggacgccgtgtactactacatgagaagcctggccgccagcaaccccatcctgaccgccaaggagagcctgatgagcctgttcgaggagaccaagagaaaggccgagcagatggagaagaagcagcacgaggagttcgacctgagccccgaccagtggagaaagggcaagaagagcaccttcagacacgtgggcgacgacaccaccagactggagatctggatccaccccagccaccccagaagcagccagggcaccgagagcggcaaggacagcgagcaggagaacggcctgggcagcctgagccccagcgacctgaacaagagattcatcctgagcttcctgcacgcccacggcaagctgttcaccagaatcggcatggagaccttccccgccgtggccgagaaggtgctgaaggagttccaggtgctgctgcagcacagccccagccccatcggcagcaccagaatgctgcagctgatgaccatcaacatgttcgccgtgcacaacagccagctgaaggactgcttcagcgaggagtgcagaagcgtgatccaggagcaggccgccgccctgggcctggccatgttcagcctgctggtgagaagatgcacctgcctgctgaaggagagcgccaaggcccagctgagcagccccgaggaccaggacgaccaggacgacatcaaggtgagcagcttcgtgcccgacctgaaggagctgctgcccagcgtgaaggtgtggagcgactggatgctgggctaccccgacacctggaaccccccccccaccagcctggacctgcccagccacgtggccgtggacgtgtggagcaccctggccgacttctgcaacatcctgaccgccgtgaaccagagcgaggtgcccctgtacaaggaccccgacgacgacctgaccctgctgatcctggaggaggacagactgctgagcggcttcgtgcccctgctggccgccccccaggacccctgctacgtggagaagaccagcgacaaggtgatcgccgccgactgcaagagagtgaccgtgctgaagtacttcctggaggccctgtgcggccaggaggagcccctgctggccttcaagggcggcaagtacgtgagcgtggcccccgtgcccgacaccatgggcaaggagatgggcagccaggagggcaccagactggaggacgaggaggaggacgtggtgatcgaggacttcgaggaggacagcgaggccgagggcagcggcggcgaggacgacatcagagagctgagagccaagaagctggccctggccagaaagatcgccgagcagcagagaagacaggagaagatccaggccgtgctggaggaccacagccagatgagacagatggagctggagatcagacccctgttcctggtgcccgacaccaacggcttcatcgaccacctggccagcctggccagactgctggagagcagaaagtacatcctggtggtgcccctgatcgtgatcaacgagctggacggcctggccaagggccaggagaccgaccacagagccggcggctacgccagagtggtgcaggagaaggccagaaagagcatcgagttcctggagcagagattcgagagcagagacagctgcctgagagccctgaccagcagaggcaacgagctggagagcatcgccttcagaagcgaggacatcaccggccagctgggcaacaacgacgacctgatcctgagctgctgcctgcactactgcaaggacaaggccaaggacttcatgcccgccagcaaggaggagcccatcagactgctgagagaggtggtgctgctgaccgacgacagaaacctgagagtgaaggccctgaccagaaacgtgcccgtgagagacatccccgccttcctgacctgggcccaggtgggctag

SEQ ID NO: 12961 - DNA, 2364 bp, Artificial Sequence
  Description of Artificial Sequence: Synthetic coding sequence
atggccgccgccagacccgccagaggccccgagctgcccctgctgggcctgctgctgctgctgctgctgggcgaccccggcagaggcgccgccagcagcggcaacgccaccggccccggccccagaagcgccggcggcagcgccagaagaagcgccgccgtgaccggcccccccccccccctgagccactgcggcagagccgccccctgcgagcccctgagatacaacgtgtgcctgggcagcgtgctgccctacggcgccaccagcaccctgctggccggcgacagcgacagccaggaggaggcccacggcaagctggtgctgtggagcggcctgagaaacgcccccagatgctgggccgtgatccagcccctgctgtgcgccgtgtacatgcccaagtgcgagaacgacagagtggagctgcccagcagaaccctgtgccaggccaccagaggcccctgcgccatcgtggagagagagagaggctggcccgacttcctgagatgcacccccgacagattccccgagggctgcaccaacgaggtgcagaacatcaagttcaacagcagcggccagtgcgaggtgcccctggtgagaaccgacaaccccaagagctggtacgaggacgtggagggctgcggcatccagtgccagaaccccctgttcaccgaggccgagcaccaggacatgcacagctacatcgccgccttcggcgccgtgaccggcctgtgcaccctgttcaccctggccaccttcgtggccgactggagaaacagcaacagataccccgccgtgatcctgttctacgtgaacgcctgcttcttcgtgggcagcatcggctggctggcccagttcatggacggcgccagaagagagatcgtgtgcagagccgacggcaccatgagactgggcgagcccaccagcaacgagaccctgagctgcgtgatcatcttcgtgatcgtgtactacgccctgatggccggcgtggtgtggttcgtggtgctgacctacgcctggcacaccagcttcaaggccctgggcaccacctaccagcccctgagcggcaagaccagctacttccacctgctgacctggagcctgcccttcgtgctgaccgtggccatcctggccgtggcccaggtggacggcgacagcgtgagcggcatctgcttcgtgggctacaagaactacagatacagagccggcttcgtgctggcccccatcggcctggtgctgatcgtgggcggctacttcctgatcagaggcgtgatgaccctgttcagcatcaagagcaaccaccccggcctgctgagcgagaaggccgccagcaagatcaacgagaccatgctgagactgggcatcttcggcttcctggccttcggcttcgtgctgatcaccttcagctgccacttctacgacttcttcaaccaggccgagtgggagagaagcttcagagactacgtgctgtgccaggccaacgtgaccatcggcctgcccaccaagcagcccatccccgactgcgagatcaagaacagacccagcctgctggtggagaagatcaacctgttcgccatgttcggcaccggcatcgccatgagcacctgggtgtggaccaaggccaccctgctgatctggagaagaacctggtgcagactgaccggccagagcgacgacgagcccaagagaatcaagaagagcaagatgatcgccaaggccttcagcaagagacacgagctgctgcagaaccccggccaggagctgagcttcagcatgcacaccgtgagccacgacggccccgtggccggcctggccttcgacctgaacgagcccagcgccgacgtgagcagcgcctgggcccagcacgtgaccaagatggtggccagaagaggcgccatcctgccccaggacatcagcgtgacccccgtggccacccccgtgccccccgaggagcaggccaacctgtggctggtggaggccgagatcagccccgagctgcagaagagactgggcagaaagaagaagagaagaaagagaaagaaggaggtgtgccccctggcccccccccccgagctgcacccccccgcccccgcccccagcaccatccccagactgccccagctgcccagacagaagtgcctggtggccgccggcgcctggggcgccggcgacagctgcagacagggcgcctggaccctggtgagcaaccccttctgccccgagcccagccccccccaggaccccttcctgcccagcgcccccgcccccgtggcctgggcccacggcagaagacagggcctgggccccatccacagcagaaccaacctgatggacaccgagctgatggacgccgacagcgacttctag

SEQ ID NO: 12962 - DNA, 231 bp, Artificial Sequence
  Description of Artificial Sequence: Synthetic coding sequence
atgagcgaccaggacagcagcgagatccacttcaaggtgaagatgaccacccacctgaagaagctgaaggagagctactgccagagacagggcgtgcccatgaacagcctgagattcctgttcgagggccagagaatcgccgacaaccacacccccaaggagctgggcatggaggaggaggacgtgatcgaggtgtaccaggagcagaccggcggccacagcaccgtgtag

SEQ ID NO: 12963 - DNA, 306 bp, Artificial Sequence
  Description of Artificial Sequence: Synthetic coding sequence
atgagcgaccaggaggccaagcccagcaccgaggacctgggcgacaagaaggagggcgagtacatcaagctgaaggtgatcggccaggacagcagcgagatccacttcaaggtgaagatgaccacccacctgaagaagctgaaggagagctactgccagagacagggcgtgcccatgaacagcctgagattcctgttcgagggccagagaatcgccgacaaccacacccccaaggagctgggcatggaggaggaggacgtgatcgaggtgtaccaggagcagaccggcggccacagcaccgtgtag

SEQ ID NO: 12964 - DNA, 306 bp, Artificial Sequence; identical to SEQ ID NO: 12963
  Description of Artificial Sequence: Synthetic coding sequence

SEQ ID NO: 12965 - DNA, 189 bp, Artificial Sequence
  Description of Artificial Sequence: Synthetic coding sequence
atgaccacccacctgaagaagctgaaggagagctactgccagagacagggcgtgcccatgaacagcctgagattcctgttcgagggccagagaatcgccgacaaccacacccccaaggagctgggcatggaggaggaggacgtgatcgaggtgtaccaggagcagaccggcggccacagcaccgtgtag

SEQ ID NO: 12966 - DNA, 189 bp, Artificial Sequence; identical to SEQ ID NO: 12965
  Description of Artificial Sequence: Synthetic coding sequence

SEQ ID NO: 12967 - DNA, 795 bp, Artificial Sequence
  Description of Artificial Sequence: Synthetic coding sequence
atgcccagaagcttcctggtgagaaagcccagcgaccccaacagaaagcccaactacagcgagctgcaggacagcaaccccgagttcaccttccagcagccctacgaccaggcccacctgctggccgccatccccccccccgagatcctgaaccccaccgccagcctgcccatgctgatctgggacagcgtgctggccccccaggcccagcccatcgcctgggccagcctgagactgcaggagagccccagagtggccgagctgaccagcctgagcgacgaggacagcggcaagggcagccagccccccagcccccccagccccgcccccagcagcttcagcagcaccagcgtgagcagcctggaggccgaggcctacgccgccttccccggcctgggccaggtgcccaagcagctggcccagctgagcgaggccaaggacctgcaggccagaaaggccttcaactgcaagtactgcaacaaggagtacctgagcctgggcgccctgaagatgcacatcagaagccacaccctgccctgcgtgtgcggcacctgcggcaaggccttcagcagaccctggctgctgcagggccacgtgagaacccacaccggcgagaagcccttcagctgcccccactgcagcagagccttcgccgacagaagcaacctgagagcccacctgcagacccacagcgacgtgaagaagtaccagtgccaggcctgcgccagaaccttcagcagaatgagcctgctgcacaagcaccaggagagcggctgcagcggctgccccagatag

SEQ ID NO: 12968 - DNA, 807 bp, Artificial Sequence
  Description of Artificial Sequence: Synthetic coding sequence
atgcccagaagcttcctggtgaagaagcacttcaacgccagcaagaagcccaactacagcgagctggacacccacaccgtgatcatcagcccctacctgtacgagagctacagcatgcccgtgatcccccagcccgagatcctgagcagcggcgcctacagccccatcaccgtgtggaccaccgccgcccccttccacgcccagctgcccaacggcctgagccccctgagcggctacagcagcagcctgggcagagtgagcccccccccccccagcgacaccagcagcaaggaccacagcggcagcgagagccccatcagcgacgaggaggagagactgcagagcaagctgagcgacccccacgccatcgaggccgagaagttccagtgcaacctgtgcaacaagacctacagcaccttcagcggcctggccaagcacaagcagctgcactgcgacgcccagagcagaaagagcttcagctgcaagtactgcgacaaggagtacgtgagcctgggcgccctgaagatgcacatcagaacccacaccctgccctgcgtgtgcaagatctgcggcaaggccttcagcagaccctggctgctgcagggccacatcagaacccacaccggcgagaagcccttcagctgcccccactgcaacagagccttcgccgacagaagcaacctgagagcccacctgcagacccacagcgacgtgaagaagtaccagtgcaagaactgcagcaagaccttcagcagaatgagcctgctgcacaagcacgaggagagcggctgctgcgtggcccactag

SEQ ID NO: 12969 - DNA, 807 bp, Artificial Sequence; identical to SEQ ID NO: 12968
  Description of Artificial Sequence: Synthetic coding sequence

SEQ ID NO: 12970 - DNA, 879 bp, Artificial Sequence
  Description of Artificial Sequence: Synthetic coding sequence
atgcccagaagcttcctggtgaagacccacagcagccacagagtgcccaactacagaagactggagacccagagagagatcaacggcgcctgcagcgcctgcggcggcctggtggtgcccctgctgcccagagacaaggaggcccccagcgtgcccggcgacctgccccagccctgggacagaagcagcgccgtggcctgcatcagcctgcccctgctgcccagaatcgaggaggccctgggcgccagcggcctggacgccctggaggtgagcgaggtggaccccagagccagcagagccgccatcgtgcccctgaaggacagcctgaaccacctgaacctgccccccctgctggtgctgcccaccagatggagccccaccctgggccccgacagacacggcgcccccgagaagctgctgggcgccgagagaatgcccagagcccccggcggcttcgagtgcttccactgccacaagccctaccacaccctggccggcctggccagacacagacagctgcactgccacctgcaggtgggcagagtgttcacctgcaagtactgcgacaaggagtacaccagcctgggcgccctgaagatgcacatcagaacccacaccctgccctgcacctgcaagatctgcggcaaggccttcagcagaccctggctgctgcagggccacgtgagaacccacaccggcgagaagccctacgcctgcagccactgcagcagagccttcgccgacagaagcaacctgagagcccacctgcagacccacagcgacgccaagaagtacagatgcagaagatgcaccaagaccttcagcagaatgagcctgctggccagacacgaggagagcggctgctgccccggcccctag

SEQ ID NO: 12971 - DNA, 1398 bp, Artificial Sequence
  Description of Artificial Sequence: Synthetic coding sequence
atgggcggcgccgtggtggacgagggccccaccggcgtgaaggcccccgacggcggctggggctgggccgtgctgttcggctgcttcgtgatcaccggcttcagctacgccttccccaaggccgtgagcgtgttcttcaaggagctgatccaggagttcggcatcggctacagcgacaccgcctggatcagcagcatcctgctggccatgctgtacggcaccggccccctgtgcagcgtgtgcgtgaacagattcggctgcagacccgtgatgctggtgggcggcctgttcgccagcctgggcatggtggccgccagcttctgcagaagcatcatccaggtgtacctgaccaccggcgtgatcaccggcctgggcctggccctgaacttccagcccagcctgatcatgctgaacagatacttcagcaagagaagacccatggccaacggcctggccgccgccggcagccccgtgttcctgtgcgccctgagccccctgggccagctgctgcaggacagatacggctggagaggcggcttcctgatcctgggcggcctgctgctgaactgctgcgtgtgcgccgccctgatgagacccctggtggtgaccgcccagcccggcagcggcccccccagacccagcagaagactgctggacctgagcgtgttcagagacagaggcttcgtgctgtacgccgtggccgccagcgtgatggtgctgggcctgttcgtgccccccgtgttcgtggtgagctacgccaaggacctgggcgtgcccgacaccaaggccgccttcctgctgaccatcctgggcttcatcgacatcttcgccagacccgccgccggcttcgtggccggcctgggcaaggtgagaccctacagcgtgtacctgttcagcttcagcatgttcttcaacggcctggccgacctggccggcagcaccgccggcgactacggcggcctggtggtgttctgcatcttcttcggcatcagctacggcatggtgggcgccctgcagttcgaggtgctgatggccatcgtgggcacccacaagttcagcagcgccatcggcctggtgctgctgatggaggccgtggccgtgctggtgggcccccccagcggcggcaagctgctggacgccacccacgtgtacatgtacgtgttcatcctggccggcgccgaggtgctgaccagcagcctgatcctgctgctgggcaacttcttctgcatcagaaagaagcccaaggagccccagcccgaggtggccgccgccgaggaggagaagctgcacaagccccccgccgacagcggcgtggacctgagagaggtggagcacttcctgaaggccgagcccgagaagaacggcgaggtggtgcacacccccgagaccagcgtgtag

SEQ ID NO: 12972 - DNA, 1398 bp, Artificial Sequence; identical to SEQ ID NO: 12971
  Description of Artificial Sequence: Synthetic coding sequence

SEQ ID NO: 12973 - DNA, 1398 bp, Artificial Sequence; identical to SEQ ID NO: 12971
  Description of Artificial Sequence: Synthetic coding sequence

SEQ ID NO: 12974 - DNA, 1398 bp, Artificial Sequence; identical to SEQ ID NO: 12971
  Description of Artificial Sequence: Synthetic coding sequence

SEQ ID NO: 12975 - DNA, 1470 bp, Artificial Sequence
  Description of Artificial Sequence: Synthetic coding sequence
atggtgcccagcagccccgccgtggagaagcaggtgcccgtggagcccggccccgaccccgagctgagaagctggagacacctggtgtgctacctgtgcttctacggcttcatggcccagatcagacccggcgagagcttcatcaccccctacctgctgggccccgacaagaacttcaccagagagcaggtgaccaacgagatcacccccgtgctgagctacagctacctggccgtgctggtgcccgtgttcctgctgaccgactacctgagatacacccccgtgctgctgctgcagggcctgagcttcgtgagcgtgtggctgctgctgctgctgggccacagcgtggcccacatgcagctgatggagctgttctacagcgtgaccatggccgccagaatcgcctacagcagctacatcttcagcctggtgagacccgccagataccagagagtggccggctacagcagagccgccgtgctgctgggcgtgttcaccagcagcgtgctgggccagctgctggtgaccgtgggcagagtgagcttcagcaccctgaactacatcagcctggccttcctgaccttcagcgtggtgctggccctgttcctgaagagacccaagagaagcctgttcttcaacagagacgacagaggcagatgcgagaccagcgccagcgagctggagagaatgaaccccggccccggcggcaagctgggccacgccctgagagtggcctgcggcgacagcgtgctggccagaatgctgagagagctgggcgacagcctgagaagaccccagctgagactgtggagcctgtggtgggtgttcaacagcgccggctactacctggtggtgtactacgtgcacatcctgtggaacgaggtggaccccaccaccaacagcgccagagtgtacaacggcgccgccgacgccgccagcaccctgctgggcgccatcaccagcttcgccgccggcttcgtgaagatcagatgggccagatggagcaagctgctgatcgccggcgtgaccgccacccaggccggcctggtgttcctgctggcccacaccagacaccccagcagcatctggctgtgctacgccgccttcgtgctgttcagaggcagctaccagttcctggtgcccatcgccaccttccagatcgccagcagcctgagcaaggagctgtgcgccctggtgttcggcgtgaacaccttcttcgccaccatcgtgaagaccatcatcaccttcatcgtgagcgacgtgagaggcctgggcctgcccgtgagaaagcagaacgaggagctgcacgtggccagcctgagcctgtggaagagccacctgagactggccgccgacaccctgagcagcgagggcagcagcggcagcggccccagaagctggttcctgagccccaccctgagagccgccctgcacggccccgtgtgccccagcgaggtgtgccccagctag

SEQ ID NO: 12976 - DNA, 1776 bp, Artificial Sequence
  Description of Artificial Sequence: Synthetic coding sequence
atggtgcccagcagccccgccgtggagaagcaggtgcccgtggagcccggccccgaccccgagctgagaagctggagacacctggtgtgctacctgtgcttctacggcttcatggcccagatcagacccggcgagagcttcatcaccccctacctgctgggccccgacaagaacttcaccagagagcaggtgaccaacgagatcacccccgtgctgagctacagctacctggccgtgctggtgcccgtgttcctgctgaccgactacctgagatacacccccgtgctgctgctgcagggcctgagcttcgtgagcgtgtggctgctgctgctgctgggccacagcgtggcccacatgcagctgatggagctgttctacagcgtgaccatggccgccagaatcgcctacagcagctacatcttcagcctggtgagacccgccagataccagagagtggccggctacagcagagccgccgtgctgctgggcgtgttcaccagcagcgtgctgggccagctgctggtgaccgtgggcagagtgagcttcagcaccctgaactacatcagcctggccttcctgaccttcagcgtggtgctggccctgttcctgaagagacccaagagaagcctgttcttcaacagagacgacagaggcagatgcgagaccagcgccagcgagctggagagaatgaaccccggccccggcggcaagctgggccacgccctgagagtggcctgcggcgacagcgtgctggccagaatgctgagagagctgggcgacagcctgagaagaccccagctgagactgtggagcctgtggtgggtgttcaacagcgccggctactacctggtggtgtactacgtgcacatcctgtggaacgaggtggaccccaccaccaacagcgccagagtgtacaacggcgccgccgacgccgccagcaccctgctgggcgccatcaccagcttcgccgccggcttcgtgaagatcagatgggccagatggagcaagctgctgatcgccggcgtgaccgccacccaggccggcctggtgttcctgctggcccacaccagacaccccagcagcatctggctgtgctacgccgccttcgtgctgttcagaggcagctaccagttcctggtgcccatcgccaccttccagatcgccagcagcctgagcaaggagctgtgcgccctggtgttcggcgtgaacaccttcttcgccaccatcgtgaagaccatcatcaccttcatcgtgagcgacgtgagaggcctgggcctgcccgtgagaaagcagttccagctgtacagcgtgtacttcctgatcctgagcatcatctacttcctgggcgccatgctggacggcctgagacactgccagagaggccaccaccccagacagccccccgcccagggcctgagaagcgccgccgaggagaaggccgcccaggccctgagcgtgcaggacaagggcctgggcggcctgcagcccgcccagagcccccccctgagccccgaggacagcctgggcgccgtgggccccgccagcctggagcagagacagagcgacccctacctggcccaggcccccgccccccaggccgccgagttcctgagccccgtgaccacccccagcccctgcaccctgtgcagcgcccaggccagcggccccgaggccgccgacgagacctgcccccagctggccgtgcacccccccggcgtgagcaagctgggcctgcagtgcctgcccagcgacggcgtgcagaacgtgaaccagtag

SEQ ID NO: 12977 - DNA, 846 bp, Artificial Sequence
  Description of Artificial Sequence: Synthetic coding sequence
atgctgagagagctgggcgacagcctgagaagaccccagctgagactgtggagcctgtggtgggtgttcaacagcgccggctactacctggtggtgtactacgtgcacatcctgtggaacgaggtggaccccaccaccaacagcgccagagtgtacaacggcgccgccgacgccgccagcaccctgctgggcgccatcaccagcttcgccgccggcttcgtgaagatcagatgggccagatggagcaagctgctgatcgccggcgtgaccgccacccaggccggcctggtgttcctgctggcccacaccagacaccccagcagcatctggctgtgctacgccgccttcgtgctgttcagaggcagctaccagttcctggtgcccatcgccaccttccagatcgccagcagcctgagcaaggagctgtgcgccctggtgttcggcgtgaacaccttcttcgccaccatcgtgaagaccatcatcaccttcatcgtgagcgacgtgagaggcctgggcctgcccgtgagaaagcaggccctgagaatgagcagacccagactgggcctgtgcctgcccggccccttccccccccagagcgccgcccccgccagagccggcatggccgccagcagcgccgaggaccccggcagcgagagaggcccctggagaagagccggcaccgtggccgccagaggcgaccccggcggcgagagaggcccctggagaagagagggcaccctggccgccagaggcgaccccggcggcgagagaggcccctggtggagagagggcaccctggccgccaagcccagaatgcagtgggtgaccagagccaccgccccctag

SEQ ID NO: 12978 - DNA, 810 bp, Artificial Sequence
  Description of Artificial Sequence: Synthetic coding sequence
tgactgagactgtggagcctgtggtgggtgttcaacagcgccggctactacctggtggtgtactacgtgcacatcctgtggaacgaggtggaccccaccaccaacagcgccagagtgtacaacggcgccgccgacgccgccagcaccctgctgggcgccatcaccagcttcgccgccggcttcgtgaagatcagatgggccagatggagcaagctgctgatcgccggcgtgaccgccacccaggccggcctggtgttcctgctggcccacaccagacaccccagcagcatctggctgtgctacgccgccttcgtgctgttcagaggcagctaccagttcctggtgcccatcgccaccttccagatcgccagcagcctgagcaaggagctgtgcgccctggtgttcggcgtgaacaccttcttcgccaccatcgtgaagaccatcatcaccttcatcgtgagcgacgtgagaggcctgggcctgcccgtgagaaagcaggccctgagaatgagcagacccagactgggcctgtgcctgcccggccccttccccccccagagcgccgcccccgccagagccggcatggccgccagcagcgccgaggaccccggcagcgagagaggcccctggagaagagccggcaccgtggccgccagaggcgaccccggcggcgagagaggcccctggagaagagagggcaccctggccgccagaggcgaccccggcggcgagagaggcccctggtggagagagggcaccctggccgccaagcccagaatgcagtgggtgaccagagccaccgccccctag

SEQ ID NO: 12979 - DNA, 549 bp, Artificial Sequence
  Description of Artificial Sequence: Synthetic coding sequence
atggtgcccagcagccccgccgtggagaagcaggtgcccgtggagcccggccccgaccccgagctgagaagctggagacacctggtgtgctacctgtgcttctacggcttcatggcccagatcagacccggcgagagcttcatcaccccctacctgctgggccccgacaagaacttcaccagagagcaggtgaccaacgagatcacccccgtgctgagctacagctacctggccgtgctggtgcccgtgttcctgctgaccgactacctgagatacacccccgtgctgctgctgcagggcctgagcttcgtgagcgtgtggctgctgctgctgctgggccacagcgtggcccacatgcagctgatggagctgttctacagcgtgaccatggccgccagaatcgcctacagcagctacatcttcagcctggtgagacccgccagataccagagagtggccggctacagcagagccgccgtgctgctgggcgtgttcaccagcagcgtgctgggccagctgctggtgaccgtgggcagagtgagcttctag

SEQ ID NO: 12980 - DNA, 465 bp, Artificial Sequence
  Description of Artificial Sequence: Synthetic coding sequence
atggtgcccagcagccccgccgtggagaagcaggtgcccgtggagcccggccccgaccccgagctgagaagctggagacacctggtgtgctacctgtgcttctacggcttcatggcccagatcagacccggcgagagcttcatcaccccctacctgctgggccccgacaagaacttcaccagagagcaggtgaccaacgagatcacccccgtgctgagctacagctacctggccgtgctggtgcccgtgttcctgctgaccgactacctgagatacacccccgtgctgctgctgcagggcctgagcttcgtgagcgtgtggctgctgctgctgctgggccacagcgtggcccacatgcagctgatggagctgttctacagcgtgaccatggccgccagaatcgcctacagcagctacatcttcagcctggtgagacccgccagataccagagagtggccggctag

SEQ ID NO: 12981 - DNA, 1656 bp, Artificial Sequence
  Description of Artificial Sequence: Synthetic coding sequence
atgagaccccagcccgccgagcccgcccccggcggcagaggcaacgaggcctgcagcatccacagcgaggtgaccaacgagatcacccccgtgctgagctacagctacctggccgtgctggtgcccgtgttcctgctgaccgactacctgagatacacccccgtgctgctgctgcagggcctgagcttcgtgagcgtgtggctgctgctgctgctgggccacagcgtggcccacatgcagctgatggagctgttctacagcgtgaccatggccgccagaatcgcctacagcagctacatcttcagcctggtgagacccgccagataccagagagtggccggctacagcagagccgccgtgctgctgggcgtgttcaccagcagcgtgctgggccagctgctggtgaccgtgggcagagtgagcttcagcaccctgaactacatcagcctggccttcctgaccttcagcgtggtgctggccctgttcctgaagagacccaagagaagcctgttcttcaacagagacgacagaggcagatgcgagaccagcgccagcgagctggagagaatgaaccccggccccggcggcaagctgggccacgccctgagagtggcctgcggcgacagcgtgctggccagaatgctgagagagctgggcgacagcctgagaagaccccagctgagactgtggagcctgtggtgggtgttcaacagcgccggctactacctggtggtgtactacgtgcacatcctgtggaacgaggtggaccccaccaccaacagcgccagagtgtacaacggcgccgccgacgccgccagcaccctgctgggcgccatcaccagcttcgccgccggcttcgtgaagatcagatgggccagatggagcaagctgctgatcgccggcgtgaccgccacccaggccggcctggtgttcctgctggcccacaccagacaccccagcagcatctggctgtgctacgccgccttcgtgctgttcagaggcagctaccagttcctggtgcccatcgccaccttccagatcgccagcagcctgagcaaggagctgtgcgccctggtgttcggcgtgaacaccttcttcgccaccatcgtgaagaccatcatcaccttcatcgtgagcgacgtgagaggcctgggcctgcccgtgagaaagcagttccagctgtacagcgtgtacttcctgatcctgagcatcatctacttcctgggcgccatgctggacggcctgagacactgccagagaggccaccaccccagacagccccccgcccagggcctgagaagcgccgccgaggagaaggccgcccaggccctgagcgtgcaggacaagggcctgggcggcctgcagcccgcccagagcccccccctgagccccgaggacagcctgggcgccgtgggccccgccagcctggagcagagacagagcgacccctacctggcccaggcccccgccccccaggccgccgagttcctgagccccgtgaccacccccagcccctgcaccctgtgcagcgcccaggccagcggccccgaggccgccgacgagacctgcccccagctggccgtgcacccccccggcgtgagcaagctgggcctgcagtgcctgcccagcgacggcgtgcagaacgtgaaccagtag

SEQ ID NO: 12982 - DNA, 186 bp, Artificial Sequence
  Description of Artificial Sequence: Synthetic coding sequence
atggtgcccagcagccccgccgtggagaagcaggtgcccgtggagcccggccccgaccccgagctgagaagctggagacacctggtgtgctacctgtgcttctacggcttcatggcccagatcagacccggcgagagcttcatcaccccctacctgctgggccccgacaagaacttcaccagatag

SEQ ID NO: 12983 - DNA, 705 bp, Artificial Sequence
  Description of Artificial Sequence: Synthetic coding sequence
atggagcccagcagcaagaagctgaccggcagactgatgctggccgtgggcggcgccgtgctgggcagcctgcagttcggctacaacaccggcgtgatcaacgccccccagaaggtgatcgaggagttctacaaccagacctgggtgcacagatacggcgagagcatcctgcccaccaccctgaccaccctgtggagcctgagcgtggccatcttcagcgtgggcggcatgatcggcagcttcagcgtgggcctgttcgtgaacagattcggcagaagaaacagcatgctgatgatgaacctgctggccttcgtgagcgccgtgctgatgggcttcagcaagctgggcaagagcttcgagatgctgatcctgggcagattcatcatcggcgtgtactgcggcctgaccaccggcttcgtgcccatgtacgtgggcgaggtgagccccaccgccctgagaggcgccctgggcaccctgcaccagctgggcatcgtggtgggcatcctgatcgcccaggtgagctggggcagaatctacctgcccggcaccgcccccgcccacagcttcagcggcagcagaatctgcgcccagcagggcagagtgagcctgccccccagcccccacagcctggccgaggacaactacggcacccaggtgcagagaacccagcaccacggcctgcccgtggacagcaagatgacctag

SEQ ID NO: 12984 - DNA, 1377 bp, Artificial Sequence
  Description of Artificial Sequence: Synthetic coding sequence
atggagcccagcagcaagaagctgaccggcagactgatgctggccgtgggcggcgccgtgctgggcagcctgcagttcggctacaacaccggcgtgatcaacgccccccagaaggtgatcgaggagttctacaaccagacctgggtgcacagatacggcgagagcatcctgcccaccaccctgaccaccctgtggagcctgagcgtggccatcttcagcgtgggcggcatgatcggcagcttcagcgtgggcctgttcgtgaacagattcggcagaagaaacagcatgctgatgatgaacctgctggccttcgtgagcgccgtgctgatgggcttcagcaagctgggcaagagcttcgagatgctgatcctgggcagattcatcatcggcgtgtactgcggcctgaccaccggcttcgtgcccatgtacgtgggcgaggtgagccccaccgccctgagaggcgccctgggcaccctgcaccagctgggcatcgtggtgggcatcctgatcgcccaggtgttcggcctggacagcatcatgggcaacaaggacctgtggcccctgctgctgagcatcatcttcatccccgccctgctgcagtgcatcgtgctgcccttctgccccgagagccccagattcctgctgatcaacagaaacgaggagaacagagccaagagcgtgctgaagaagctgagaggcaccgccgacgtgacccacgacctgcaggagatgaaggaggagagcagacagatgatgagagagaagaaggtgaccatcctggagctgttcagaagccccgcctacagacagcccatcctgatcgccgtggtgctgcagctgagccagcagctgagcggcatcaacgccgtgttctactacagcaccagcatcttcgagaaggccggcgtgcagcagcccgtgtacgccaccatcggcagcggcatcgtgaacaccgccttcaccgtggtgagcctgttcgtggtggagagagccggcagaagaaccctgcacctgatcggcctggccggcatggccggctgcgccatcctgatgaccatcgccctggccctgctggagcagctgccctggatgagctacctgagcatcgtggccatcttcggcttcgtggccttcttcgaggtgggccccggccccatcccctggttcatcgtggccgagctgttcagccagggccccagacccgccgccatcgccgtggccggcttcagcaactggaccagcaacttcatcgtgggcatgtgcttccagtacgtggagcagctgtgcggcccctacgtgttcatcatcttcaccgtgctgctggtgctgttcttcatcttcaccctgaacggcagcatgcccgagggcggcgactag

SEQ ID NO: 12985 - DNA, 1305 bp, Artificial Sequence
  Description of Artificial Sequence: Synthetic coding sequence
atggagcccagcagcaagaagctgaccggcagactgatgctggccgtgggcggcgccgtgctgggcagcctgcagttcggctacaacaccggcgtgatcaacgccccccagaaggtgatcgaggagttctacaaccagacctgggtgcacagatacggcgagagcatcctgcccaccaccctgaccaccctgtggagcctgagcgtggccatcttcagcgtgggcggcatgatcggcagcttcagcgtgggcctgttcgtgaacagattcggcagaagaaacagcatgctgatgatgaacctgctggccttcgtgcccatgtacgtgggcgaggtgagccccaccgccctgagaggcgccctgggcaccctgcaccagctgggcatcgtggtgggcatcatcatcttcatccccgccctgctgcagtgcatcgtgctgcccttctgccccgagagccccagattcctgctgatcaacagaaacgaggagaacagagccaagagcgtgctgaagaagctgagaggcaccgccgacgtgacccacgacctgcaggagatgaaggaggagagcagacagatgatgagagagaagaaggtgaccatcctggagctgttcagaagccccgcctacagacagcccatcctgatcgccgtggtgctgcagctgagccagcagctgagcggcatcaacgccgtgttctactacagcaccagcatcttcgagaaggccggcgtgcagcagcccgtgtacgccaccatcggcagcggcatcgtgaacaccgccttcaccgtggtgagcctgttcgtggtggagagagccggcagaagaaccctgcacctgatcggcctggccggcatggccggctgcgccatcctgatgaccatcgccctggccctgctggagcagctgccctggatgagctacctgagcatcgtggccatcttcggcttcgtggccttcttcgaggtgggccccggccccatcccctggttcatcgtggccgagctgttcagccagggccccagacccgccgccatcgccgtggccggcttcagcaactggaccagcaacttcatcgtgggcatgtgcttccagtacgtggagcagctgtgcggcccctacgtgttcatcatcttcaccgtgctgctggtgctgttcttcatcttcacctacttcaaggtgcccgagaccaagggcagaaccttcgacgagatcgccagcggcttcagacagggcggcgccagccagagcgacaagacccccgaggagctgttccaccccctgggcgccgacagccaggtgtag

SEQ ID NO: 12986 - DNA, 528 bp, Artificial Sequence
  Description of Artificial Sequence: Synthetic coding sequence
atggagcccagcagcaagaagctgaccggcagactgatgctggccgtgggcggcgccgtgctgggcagcctgcagttcggctacaacaccggcgtgatcaacgccccccagaaggtgatcgaggagttctacaaccagacctgggtgcacagatacggcgagagcatcctgcccaccaccctgaccaccctgtggagcctgagcgtggccatcttcagcgtgggcggcatgatcggcagcttcagcgtgggcctgttcgtgaacagattcggcagaagaaacagcatgctgatgatgaacctgctggccttcgtgagcgccgtgctgatgggcttcagcaagctgggcaaccccaagctggagaccaccgacacccccctgcccaagaagttccccttcagaccccaggccagaaaggtgaccgccgtgcagtgccccttctgcctgagcatctgccccctgcacagcctgctgatcctgggccccaccagcaccgccaccgaggccggcaagggccacaacgtgtag

SEQ ID NO: 12987 - DNA, 1479 bp, Artificial Sequence
  Description of Artificial Sequence: Synthetic coding sequence
atggagcccagcagcaagaagctgaccggcagactgatgctggccgtgggcggcgccgtgctgggcagcctgcagttcggctacaacaccggcgtgatcaacgccccccagaaggtgatcgaggagttctacaaccagacctgggtgcacagatacggcgagagcatcctgcccaccaccctgaccaccctgtggagcctgagcgtggccatcttcagcgtgggcggcatgatcggcagcttcagcgtgggcctgttcgtgaacagattcggcagaagaaacagcatgctgatgatgaacctgctggccttcgtgagcgccgtgctgatgggcttcagcaagctgggcaagagcttcgagatgctgatcctgggcagattcatcatcggcgtgtactgcggcctgaccaccggcttcgtgcccatgtacgtgggcgaggtgagccccaccgccctgagaggcgccctgggcaccctgcaccagctgggcatcgtggtgggcatcctgatcgcccaggtgttcggcctggacagcatcatgggcaacaaggacctgtggcccctgctgctgagcatcatcttcatccccgccctgctgcagtgcatcgtgctgcccttctgccccgagagccccagattcctgctgatcaacagaaacgaggagaacagagccaagagcgtgctgaagaagctgagaggcaccgccgacgtgacccacgacctgcaggagatgaaggaggagagcagacagatgatgagagagaagaaggtgaccatcctggagctgttcagaagccccgcctacagacagcccatcctgatcgccgtggtgctgcagctgagccagcagctgagcggcatcaacgccgtgttctactacagcaccagcatcttcgagaaggccggcgtgcagcagcccgtgtacgccaccatcggcagcggcatcgtgaacaccgccttcaccgtggtgagcctgttcgtggtggagagagccggcagaagaaccctgcacctgatcggcctggccggcatggccggctgcgccatcctgatgaccatcgccctggccctgctggagcagctgccctggatgagctacctgagcatcgtggccatcttcggcttcgtggccttcttcgaggtgggccccggccccatcccctggttcatcgtggccgagctgttcagccagggccccagacccgccgccatcgccgtggccggcttcagcaactggaccagcaacttcatcgtgggcatgtgcttccagtacgtggagcagctgtgcggcccctacgtgttcatcatcttcaccgtgctgctggtgctgttcttcatcttcacctacttcaaggtgcccgagaccaagggcagaaccttcgacgagatcgccagcggcttcagacagggcggcgccagccagagcgacaagacccccgaggagctgttccaccccctgggcgccgacagccaggtgtag

SEQ ID NO: 12988 - DNA, 753 bp, Artificial Sequence
  Description of Artificial Sequence: Synthetic coding sequence
atgctgatgatgaacctgctggccttcgtgagcgccgtgctgatgggcttcagcaagctgggcaagagcttcgagatgctgatcctgggcagattcatcatcggcgtgtactgcggcctgaccaccggcttcgtgcccatgtacgtgggcgaggtgagccccaccgccctgagaggcgccctgggcaccctgcaccagctgggcatcgtggtgggcatcctgatcgcccaggtgttcggcctggacagcatcatgggcaacaaggacctgtggcccctgctgctgagcatcatcttcatccccgccctgctgcagtgcatcgtgctgcccttctgccccgagagccccagattcctgctgatcaacagaaacgaggagaacagagccaagagcgtgctgaagaagctgagaggcaccgccgacgtgacccacgacctgcaggagatgaaggaggagagcagacagatgatgagagagaagaaggtgaccatcctggagctgttcagaagccccgcctacagacagcccatcctgatcgccgtggtgctgcagctgagccagcagctgagcggcatcaacgccgtgttctactacagcaccagcatcttcgagaaggccggcgtgcagcagcccgtgtacgccaccatcggcagcggcatcgtgaacaccgccttcaccgtggtgagcgtgagcctgtgcctgctggccccccccgccaagccccagggcggcggcagcgccatcttcccctag

SEQ ID NO: 12989 - DNA, 1671 bp, Artificial Sequence
  Description of Artificial Sequence: Synthetic coding sequence
atgcccagcttcgacgaggccctgcagagagtgggcgagttcggcagattccagagaagagtgttcctgctgctgtgcctgaccggcgtgaccttcgccttcctgttcgtgggcgtggtgttcctgggcacccagcccgaccactactggtgcagaggccccagcgccgccgccctggccgagagatgcggctggagccccgaggaggagtggaacagaaccgcccccgccagcagaggccccgagccccccgagagaagaggcagatgccagagatacctgctggaggccgccaacgacagcgccagcgccaccagcgccctgagctgcgccgaccccctggccgccttccccaacagaagcgcccccctggtgccctgcagaggcggctggagatacgcccaggcccacagcaccatcgtgagcgagttcgacctggtgtgcgtgaacgcctggatgctggacctgacccaggccatcctgaacctgggcttcctgaccggcgccttcaccctgggctacgccgccgacagatacggcagaatcgtgatctacctgctgagctgcctgggcgtgggcgtgaccggcgtggtggtggccttcgcccccaacttccccgtgttcgtgatcttcagattcctgcagggcgtgttcggcaagggcacctggatgacctgctacgtgatcgtgaccgagatcgtgggcagcaagcagagaagaatcgtgggcatcgtgatccagatgttcttcaccctgggcatcatcatcctgcccggcatcgcctacttcatccccaactggcagggcatccagctggccatcaccctgcccagcttcctgttcctgctgtactactgggtggtgcccgagagccccagatggctgatcaccagaaagaagggcgacaaggccctgcagatcctgagaagaatcgccaagtgcaacggcaagtacctgagcagcaactacagcgagatcaccgtgaccgacgaggaggtgagcaaccccagcttcctggacctggtgagaaccccccagatgagaaagtgcaccctgatcctgatgttcgcctggttcaccagcgccgtggtgtaccagggcctggtgatgagactgggcatcatcggcggcaacctgtacatcgacttcttcatcagcggcgtggtggagctgcccggcgccctgctgatcctgctgaccatcgagagactgggcagaagactgcccttcgccgccagcaacatcgtggccggcgtggcctgcctggtgaccgccttcctgcccgagggcatcgcctggctgagaaccaccgtggccaccctgggcagactgggcatcaccatggccttcgagatcgtgtacctggtgaacagcgagctgtaccccaccaccctgagaaacttcggcgtgagcctgtgcagcggcctgtgcgacttcggcggcatcatcgcccccttcctgctgttcagactggccgccgtgtggctggagctgcccctgatcatcttcggcatcctggccagcatctgcggcggcctggtgatgctgctgcccgagaccaagggcatcgccctgcccgagaccgtggacgacgtggagaagctgggcagcccccacagctgcaagtgcggcagaaacaagaagacccccgtgagcagaagccacctgtag

SEQ ID NO: 12990 - DNA, 1674 bp, Artificial Sequence
  Description of Artificial Sequence: Synthetic coding sequence
atgcccagcttcgacgaggccctgcagagagtgggcgagttcggcagattccagagaagagtgttcctgctgctgtgcctgaccggcgtgaccttcgccttcctgttcgtgggcgtggtgttcctgggcacccagcccgaccactactggtgcagaggccccagcgccgccgccctggccgagagatgcggctggagccccgaggaggagtggaacagaaccgcccccgccagcagaggccccgagccccccgagagaagaggcagatgccagagatacctgctggaggccgccaacgacagcgccagcgccaccagcgccctgagctgcgccgaccccctggccgccttccccaacagaagcgcccccctggtgccctgcagaggcggctggagatacgcccaggcccacagcaccatcgtgagcgagttcgacctggtgtgcgtgaacgcctggatgctggacctgacccaggccatcctgaacctgggcttcctgaccggcgccttcaccctgggctacgccgccgacagatacggcagaatcgtgatctacctgctgagctgcctgggcgtgggcgtgaccggcgtggtggtggccttcgcccccaacttccccgtgttcgtgatcttcagattcctgcagggcgtgttcggcaagggcacctggatgacctgctacgtgatcgtgaccgagatcgtgggcagcaagcagagaagaatcgtgggcatcgtgatccagatgttcttcaccctgggcatcatcatcctgcccggcatcgcctacttcatccccaactggcagggcatccagctggccatcaccctgcccagcttcctgttcctgctgtactactgggtggtgcccgagagccccagatggctgatcaccagaaagaagggcgacaaggccctgcagatcctgagaagaatcgccaagtgcaacggcaagtacctgagcagcaactacagcgagatcaccgtgaccgacgaggaggtgagcaaccccagcttcctggacctggtgagaaccccccagatgagaaagtgcaccctgatcctgatgttcgcctggttcaccagcgccgtggtgtaccagggcctggtgatgagactgggcatcatcggcggcaacctgtacatcgacttcttcatcagcggcgtggtggagctgcccggcgccctgctgatcctgctgaccatcgagagactgggcagaagactgcccttcgccgccagcaacatcgtggccggcgtggcctgcctggtgaccgccttcctgcccgaggccggcatcgcctggctgagaaccaccgtggccaccctgggcagactgggcatcaccatggccttcgagatcgtgtacctggtgaacagcgagctgtaccccaccaccctgagaaacttcggcgtgagcctgtgcagcggcctgtgcgacttcggcggcatcatcgcccccttcctgctgttcagactggccgccgtgtggctggagctgcccctgatcatcttcggcatcctggccagcatctgcggcggcctggtgatgctgctgcccgagaccaagggcatcgccctgcccgagaccgtggacgacgtggagaagctgggcagcccccacagctgcaagtgcggcagaaacaagaagacccccgtgagcagaagccacctgtag

SEQ ID NO: 12991 - DNA, 1017 bp, Artificial Sequence
  Description of Artificial Sequence: Synthetic coding sequence
atggagctgagaagcggcagcgtgggcagccaggccgtggccagaagaatggacggcgacagcagagacggcggcggcggcaaggacgccaccggcagcgaggactacgagaacctgcccaccagcgccagcgtgagcacccacatgaccgccggcgccatggccggcatcctggagcacagcgtgatgtaccccgtggacagcgtgaagaccagaatgcagagcctgagccccgaccccaaggcccagtacaccagcatctacggcgccctgaagaagatcatgagaaccgagggcttctggagacccctgagaggcgtgaacgtgatgatcatgggcgccggccccgcccacgccatgtacttcgcctgctacgagaacatgaagagaaccctgaacgacgtgttccaccaccagggcaacagccacctggccaacggcatcgccggcagcatggccaccctgctgcacgacgccgtgatgaaccccgccgaggtggtgaagcagagactgcagatgtacaacagccagcacagaagcgccatcagctgcatcagaaccgtgtggagaaccgagggcctgggcgccttctacagaagctacaccacccagctgaccatgaacatccccttccagagcatccacttcatcacctacgagttcctgcaggagcaggtgaacccccacagaacctacaacccccagagccacatcatcagcggcggcctggccggcgccctggccgccgccgccaccacccccctggacgtgtgcaagaccctgctgaacacccaggagaacgtggccctgagcctggccaacatcagcggcagactgagcggcatggccaacgccttcagaaccgtgtaccagctgaacggcctggccggctacttcaagggcatccaggccagagtgatctaccagatgcccagcaccgccatcagctggagcgtgtacgagttcttcaagtacttcctgaccaagagacagctggagaacagagccccctactag

SEQ ID NO: 12992 - DNA, 2268 bp, Artificial Sequence
  Description of Artificial Sequence: Synthetic coding sequence
atggccagaaagctgagcgtgatcctgatcctgaccttcgccctgagcgtgaccaaccccctgcacgagctgaaggccgccgccttcccccagaccaccgagaagatcagccccaactgggagagcggcatcaacgtggacctggccatcagcaccagacagtaccacctgcagcagctgttctacagatacggcgagaacaacagcctgagcgtggagggcttcagaaagctgctgcagaacatcggcatcgacaagatcaagagaatccacatccaccacgaccacgaccaccacagcgaccacgagcaccacagcgaccacgagagacacagcgaccacgagcaccacagcgagcacgagcaccacagcgaccacgaccaccacagccaccacaaccacgccgccagcggcaagaacaagagaaaggccctgtgccccgaccacgacagcgacagcagcggcaaggaccccagaaacagccagggcaagggcgcccacagacccgagcacgccagcggcagaagaaacgtgaaggacagcgtgagcgccagcgaggtgaccagcaccgtgtacaacaccgtgagcgagggcacccacttcctggagaccatcgagacccccagacccggcaagctgttccccaaggacgtgagcagcagcaccccccccagcgtgaccagcaagagcagagtgagcagactggccggcagaaagaccaacgagagcgtgagcgagcccagaaagggcttcatgtacagcagaaacaccaacgagaacccccaggagtgcttcaacgccagcaagctgctgaccagccacggcatgggcatccaggtgcccctgaacgccaccgagttcaactacctgtgccccgccatcatcaaccagatcgacgccagaagctgcctgatccacaccagcgagaagaaggccgagatcccccccaagacctacagcctgcagatcgcctgggtgggcggcttcatcgccatcagcatcatcagcttcctgagcctgctgggcgtgatcctggtgcccctgatgaacagagtgttcttcaagttcctgctgagcttcctggtggccctggccgtgggcaccctgagcggcgacgccttcctgcacctgctgccccacagccacgccagccaccaccacagccacagccacgaggagcccgccatggagatgaagagaggccccctgttcagccacctgagcagccagaacatcgaggagagcgcctacttcgacagcacctggaagggcctgaccgccctgggcggcctgtacttcatgttcctggtggagcacgtgctgaccctgatcaagcagttcaaggacaagaagaagaagaaccagaagaagcccgagaacgacgacgacgtggagatcaagaagcagctgagcaagtacgagagccagctgagcaccaacgaggagaaggtggacaccgacgacagaaccgagggctacctgagagccgacagccaggagcccagccacttcgacagccagcagcccgccgtgctggaggaggaggaggtgatgatcgcccacgcccacccccaggaggtgtacaacgagtacgtgcccagaggctgcaagaacaagtgccacagccacttccacgacaccctgggccagagcgacgacctgatccaccaccaccacgactaccaccacatcctgcaccaccaccaccaccagaaccaccacccccacagccacagccagagatacagcagagaggagctgaaggacgccggcgtggccaccctggcctggatggtgatcatgggcgacggcctgcacaacttcagcgacggcctggccatcggcgccgccttcaccgagggcctgagcagcggcctgagcaccagcgtggccgtgttctgccacgagctgccccacgagctgggcgacttcgccgtgctgctgaaggccggcatgaccgtgaagcaggccgtgctgtacaacgccctgagcgccatgctggcctacctgggcatggccaccggcatcttcatcggccactacgccgagaacgtgagcatgtggatcttcgccctgaccgccggcctgttcatgtacgtggccctggtggacatggtgcccgagatgctgcacaacgacgccagcgaccacggctgcagcagatggggctacttcttcctgcagaacgccggcatgctgctgggcttcggcatcatgctgctgatcagcatcttcgagcacaagatcgtgttcagaatcaacttctag

SEQ ID NO: 12993 - DNA, 1302 bp, Artificial Sequence
  Description of Artificial Sequence: Synthetic coding sequence
atgggcatccaggtgcccctgaacgccaccgagttcaactacctgtgccccgccatcatcaaccagatcgacgccagaagctgcctgatccacaccagcgagaagaaggccgagatcccccccaagacctacagcctgcagatcgcctgggtgggcggcttcatcgccatcagcatcatcagcttcctgagcctgctgggcgtgatcctggtgcccctgatgaacagagtgttcttcaagttcctgctgagcttcctggtggccctggccgtgggcaccctgagcggcgacgccttcctgcacctgctgccccacagccacgccagccaccaccacagccacagccacgaggagcccgccatggagatgaagagaggccccctgttcagccacctgagcagccagaacatcgaggagagcgcctacttcgacagcacctggaagggcctgaccgccctgggcggcctgtacttcatgttcctggtggagcacgtgctgaccctgatcaagcagttcaaggacaagaagaagaagaaccagaagaagcccgagaacgacgacgacgtggagatcaagaagcagctgagcaagtacgagagccagctgagcaccaacgaggagaaggtggacaccgacgacagaaccgagggctacctgagagccgacagccaggagcccagccacttcgacagccagcagcccgccgtgctggaggaggaggaggtgatgatcgcccacgcccacccccaggaggtgtacaacgagtacgtgcccagaggctgcaagaacaagtgccacagccacttccacgacaccctgggccagagcgacgacctgatccaccaccaccacgactaccaccacatcctgcaccaccaccaccaccagaaccaccacccccacagccacagccagagatacagcagagaggagctgaaggacgccggcgtggccaccctggcctggatggtgatcatgggcgacggcctgcacaacttcagcgacggcctggccatcggcgccgccttcaccgagggcctgagcagcggcctgagcaccagcgtggccgtgttctgccacgagctgccccacgagctgggcgacttcgccgtgctgctgaaggccggcatgaccgtgaagcaggccgtgctgtacaacgccctgagcgccatgctggcctacctgggcatggccaccggcatcttcatcggccactacgccgagaacgtgagcatgtggatcttcgccctgaccgccggcctgttcatgtacgtggccctggtggacatggtgagcttctag

SEQ ID NO: 12994 - DNA, 1233 bp, Artificial Sequence
  Description of Artificial Sequence: Synthetic coding sequence
atgggcatccaggtgcccctgaacgccaccgagttcaactacctgtgccccgccatcatcaaccagatcgacgccagaagctgcctgatccacaccagcgagaagaaggccgagatcccccccaagacctacagcctgcagatcgcctgggtgggcggcttcatcgccatcagcatcatcagcttcctgagcctgctgggcgtgatcctggtgcccctgatgaacagagtgttcttcaagttcctgctgagcttcctggtggccctggccgtgggcaccctgagcggcgacgccttcctgcacctgctgccccacagccacgccagccaccaccacagccacagccacgaggagcccgccatggagatgaagagaggccccctgttcagccacctgagcagccagaacatcgaggagagcgcctacttcgacagcacctggaagggcctgaccgccctgggcggcctgtacttcatgttcctggtggagcacgtgctgaccctgatcaagcagttcaaggacaagaagaagaagaaccagaagaagcccgagaacgacgacgacgtggagatcaagaagcagctgagcaagtacgagagccagctgagcaccaacgaggagaaggtggacaccgacgacagaaccgagggctacctgagagccgacagccaggagcccagccacttcgacagccagcagcccgccgtgctggaggaggaggaggtgatgatcgcccacgcccacccccaggaggtgtacaacgagtacgtgcccagaggctgcaagaacaagtgccacagccacttccacgacaccctgggccagagcgacgacctgatccaccaccaccacgactaccaccacatcctgcaccaccaccaccaccagaaccaccacccccacagccacagccagagatacagcagagaggagctgaaggacgccggcgtggccaccctggcctggatggtgatcatgggcgacggcctgcacaacttcagcgacggcctggccatcggcgccgccttcaccgagggcctgagcagcggcctgagcaccagcgtggccctggtggacatggtgcccgagatgctgcacaacgacgccagcgaccacggctgcagcagatggggctacttcttcctgcagaacgccggcatgctgctgggcttcggcatcatgctgctgatcagcatcttcgagcacaagatcgtgttcagaatcaacttctag

SEQ ID NO: 12995 - DNA, 1833 bp, Artificial Sequence
  Description of Artificial Sequence: Synthetic coding sequence
atggacacccccagaggcatcggcaccttcgtggtgtgggactacgtggtgttcgccggcatgctggtgatcagcgccgccatcggcatctactacgccttcgccggcggcggccagcagaccagcaaggacttcctgatgggcggcagaagaatgaccgccgtgcccgtggccctgagcctgaccgccagcttcatgagcgccgtgaccgtgctgggcacccccagcgaggtgtacagattcggcgccatcttcagcatcttcgccttcacctacttcttcgtggtggtgatcagcgccgaggtgttcctgcccgtgttctacaagctgggcatcaccagcacctacgagtacctggagctgagattcaacaagtgcgtgagactgtgcggcaccgtgctgttcatcgtgcagaccatcctgtacaccggcatcgtgatctacgcccccgccctggccctgaaccaggtgaccggcttcgacctgtggggcgccgtggtggccaccggcgtggtgtgcaccttctactgcaccctgggcggcctgaaggccgtgatctggaccgacgtgttccaggtgggcatcatggtggccggcttcgccagcgtgatcatccaggccgtggtgatgcagggcggcatcagcaccatcctgaacgacgcctacgacggcggcagactgaacttctggaacttcaaccccaaccccctgcagagacacaccttctggaccatcatcatcggcggcaccttcacctggaccagcatctacggcgtgaaccagagccaggtgcagagatacatcagctgcaagagcagattccaggccaagctgagcctgtacatcaacctggtgggcctgtgggccatcctgacctgcagcgtgttctgcggcctggccctgtacagcagataccacgactgcgacccctggaccgccaagaaggtgagcgcccccgaccagctgatgccctacctggtgctggacatcctgcaggactaccccggcctgcccggcctgttcgtggcctgcgcctacagcggcaccctgagcaccgtgagcagcagcatcaacgccctggccgccgtgaccgtggaggacctgatcaagccctacttcagaagcctgagcgagagaagcctgagctggatcagccagggcatgagcgtggtgtacggcgccctgtgcatcggcatggccgccctggccagcctgatgggcgccctgctgcaggccgccctgagcgtgttcggcatggtgggcggccccctgatgggcctgttcgccctgggcatcctggtgcccttcgccaacagcatcggcgccctggtgggcctgatggccggcttcgccatcagcctgtgggtgggcatcggcgcccagatctacccccccctgcccgagagaaccctgcccctgcacctggacatccagggctgcaacagcacctacaacgagaccaacctgatgaccaccaccgagatgcccttcaccaccagcgtgttccagatctacaacgtgcagagaacccccctgatggacaactggtacagcctgagctacctgtacttcagcaccgtgggcaccctggtgaccctgctggtgggcatcctggtgagcctgagcaccggcggcagaaagcagaacctggaccccagatacatcctgaccaaggaggacttcctgagcaacttcgacatcttcaagaagaagaagcacgtgctgagctacaagagccaccccgtggaggacggcggcaccgacaaccccgccttcaaccacatcgagctgaacagcgaccagagcggcaagagcaacggcaccagactgtag

SEQ ID NO: 12996 - DNA, 1071 bp, Artificial Sequence
  Description of Artificial Sequence: Synthetic coding sequence
atggacatggccgacgagcccctgaacggcagccacacctggctgagcatccccttcgacctgaacggcagcgtggtgagcaccaacaccagcaaccagaccgagccctactacgacctgaccagcaacgccgtgctgaccttcatctacttcgtggtgtgcatcatcggcctgtgcggcaacaccctggtgatctacgtgatcctgagatacgccaagatgaagaccatcaccaacatctacatcctgaacctggccatcgccgacgagctgttcatgctgggcctgcccttcctggccatgcaggtggccctggtgcactggcccttcggcaaggccatctgcagagtggtgatgaccgtggacggcatcaaccagttcaccagcatcttctgcctgaccgtgatgagcatcgacagatacctggccgtggtgcaccccatcaagagcgccaagtggagaagacccagaaccgccaagatgatcaccatggccgtgtggggcgtgagcctgctggtgatcctgcccatcatgatctacgccggcctgagaagcaaccagtggggcagaagcagctgcaccatcaactggcccggcgagagcggcgcctggtacaccggcttcatcatctacaccttcatcctgggcttcctggtgcccctgaccatcatctgcctgtgctacctgttcatcatcatcaaggtgaagagcagcggcatcagagtgggcagcagcaagagaaagaagagcgagaagaaggtgaccagaatggtgagcatcgtggtggccgtgttcatcttctgctggctgcccttctacatcttcaacgtgagcagcgtgagcatggccatcagccccacccccgccctgaagggcatgttcgacttcgtggtggtgctgacctacgccaacagctgcgccaaccccatcctgtacgccttcctgagcgacaacttcaagaagagcttccagaacgtgctgtgcctggtgaaggtggacaacagcaagagcggcgaggagggcagctgcctggacatgatcttcagaaacaacaagaacagaaagaagtag

SEQ ID NO: 12997 - DNA, 1110 bp, Artificial Sequence
  Description of Artificial Sequence: Synthetic coding sequence
atggacatggccgacgagcccctgaacggcagccacacctggctgagcatccccttcgacctgaacggcagcgtggtgagcaccaacaccagcaaccagaccgagccctactacgacctgaccagcaacgccgtgctgaccttcatctacttcgtggtgtgcatcatcggcctgtgcggcaacaccctggtgatctacgtgatcctgagatacgccaagatgaagaccatcaccaacatctacatcctgaacctggccatcgccgacgagctgttcatgctgggcctgcccttcctggccatgcaggtggccctggtgcactggcccttcggcaaggccatctgcagagtggtgatgaccgtggacggcatcaaccagttcaccagcatcttctgcctgaccgtgatgagcatcgacagatacctggccgtggtgcaccccatcaagagcgccaagtggagaagacccagaaccgccaagatgatcaccatggccgtgtggggcgtgagcctgctggtgatcctgcccatcatgatctacgccggcctgagaagcaaccagtggggcagaagcagctgcaccatcaactggcccggcgagagcggcgcctggtacaccggcttcatcatctacaccttcatcctgggcttcctggtgcccctgaccatcatctgcctgtgctacctgttcatcatcatcaaggtgaagagcagcggcatcagagtgggcagcagcaagagaaagaagagcgagaagaaggtgaccagaatggtgagcatcgtggtggccgtgttcatcttctgctggctgcccttctacatcttcaacgtgagcagcgtgagcatggccatcagccccacccccgccctgaagggcatgttcgacttcgtggtggtgctgacctacgccaacagctgcgccaaccccatcctgtacgccttcctgagcgacaacttcaagaagagcttccagaacgtgctgtgcctggtgaaggtgagcggcaccgacgacggcgagagaagcgacagcaagcaggacaagagcagactgaacgagaccaccgagacccagagaaccctgctgaacggcgacctgcagaccagcatctag

SEQ ID NO: 12998 - DNA, 3315 bp, Artificial Sequence
  Description of Artificial Sequence: Synthetic coding sequence
atgcaggcccagcagctgccctacgagttcttcagcgaggagaacgcccccaagtggagaggcctgctggtgcccgccctgaagaaggtgcagggccaggtgcaccccaccctggagagcaacgacgacgccctgcagtacgtggaggagctgatcctgcagctgctgaacatgctgtgccaggcccagcccagaagcgccagcgacgtggaggagagagtgcagaagagcttcccccaccccatcgacaagtgggccatcgccgacgcccagagcgccatcgagaagagaaagagaagaaaccccctgagcctgcccgtggagaagatccaccccctgctgaaggaggtgctgggctacaagatcgaccaccaggtgagcgtgtacatcgtggccgtgctggagtacatcagcgccgacatcctgaagctggtgggcaactacgtgagaaacatcagacactacgagatcaccaagcaggacatcaaggtggccatgtgcgccgacaaggtgctgatggacatgttccaccaggacgtggaggacatcaacatcctgagcctgaccgacgaggagcccagcaccagcggcgagcagacctactacgacctggtgaaggccttcatggccgagatcagacagtacatcagagagctgaacctgatcatcaaggtgttcagagagcccttcgtgagcaacagcaagctgttcagcgccaacgacgtggagaacatcttcagcagaatcgtggacatccacgagctgagcgtgaagctgctgggccacatcgaggacaccgtggagatgaccgacgagggcagcccccaccccctggtgggcagctgcttcgaggacctggccgaggagctggccttcgacccctacgagagctacgccagagacatcctgagacccggcttccacgacagattcctgagccagctgagcaagcccggcgccgccctgtacctgcagagcatcggcgagggcttcaaggaggccgtgcagtacgtgctgcccagactgctgctggcccccgtgtaccactgcctgcactacttcgagctgctgaagcagctggaggagaagagcgaggaccaggaggacaaggagtgcctgaagcaggccatcaccgccctgctgaacgtgcagagcggcatggagaagatctgcagcaagagcctggccaagagaagactgagcgagagcgcctgcagattctacagccagcagatgaagggcaagcagctggccatcaagaagatgaacgagatccagaagaacatcgacggctgggagggcaaggacatcggccagtgctgcaacgagttcatcatggagggcaccctgaccagagtgggcgccaagcacgagagacacatcttcctgttcgacggcctgatgatctgctgcaagagcaaccacggccagcccagactgcccggcgccagcaacgccgagtacagactgaaggagaagttcttcatgagaaaggtgcagatcaacgacaaggacgacaccaacgagtacaagcacgccttcgagatcatcctgaaggacgagaacagcgtgatcttcagcgccaagagcgccgaggagaagaacaactggatggccgccctgatcagcctgcagtacagaagcaccctggagagaatgctggacgtgaccatgctgcaggaggagaaggaggagcagatgagactgcccagcgccgacgtgtacagattcgccgagcccgacagcgaggagaacatcatcttcgaggagaacatgcagcccaaggccggcatccccatcatcaaggccggcaccgtgatcaagctgatcgagagactgacctaccacatgtacgccgaccccaacttcgtgagaaccttcctgaccacctacagaagcttctgcaagccccaggagctgctgagcctgatcatcgagagattcgagatccccgagcccgagcccaccgaggccgacagaatcgccatcgagaacggcgaccagcccctgagcgccgagctgaagagattcagaaaggagtacatccagcccgtgcagctgagagtgctgaacgtgtgcagacactgggtggagcaccacttctacgacttcgagagagacgcctacctgctgcagagaatggaggagttcatcggcaccgtgagaggcaaggccatgaagaagtgggtggagagcatcaccaagatcatccagagaaagaagatcgccagagacaacggccccggccacaacatcaccttccagagcagcccccccaccgtggagtggcacatcagcagacccggccacatcgagaccttcgacctgctgaccctgcaccccatcgagatcgccagacagctgaccctgctggagagcgacctgtacagagccgtgcagcccagcgagctggtgggcagcgtgtggaccaaggaggacaaggagatcaacagccccaacctgctgaagatgatcagacacaccaccaacctgaccctgtggttcgagaagtgcatcgtggagaccgagaacctggaggagagagtggccgtggtgagcagaatcatcgagatcctgcaggtgttccaggagctgaacaacttcaacggcgtgctggaggtggtgagcgccatgaacagcagccccgtgtacagactggaccacaccttcgagcagatccccagcagacagaagaagatcctggaggaggcccacgagctgagcgaggaccactacaagaagtacctggccaagctgagaagcatcaaccccccctgcgtgcccttcttcggcatctacctgaccaacatcctgaagaccgaggagggcaaccccgaggtgctgaagagacacggcaaggagctgatcaacttcagcaagagaagaaaggtggccgagatcaccggcgagatccagcagtaccagaaccagccctactgcctgagagtggagagcgacatcaagagattcttcgagaacctgaaccccatgggcaacagcatggagaaggagttcaccgactacctgttcaacaagagcctggagatcgagcccagaaaccccaagcccctgcccagattccccaagaagtacagctaccccctgaagagccccggcgtgagacccagcaaccccagacccggcaccatgagacaccccacccccctgcagcaggagcccagaaagatcagctacagcagaatccccgagagcgagaccgagagcaccgccagcgcccccaacagccccaacaccgtgaacaccagcgcctgcttctggtgcttccagtaccacagatgcctgcagtgcatctag

SEQ ID NO: 12999 - DNA, 3957 bp, Artificial Sequence
  Description of Artificial Sequence: Synthetic coding sequence
atgcaggcccagcagctgccctacgagttcttcagcgaggagaacgcccccaagtggagaggcctgctggtgcccgccctgaagaaggtgcagggccaggtgcaccccaccctggagagcaacgacgacgccctgcagtacgtggaggagctgatcctgcagctgctgaacatgctgtgccaggcccagcccagaagcgccagcgacgtggaggagagagtgcagaagagcttcccccaccccatcgacaagtgggccatcgccgacgcccagagcgccatcgagaagagaaagagaagaaaccccctgagcctgcccgtggagaagatccaccccctgctgaaggaggtgctgggctacaagatcgaccaccaggtgagcgtgtacatcgtggccgtgctggagtacatcagcgccgacatcctgaagctggtgggcaactacgtgagaaacatcagacactacgagatcaccaagcaggacatcaaggtggccatgtgcgccgacaaggtgctgatggacatgttccaccaggacgtggaggacatcaacatcctgagcctgaccgacgaggagcccagcaccagcggcgagcagacctactacgacctggtgaaggccttcatggccgagatcagacagtacatcagagagctgaacctgatcatcaaggtgttcagagagcccttcgtgagcaacagcaagctgttcagcgccaacgacgtggagaacatcttcagcagaatcgtggacatccacgagctgagcgtgaagctgctgggccacatcgaggacaccgtggagatgaccgacgagggcagcccccaccccctggtgggcagctgcttcgaggacctggccgaggagctggccttcgacccctacgagagctacgccagagacatcctgagacccggcttccacgacagattcctgagccagctgagcaagcccggcgccgccctgtacctgcagagcatcggcgagggcttcaaggaggccgtgcagtacgtgctgcccagactgctgctggcccccgtgtaccactgcctgcactacttcgagctgctgaagcagctggaggagaagagcgaggaccaggaggacaaggagtgcctgaagcaggccatcaccgccctgctgaacgtgcagagcggcatggagaagatctgcagcaagagcctggccaagagaagactgagcgagagcgcctgcagattctacagccagcagatgaagggcaagcagctggccatcaagaagatgaacgagatccagaagaacatcgacggctgggagggcaaggacatcggccagtgctgcaacgagttcatcatggagggcaccctgaccagagtgggcgccaagcacgagagacacatcttcctgttcgacggcctgatgatctgctgcaagagcaaccacggccagcccagactgcccggcgccagcaacgccgagtacagactgaaggagaagttcttcatgagaaaggtgcagatcaacgacaaggacgacaccaacgagtacaagcacgccttcgagatcatcctgaaggacgagaacagcgtgatcttcagcgccaagagcgccgaggagaagaacaactggatggccgccctgatcagcctgcagtacagaagcaccctggagagaatgctggacgtgaccatgctgcaggaggagaaggaggagcagatgagactgcccagcgccgacgtgtacagattcgccgagcccgacagcgaggagaacatcatcttcgaggagaacatgcagcccaaggccggcatccccatcatcaaggccggcaccgtgatcaagctgatcgagagactgacctaccacatgtacgccgaccccaacttcgtgagaaccttcctgaccacctacagaagcttctgcaagccccaggagctgctgagcctgatcatcgagagattcgagatccccgagcccgagcccaccgaggccgacagaatcgccatcgagaacggcgaccagcccctgagcgccgagctgaagagattcagaaaggagtacatccagcccgtgcagctgagagtgctgaacgtgtgcagacactgggtggagcaccacttctacgacttcgagagagacgcctacctgctgcagagaatggaggagttcatcggcaccgtgagaggcaaggccatgaagaagtgggtggagagcatcaccaagatcatccagagaaagaagatcgccagagacaacggccccggccacaacatcaccttccagagcagcccccccaccgtggagtggcacatcagcagacccggccacatcgagaccttcgacctgctgaccctgcaccccatcgagatcgccagacagctgaccctgctggagagcgacctgtacagagccgtgcagcccagcgagctggtgggcagcgtgtggaccaaggaggacaaggagatcaacagccccaacctgctgaagatgatcagacacaccaccaacctgaccctgtggttcgagaagtgcatcgtggagaccgagaacctggaggagagagtggccgtggtgagcagaatcatcgagatcctgcaggtgttccaggagctgaacaacttcaacggcgtgctggaggtggtgagcgccatgaacagcagccccgtgtacagactggaccacaccttcgagcagatccccagcagacagaagaagatcctggaggaggcccacgagctgagcgaggaccactacaagaagtacctggccaagctgagaagcatcaaccccccctgcgtgcccttcttcggcatctacctgaccaacatcctgaagaccgaggagggcaaccccgaggtgctgaagagacacggcaaggagctgatcaacttcagcaagagaagaaaggtggccgagatcaccggcgagatccagcagtaccagaaccagccctactgcctgagagtggagagcgacatcaagagattcttcgagaacctgaaccccatgggcaacagcatggagaaggagttcaccgactacctgttcaacaagagcctggagatcgagcccagaaaccccaagcccctgcccagattccccaagaagtacagctaccccctgaagagccccggcgtgagacccagcaaccccagacccggcaccatgagacaccccacccccctgcagcaggagcccagaaagatcagctacagcagaatccccgagagcgagaccgagagcaccgccagcgcccccaacagccccagaacccccctgacccccccccccgccagcggcgccagcagcaccaccgacgtgtgcagcgtgttcgacagcgaccacagcagccccttccacagcagaagcgccagcgtgagcagcatcagcctgaccaagggcaccgacgaggtgcccgtgcccccccccgtgccccccagaagaagacccgagagcgcccccgccgagagcagccccagcaagatcatgagcaagcacctggacagcccccccgccatcccccccagacagcccaccagcaaggcctacagccccagatacagcatcagcgacagaaccagcatcagcgacccccccgagagcccccccctgctgccccccagagagcccgtgagaacccccgacgtgttcagcagcagccccctgcacctgcagcccccccccctgggcaagaagagcgaccacggcaacgccttcttccccaacagccccagccccttcacccccccccccccccagacccccagcccccacggcaccagaagacacctgcccagcccccccctgacccaggaggtggacctgcacagcatcgccggcccccccgtgccccccagacagagcaccagccagcacatccccaagctgccccccaagacctacaagagagagcacacccaccccagcatgcacagagacggcccccccctgctggagaacgcccacagcagctag

SEQ ID NO: 13000 - DNA, 4002 bp, Artificial Sequence
  Description of Artificial Sequence: Synthetic coding sequence
atgcaggcccagcagctgccctacgagttcttcagcgaggagaacgcccccaagtggagaggcctgctggtgcccgccctgaagaaggtgcagggccaggtgcaccccaccctggagagcaacgacgacgccctgcagtacgtggaggagctgatcctgcagctgctgaacatgctgtgccaggcccagcccagaagcgccagcgacgtggaggagagagtgcagaagagcttcccccaccccatcgacaagtgggccatcgccgacgcccagagcgccatcgagaagagaaagagaagaaaccccctgagcctgcccgtggagaagatccaccccctgctgaaggaggtgctgggctacaagatcgaccaccaggtgagcgtgtacatcgtggccgtgctggagtacatcagcgccgacatcctgaagctggtgggcaactacgtgagaaacatcagacactacgagatcaccaagcaggacatcaaggtggccatgtgcgccgacaaggtgctgatggacatgttccaccaggacgtggaggacatcaacatcctgagcctgaccgacgaggagcccagcaccagcggcgagcagacctactacgacctggtgaaggccttcatggccgagatcagacagtacatcagagagctgaacctgatcatcaaggtgttcagagagcccttcgtgagcaacagcaagctgttcagcgccaacgacgtggagaacatcttcagcagaatcgtggacatccacgagctgagcgtgaagctgctgggccacatcgaggacaccgtggagatgaccgacgagggcagcccccaccccctggtgggcagctgcttcgaggacctggccgaggagctggccttcgacccctacgagagctacgccagagacatcctgagacccggcttccacgacagattcctgagccagctgagcaagcccggcgccgccctgtacctgcagagcatcggcgagggcttcaaggaggccgtgcagtacgtgctgcccagactgctgctggcccccgtgtaccactgcctgcactacttcgagctgctgaagcagctggaggagaagagcgaggaccaggaggacaaggagtgcctgaagcaggccatcaccgccctgctgaacgtgcagagcggcatggagaagatctgcagcaagagcctggccaagagaagactgagcgagagcgcctgcagattctacagccagcagatgaagggcaagcagctggccatcaagaagatgaacgagatccagaagaacatcgacggctgggagggcaaggacatcggccagtgctgcaacgagttcatcatggagggcaccctgaccagagtgggcgccaagcacgagagacacatcttcctgttcgacggcctgatgatctgctgcaagagcaaccacggccagcccagactgcccggcgccagcaacgccgagtacagactgaaggagaagttcttcatgagaaaggtgcagatcaacgacaaggacgacaccaacgagtacaagcacgccttcgagatcatcctgaaggacgagaacagcgtgatcttcagcgccaagagcgccgaggagaagaacaactggatggccgccctgatcagcctgcagtacagaagcaccctggagagaatgctggacgtgaccatgctgcaggaggagaaggaggagcagatgagactgcccagcgccgacgtgtacagattcgccgagcccgacagcgaggagaacatcatcttcgaggagaacatgcagcccaaggccggcatccccatcatcaaggccggcaccgtgatcaagctgatcgagagactgacctaccacatgtacgccgaccccaacttcgtgagaaccttcctgaccacctacagaagcttctgcaagccccaggagctgctgagcctgatcatcgagagattcgagatccccgagcccgagcccaccgaggccgacagaatcgccatcgagaacggcgaccagcccctgagcgccgagctgaagagattcagaaaggagtacatccagcccgtgcagctgagagtgctgaacgtgtgcagacactgggtggagcaccacttctacgacttcgagagagacgcctacctgctgcagagaatggaggagttcatcggcaccgtgagaggcaaggccatgaagaagtgggtggagagcatcaccaagatcatccagagaaagaagatcgccagagacaacggccccggccacaacatcaccttccagagcagcccccccaccgtggagtggcacatcagcagacccggccacatcgagaccttcgacctgctgaccctgcaccccatcgagatcgccagacagctgaccctgctggagagcgacctgtacagagccgtgcagcccagcgagctggtgggcagcgtgtggaccaaggaggacaaggagatcaacagccccaacctgctgaagatgatcagacacaccaccaacctgaccctgtggttcgagaagtgcatcgtggagaccgagaacctggaggagagagtggccgtggtgagcagaatcatcgagatcctgcaggtgttccaggagctgaacaacttcaacggcgtgctggaggtggtgagcgccatgaacagcagccccgtgtacagactggaccacaccttcgagcagatccccagcagacagaagaagatcctggaggaggcccacgagctgagcgaggaccactacaagaagtacctggccaagctgagaagcatcaaccccccctgcgtgcccttcttcggcatctacctgaccaacatcctgaagaccgaggagggcaaccccgaggtgctgaagagacacggcaaggagctgatcaacttcagcaagagaagaaaggtggccgagatcaccggcgagatccagcagtaccagaaccagccctactgcctgagagtggagagcgacatcaagagattcttcgagaacctgaaccccatgggcaacagcatggagaaggagttcaccgactacctgttcaacaagagcctggagatcgagcccagaaaccccaagcccctgcccagattccccaagaagtacagctaccccctgaagagccccggcgtgagacccagcaaccccagacccggcaccatgagacaccccacccccctgcagcaggagcccagaaagatcagctacagcagaatccccgagagcgagaccgagagcaccgccagcgcccccaacagccccagaacccccctgacccccccccccgccagcggcgccagcagcaccaccgacgtgtgcagcgtgttcgacagcgaccacagcagccccttccacagcagcaacgacaccgtgttcatccaggtgaccctgccccacggccccagaagcgccagcgtgagcagcatcagcctgaccaagggcaccgacgaggtgcccgtgcccccccccgtgccccccagaagaagacccgagagcgcccccgccgagagcagccccagcaagatcatgagcaagcacctggacagcccccccgccatcccccccagacagcccaccagcaaggcctacagccccagatacagcatcagcgacagaaccagcatcagcgacccccccgagagcccccccctgctgccccccagagagcccgtgagaacccccgacgtgttcagcagcagccccctgcacctgcagcccccccccctgggcaagaagagcgaccacggcaacgccttcttccccaacagccccagccccttcacccccccccccccccagacccccagcccccacggcaccagaagacacctgcccagcccccccctgacccaggaggtggacctgcacagcatcgccggcccccccgtgccccccagacagagcaccagccagcacatccccaagctgccccccaagacctacaagagagagcacacccaccccagcatgcacagagacggcccccccctgctggagaacgcccacagcagctag

SEQ ID NO: 13001 - DNA, 4002 bp, Artificial Sequence; identical to SEQ ID NO: 13000
  Description of Artificial Sequence: Synthetic coding sequence

SEQ ID NO: 13002 - DNA, 945 bp, Artificial Sequence
  Description of Artificial Sequence: Synthetic coding sequence
atgctgtgccaggcccagcccagaagcgccagcgacgtggaggagagagtgcagaagagcttcccccaccccatcgacaagtgggccatcgccgacgcccagagcgccatcgagaagagaaagagaagaaaccccctgagcctgcccgtggagaagatccaccccctgctgaaggaggtgctgggctacaagatcgaccaccaggtgagcgtgtacatcgtggccgtgctggagtacatcagcgccgacatcctgaagctggtgggcaactacgtgagaaacatcagacactacgagatcaccaagcaggacatcaaggtggccatgtgcgccgacaaggtgctgatggacatgttccaccaggacgtggaggacatcaacatcctgagcctgaccgacgaggagcccagcaccagcggcgagcagacctactacgacctggtgaaggccttcatggccgagatcagacagtacatcagagagctgaacctgatcatcaaggtgttcagagagcccttcgtgagcaacagcaagctgttcagcgccaacgacgtggagaacatcttcagcagaatcgtggacatccacgagctgagcgtgaagctgctgggccacatcgaggacaccgtggagatgaccgacgagggcagcccccaccccctggtgggcagctgcttcgaggacctggccgaggagctggccttcgacccctacgagagctacgccagagacatcctgagacccggcttccacgacagattcctgagccagctgagcaagcccggcgccgccctgtacctgcagagcatcggcgagggcttcaaggaggccgtgcagtacgtgctgcccagactgctgctggcccccgtgtaccactgcctgcactacttcgagctgctgaagttccccttcggcgacctgagcagactgagagacagcgtgtag

SEQ ID NO: 13003 - DNA, 3153 bp, Artificial Sequence
  Description of Artificial Sequence: Synthetic coding sequence
atgaccgacgagggcagcccccaccccctggtgggcagctgcttcgaggacctggccgaggagctggccttcgacccctacgagagctacgccagagacatcctgagacccggcttccacgacagattcctgagccagctgagcaagcccggcgccgccctgtacctgcagagcatcggcgagggcttcaaggaggccgtgcagtacgtgctgcccagactgctgctggcccccgtgtaccactgcctgcactacttcgagctgctgaagcagctggaggagaagagcgaggaccaggaggacaaggagtgcctgaagcaggccatcaccgccctgctgaacgtgcagagcggcatggagaagatctgcagcaagagcctggccaagagaagactgagcgagagcgcctgcagattctacagccagcagatgaagggcaagcagctggccatcaagaagatgaacgagatccagaagaacatcgacggctgggagggcaaggacatcggccagtgctgcaacgagttcatcatggagggcaccctgaccagagtgggcgccaagcacgagagacacatcttcctgttcgacggcctgatgatctgctgcaagagcaaccacggccagcccagactgcccggcgccagcaacgccgagtacagactgaaggagaagttcttcatgagaaaggtgcagatcaacgacaaggacgacaccaacgagtacaagcacgccttcgagatcatcctgaaggacgagaacagcgtgatcttcagcgccaagagcgccgaggagaagaacaactggatggccgccctgatcagcctgcagtacagaagcaccctggagagaatgctggacgtgaccatgctgcaggaggagaaggaggagcagatgagactgcccagcgccgacgtgtacagattcgccgagcccgacagcgaggagaacatcatcttcgaggagaacatgcagcccaaggccggcatccccatcatcaaggccggcaccgtgatcaagctgatcgagagactgacctaccacatgtacgccgaccccaacttcgtgagaaccttcctgaccacctacagaagcttctgcaagccccaggagctgctgagcctgatcatcgagagattcgagatccccgagcccgagcccaccgaggccgacagaatcgccatcgagaacggcgaccagcccctgagcgccgagctgaagagattcagaaaggagtacatccagcccgtgcagctgagagtgctgaacgtgtgcagacactgggtggagcaccacttctacgacttcgagagagacgcctacctgctgcagagaatggaggagttcatcggcaccgtgagaggcaaggccatgaagaagtgggtggagagcatcaccaagatcatccagagaaagaagatcgccagagacaacggccccggccacaacatcaccttccagagcagcccccccaccgtggagtggcacatcagcagacccggccacatcgagaccttcgacctgctgaccctgcaccccatcgagatcgccagacagctgaccctgctggagagcgacctgtacagagccgtgcagcccagcgagctggtgggcagcgtgtggaccaaggaggacaaggagatcaacagccccaacctgctgaagatgatcagacacaccaccaacctgaccctgtggttcgagaagtgcatcgtggagaccgagaacctggaggagagagtggccgtggtgagcagaatcatcgagatcctgcaggtgttccaggagctgaacaacttcaacggcgtgctggaggtggtgagcgccatgaacagcagccccgtgtacagactggaccacaccttcgagcagatccccagcagacagaagaagatcctggaggaggcccacgagctgagcgaggaccactacaagaagtacctggccaagctgagaagcatcaaccccccctgcgtgcccttcttcggcatctacctgaccaacatcctgaagaccgaggagggcaaccccgaggtgctgaagagacacggcaaggagctgatcaacttcagcaagagaagaaaggtggccgagatcaccggcgagatccagcagtaccagaaccagccctactgcctgagagtggagagcgacatcaagagattcttcgagaacctgaaccccatgggcaacagcatggagaaggagttcaccgactacctgttcaacaagagcctggagatcgagcccagaaaccccaagcccctgcccagattccccaagaagtacagctaccccctgaagagccccggcgtgagacccagcaaccccagacccggcaccatgagacaccccacccccctgcagcaggagcccagaaagatcagctacagcagaatccccgagagcgagaccgagagcaccgccagcgcccccaacagccccagaacccccctgacccccccccccgccagcggcgccagcagcaccaccgacgtgtgcagcgtgttcgacagcgaccacagcagccccttccacagcagaagcgccagcgtgagcagcatcagcctgaccaagggcaccgacgaggtgcccgtgcccccccccgtgccccccagaagaagacccgagagcgcccccgccgagagcagccccagcaagatcatgagcaagcacctggacagcccccccgccatcccccccagacagcccaccagcaaggcctacagccccagatacagcatcagcgacagaaccagcatcagcgacccccccgagagcccccccctgctgccccccagagagcccgtgagaacccccgacgtgttcagcagcagccccctgcacctgcagcccccccccctgggcaagaagagcgaccacggcaacgccttcttccccaacagccccagccccttcacccccccccccccccagacccccagcccccacggcaccagaagacacctgcccagcccccccctgacccaggaggtggacctgcacagcatcgccggcccccccgtgccccccagacagagcaccagccagcacatccccaagctgccccccaagacctacaagagagagcacacccaccccagcatgcacagagacggcccccccctgctggagaacgcccacagcagctag

SEQ ID NO: 13004 - DNA, 2358 bp, Artificial Sequence
  Description of Artificial Sequence: Synthetic coding sequence
atgagcgaccaggaccacagcatggacgagatgaccgccgtggtgaagatcgagaagggcgtgggcggcaacaacggcggcaacggcaacggcggcggcgccttcagccaggccagaagcagcagcaccggcagcagcagcagcaccggcggcggcggccaggagagccagcccagccccctggccctgctggccgccacctgcagcagaatcgagagccccaacgagaacagcaacaacagccagggccccagccagagcggcggcaccggcgagctggacctgaccgccacccagctgagccagggcgccaacggctggcagatcatcagcagcagcagcggcgccacccccaccagcaaggagcagagcggcagcagcaccaacggcagcaacggcagcgagagcagcaagaacagaaccgtgagcggcggccagtacgtggtggccgccgcccccaacctgcagaaccagcaggtgctgaccggcctgcccggcgtgatgcccaacatccagtaccaggtgatcccccagttccagaccgtggacggccagcagctgcagttcgccgccaccggcgcccaggtgcagcaggacggcagcggccagatccagatcatccccggcgccaaccagcagatcatcaccaacagaggcagcggcggcaacatcatcgccgccatgcccaacctgctgcagcaggccgtgcccctgcagggcctggccaacaacgtgctgagcggccagacccagtacgtgaccaacgtgcccgtggccctgaacggcaacatcaccctgctgcccgtgaacagcgtgagcgccgccaccctgacccccagcagccaggccgtgaccatcagcagcagcggcagccaggagagcggcagccagcccgtgaccagcggcaccaccatcagcagcgccagcctggtgagcagccaggccagcagcagcagcttcttcaccaacgccaacagctacagcaccaccaccaccaccagcaacatgggcatcatgaacttcaccaccagcggcagcagcggcaccaacagccagggccagaccccccagagagtgagcggcctgcagggcagcgacgccctgaacatccagcagaaccagaccagcggcggcagcctgcaggccggccagcagaaggagggcgagcagaaccagcagacccagcagcagcagatcctgatccagccccagctggtgcagggcggccaggccctgcaggccctgcaggccgcccccctgagcggccagaccttcaccacccaggccatcagccaggagaccctgcagaacctgcagctgcaggccgtgcccaacagcggccccatcatcatcagaacccccaccgtgggccccaacggccaggtgagctggcagaccctgcagctgcagaacctgcaggtgcagaacccccaggcccagaccatcaccctggcccccatgcagggcgtgagcctgggccagaccagcagcagcaacaccaccctgacccccatcgccagcgccgccagcatccccgccggcaccgtgaccgtgaacgccgcccagctgagcagcatgcccggcctgcagaccatcaacctgagcgccctgggcaccagcggcatccaggtgcaccccatccagggcctgcccctggccatcgccaacgcccccggcgaccacggcgcccagctgggcctgcacggcgccggcggcgacggcatccacgacgacaccgccggcggcgaggagggcgagaacagccccgacgcccagccccaggccggcagaagaaccagaagagaggcctgcacctgcccctactgcaaggacagcgagggcagaggcagcggcgaccccggcaagaagaagcagcacatctgccacatccagggctgcggcaaggtgtacggcaagaccagccacctgagagcccacctgagatggcacaccggcgagagacccttcatgtgcacctggagctactgcggcaagagattcaccagaagcgacgagctgcagagacacaagagaacccacaccggcgagaagaagttcgcctgccccgagtgccccaagagattcatgagaagcgaccacctgagcaagcacatcaagacccaccagaacaagaagggcggccccggcgtggccctgagcgtgggcaccctgcccctggacagcggcgccggcagcgagggcagcggcaccgccacccccagcgccctgatcaccaccaacatggtggccatggaggccatctgccccgagggcatcgccagactggccaacagcggcatcaacgtgatgcaggtggccgacctgcagagcatcaacatcagcggcaacggcttctag

SEQ ID NO: 13005 - DNA, 2337 bp, Artificial Sequence
  Description of Artificial Sequence: Synthetic coding sequence
atggacgagatgaccgccgtggtgaagatcgagaagggcgtgggcggcaacaacggcggcaacggcaacggcggcggcgccttcagccaggccagaagcagcagcaccggcagcagcagcagcaccggcggcggcggccaggagagccagcccagccccctggccctgctggccgccacctgcagcagaatcgagagccccaacgagaacagcaacaacagccagggccccagccagagcggcggcaccggcgagctggacctgaccgccacccagctgagccagggcgccaacggctggcagatcatcagcagcagcagcggcgccacccccaccagcaaggagcagagcggcagcagcaccaacggcagcaacggcagcgagagcagcaagaacagaaccgtgagcggcggccagtacgtggtggccgccgcccccaacctgcagaaccagcaggtgctgaccggcctgcccggcgtgatgcccaacatccagtaccaggtgatcccccagttccagaccgtggacggccagcagctgcagttcgccgccaccggcgcccaggtgcagcaggacggcagcggccagatccagatcatccccggcgccaaccagcagatcatcaccaacagaggcagcggcggcaacatcatcgccgccatgcccaacctgctgcagcaggccgtgcccctgcagggcctggccaacaacgtgctgagcggccagacccagtacgtgaccaacgtgcccgtggccctgaacggcaacatcaccctgctgcccgtgaacagcgtgagcgccgccaccctgacccccagcagccaggccgtgaccatcagcagcagcggcagccaggagagcggcagccagcccgtgaccagcggcaccaccatcagcagcgccagcctggtgagcagccaggccagcagcagcagcttcttcaccaacgccaacagctacagcaccaccaccaccaccagcaacatgggcatcatgaacttcaccaccagcggcagcagcggcaccaacagccagggccagaccccccagagagtgagcggcctgcagggcagcgacgccctgaacatccagcagaaccagaccagcggcggcagcctgcaggccggccagcagaaggagggcgagcagaaccagcagacccagcagcagcagatcctgatccagccccagctggtgcagggcggccaggccctgcaggccctgcaggccgcccccctgagcggccagaccttcaccacccaggccatcagccaggagaccctgcagaacctgcagctgcaggccgtgcccaacagcggccccatcatcatcagaacccccaccgtgggccccaacggccaggtgagctggcagaccctgcagctgcagaacctgcaggtgcagaacccccaggcccagaccatcaccctggcccccatgcagggcgtgagcctgggccagaccagcagcagcaacaccaccctgacccccatcgccagcgccgccagcatccccgccggcaccgtgaccgtgaacgccgcccagctgagcagcatgcccggcctgcagaccatcaacctgagcgccctgggcaccagcggcatccaggtgcaccccatccagggcctgcccctggccatcgccaacgcccccggcgaccacggcgcccagctgggcctgcacggcgccggcggcgacggcatccacgacgacaccgccggcggcgaggagggcgagaacagccccgacgcccagccccaggccggcagaagaaccagaagagaggcctgcacctgcccctactgcaaggacagcgagggcagaggcagcggcgaccccggcaagaagaagcagcacatctgccacatccagggctgcggcaaggtgtacggcaagaccagccacctgagagcccacctgagatggcacaccggcgagagacccttcatgtgcacctggagctactgcggcaagagattcaccagaagcgacgagctgcagagacacaagagaacccacaccggcgagaagaagttcgcctgccccgagtgccccaagagattcatgagaagcgaccacctgagcaagcacatcaagacccaccagaacaagaagggcggccccggcgtggccctgagcgtgggcaccctgcccctggacagcggcgccggcagcgagggcagcggcaccgccacccccagcgccctgatcaccaccaacatggtggccatggaggccatctgccccgagggcatcgccagactggccaacagcggcatcaacgtgatgcaggtggccgacctgcagagcatcaacatcagcggcaacggcttctag

SEQ ID NO: 13006 - DNA, 1413 bp, Artificial Sequence
  Description of Artificial Sequence: Synthetic coding sequence
atgagcgcccaggtgctgggcttcctgagaagctggacccccctgcccctggccgcccccagaggccccgccgccgccggcaacgacgccggcgcccccgccgccaccgcccccggcggcgagggcgagccccacagcagaccctgcgacgccagactgggcagcaccgacaaggagctgaaggccggcgccgccgccaccggcagcgcccccaccgcccccggcaccccctggcagagagagcccagagtggaggtgatggaccccgccggcggccccagaggcgtgctgcccagaccctgcagagtgctggtgctgctgaaccccagaggcggcaagggcaaggccctgcagctgttcagaagccacgtgcagcccctgctggccgaggccgagatcagcttcaccctgatgctgaccgagagaagaaaccacgccagagagctggtgagaagcgaggagctgggcagatgggacgccctggtggtgatgagcggcgacggcctgatgcacgaggtggtgaacggcctgatggagagacccgactgggagaccgccatccagaagcccctgtgcagcctgcccgccggcagcggcaacgccctggccgccagcctgaaccactacgccggctacgagcaggtgaccaacgaggacctgctgaccaactgcaccctgctgctgtgcagaagactgctgagccccatgaacctgctgagcctgcacaccgccagcggcctgagactgttcagcgtgctgagcctggcctggggcttcatcgccgacgtggacctggagagcgagaagtacagaagactgggcgagatgagattcaccctgggcaccttcctgagactggccgccctgagaacctacagaggcagactggcctacctgcccgtgggcagagtgggcagcaagacccccgccagccccgtggtggtgcagcagggccccgtggacgcccacctggtgcccctggaggagcccgtgcccagccactggaccgtggtgcccgacgaggacttcgtgctggtgctggccctgctgcacagccacctgggcagcgagatgttcgccgcccccatgggcagatgcgccgccggcgtgatgcacctgttctacgtgagagccggcgtgagcagagccatgctgctgagactgttcctggccatggagaagggcagacacatggagtacgagtgcccctacctggtgtacgtgcccgtggtggccttcagactggagcccaaggacggcaagggcgtgttcgccgtggacggcgagctgatggtgagcgaggccgtgcagggccaggtgcaccccaactacttctggatggtgagcggctgcgtggagcccccccccagctggaagccccagcagatgcccccccccgaggagcccctgtag

SEQ ID NO: 13007 - DNA, 1155 bp, Artificial Sequence
  Description of Artificial Sequence: Synthetic coding sequence
atggaccccgccggcggccccagaggcgtgctgcccagaccctgcagagtgctggtgctgctgaaccccagaggcggcaagggcaaggccctgcagctgttcagaagccacgtgcagcccctgctggccgaggccgagatcagcttcaccctgatgctgaccgagagaagaaaccacgccagagagctggtgagaagcgaggagctgggcagatgggacgccctggtggtgatgagcggcgacggcctgatgcacgaggtggtgaacggcctgatggagagacccgactgggagaccgccatccagaagcccctgtgcagcctgcccgccggcagcggcaacgccctggccgccagcctgaaccactacgccggctacgagcaggtgaccaacgaggacctgctgaccaactgcaccctgctgctgtgcagaagactgctgagccccatgaacctgctgagcctgcacaccgccagcggcctgagactgttcagcgtgctgagcctggcctggggcttcatcgccgacgtggacctggagagcgagaagtacagaagactgggcgagatgagattcaccctgggcaccttcctgagactggccgccctgagaacctacagaggcagactggcctacctgcccgtgggcagagtgggcagcaagacccccgccagccccgtggtggtgcagcagggccccgtggacgcccacctggtgcccctggaggagcccgtgcccagccactggaccgtggtgcccgacgaggacttcgtgctggtgctggccctgctgcacagccacctgggcagcgagatgttcgccgcccccatgggcagatgcgccgccggcgtgatgcacctgttctacgtgagagccggcgtgagcagagccatgctgctgagactgttcctggccatggagaagggcagacacatggagtacgagtgcccctacctggtgtacgtgcccgtggtggccttcagactggagcccaaggacggcaagggcgtgttcgccgtggacggcgagctgatggtgagcgaggccgtgcagggccaggtgcaccccaactacttctggatggtgagcggctgcgtggagcccccccccagctggaagccccagcagatgcccccccccgaggagcccctgtag

SEQ ID NO: 13008 - DNA, 1152 bp, Artificial Sequence
  Description of Artificial Sequence: Synthetic coding sequence
gagcccaccggcggccccagaggcgtgctgcccagaccctgcagagtgctggtgctgctgaaccccagaggcggcaagggcaaggccctgcagctgttcagaagccacgtgcagcccctgctggccgaggccgagatcagcttcaccctgatgctgaccgagagaagaaaccacgccagagagctggtgagaagcgaggagctgggcagatgggacgccctggtggtgatgagcggcgacggcctgatgcacgaggtggtgaacggcctgatggagagacccgactgggagaccgccatccagaagcccctgtgcagcctgcccgccggcagcggcaacgccctggccgccagcctgaaccactacgccggctacgagcaggtgaccaacgaggacctgctgaccaactgcaccctgctgctgtgcagaagactgctgagccccatgaacctgctgagcctgcacaccgccagcggcctgagactgttcagcgtgctgagcctggcctggggcttcatcgccgacgtggacctggagagcgagaagtacagaagactgggcgagatgagattcaccctgggcaccttcctgagactggccgccctgagaacctacagaggcagactggcctacctgcccgtgggcagagtgggcagcaagacccccgccagccccgtggtggtgcagcagggccccgtggacgcccacctggtgcccctggaggagcccgtgcccagccactggaccgtggtgcccgacgaggacttcgtgctggtgctggccctgctgcacagccacctgggcagcgagatgttcgccgcccccatgggcagatgcgccgccggcgtgatgcacctgttctacgtgagagccggcgtgagcagagccatgctgctgagactgttcctggccatggagaagggcagacacatggagtacgagtgcccctacctggtgtacgtgcccgtggtggccttcagactggagcccaaggacggcaagggcgtgttcgccgtggacggcgagctgatggtgagcgaggccgtgcagggccaggtgcaccccaactacttctggatggtgagcggctgcgtggagcccccccccagctggaagccccagcagatgcccccccccgaggagcccctgtag

SEQ ID NO: 13009 - DNA, 1155 bp, Artificial Sequence; identical to SEQ ID NO: 13007
  Description of Artificial Sequence: Synthetic coding sequence

SEQ ID NO: 13010 - DNA, 1197 bp, Artificial Sequence
  Description of Artificial Sequence: Synthetic coding sequence
atggaccccgtggtgggctgcggcagaggcctgttcggcttcgtgttcagcgccggcggccccagaggcgtgctgcccagaccctgcagagtgctggtgctgctgaaccccagaggcggcaagggcaaggccctgcagctgttcagaagccacgtgcagcccctgctggccgaggccgagatcagcttcaccctgatgctgaccgagagaagaaaccacgccagagagctggtgagaagcgaggagctgggcagatgggacgccctggtggtgatgagcggcgacggcctgatgcacgaggtggtgaacggcctgatggagagacccgactgggagaccgccatccagaagcccctgtgcagcctgcccgccggcagcggcaacgccctggccgccagcctgaaccactacgccggctacgagcaggtgaccaacgaggacctgctgaccaactgcaccctgctgctgtgcagaagactgctgagccccatgaacctgctgagcctgcacaccgccagcggcctgagactgttcagcgtgctgagcctggcctggggcttcatcgccgacgtggacctggagagcgagaagtacagaagactgggcgagatgagattcaccctgggcaccttcctgagactggccgccctgagaacctacagaggcagactggcctacctgcccgtgggcagagtgggcagcaagacccccgccagccccgtggtggtgcagcagggccccgtggacgcccacctggtgcccctggaggagcccgtgcccagccactggaccgtggtgcccgacgaggacttcgtgctggtgctggccctgctgcacagccacctgggcagcgagatgttcgccgcccccatgggcagatgcgccgccggcgtgatgcacctgttctacgtgagagccggcgtgagcagagccatgctgctgagactgttcctggccatggagaagggcagacacatggagtacgagtgcccctacctggtgtacgtgcccgtggtggccttcagactggagcccaaggacggcaagggcgtgttcgccgtggacggcgagctgatggtgagcgaggccgtgcagggccaggtgcaccccaactacttctggatggtgagcggctgcgtggagcccccccccagctggaagccccagcagatgcccccccccgaggagcccctgtag

SEQ ID NO: 13011 - DNA, 1155 bp, Artificial Sequence; identical to SEQ ID NO: 13007
  Description of Artificial Sequence: Synthetic coding sequence

SEQ ID NO: 13012 - DNA, 1965 bp, Artificial Sequence
  Description of Artificial Sequence: Synthetic coding sequence
atgaacggccacctggaggccgaggagcagcaggaccagagacccgaccaggagctgaccggcagctggggccacggccccagaagcaccctggtgagagccaaggccatggcccccccccccccccccctggccgccagcacccccctgctgcacggcgagttcggcagctaccccgccagaggccccagattcgccctgaccctgaccagccaggccctgcacatccagagactgagacccaagcccgaggccagacccagaggcggcctggtgcccctggccgaggtgagcggctgctgcaccctgagaagcagaagccccagcgacagcgccgcctacttctgcatctacacctaccccagaggcagaagaggcgccagaagaagagccaccagaaccttcagagccgacggcgccgccacctacgaggagaacagagccgaggcccagagatgggccaccgccctgacctgcctgctgagaggcctgcccctgcccggcgacggcgagatcacccccgacctgctgcccagaccccccagactgctgctgctggtgaaccccttcggcggcagaggcctggcctggcagtggtgcaagaaccacgtgctgcccatgatcagcgaggccggcctgagcttcaacctgatccagaccgagagacagaaccacgccagagagctggtgcagggcctgagcctgagcgagtgggacggcatcgtgaccgtgagcggcgacggcctgctgcacgaggtgctgaacggcctgctggacagacccgactgggaggaggccgtgaagatgcccgtgggcatcctgccctgcggcagcggcaacgccctggccggcgccgtgaaccagcacggcggcttcgagcccgccctgggcctggacctgctgctgaactgcagcctgctgctgtgcagaggcggcggccaccccctggacctgctgagcgtgaccctggccagcggcagcagatgcttcagcttcctgagcgtggcctggggcttcgtgagcgacgtggacatccagagcgagagattcagagccctgggcagcgccagattcaccctgggcaccgtgctgggcctggccaccctgcacacctacagaggcagactgagctacctgcccgccaccgtggagcccgccagccccacccccgcccacagcctgcccagagccaagagcgagctgaccctgacccccgaccccgccccccccatggcccacagccccctgcacagaagcgtgagcgacctgcccctgcccctgccccagcccgccctggccagccccggcagccccgagcccctgcccatcctgagcctgaacggcggcggccccgagctggccggcgactggggcggcgccggcgacgcccccctgagccccgaccccctgctgagcagcccccccggcagccccaaggccgccctgcacagccccgtgagcgagggcgcccccgtgatcccccccagcagcggcctgcccctgcccacccccgacgccagagtgggcgccagcacctgcggcccccccgaccacctgctgccccccctgggcacccccctgccccccgactgggtgaccctggagggcgacttcgtgctgatgctggccatcagccccagccacctgggcgccgacctggtggccgccccccacgccagattcgacgacggcctggtgcacctgtgctgggtgagaagcggcatcagcagagccgccctgctgagactgttcctggccatggagagaggcagccacttcagcctgggctgcccccagctgggctacgccgccgccagagccttcagactggagcccctgacccccagaggcgtgctgaccgtggacggcgagcaggtggagtacggccccctgcaggcccagatgcaccccggcatcggcaccctgctgaccggcccccccggctgccccggcagagagccctag

SEQ ID NO: 13013 - DNA, 1851 bp, Artificial Sequence
  Description of Artificial Sequence: Synthetic coding sequence
atggcccccccccccccccccctggccgccagcacccccctgctgcacggcgagttcggcagctaccccgccagaggccccagattcgccctgaccctgaccagccaggccctgcacatccagagactgagacccaagcccgaggccagacccagaggcggcctggtgcccctggccgaggtgagcggctgctgcaccctgagaagcagaagccccagcgacagcgccgcctacttctgcatctacacctaccccagaggcagaagaggcgccagaagaagagccaccagaaccttcagagccgacggcgccgccacctacgaggagaacagagccgaggcccagagatgggccaccgccctgacctgcctgctgagaggcctgcccctgcccggcgacggcgagatcacccccgacctgctgcccagaccccccagactgctgctgctggtgaaccccttcggcggcagaggcctggcctggcagtggtgcaagaaccacgtgctgcccatgatcagcgaggccggcctgagcttcaacctgatccagaccgagagacagaaccacgccagagagctggtgcagggcctgagcctgagcgagtgggacggcatcgtgaccgtgagcggcgacggcctgctgcacgaggtgctgaacggcctgctggacagacccgactgggaggaggccgtgaagatgcccgtgggcatcctgccctgcggcagcggcaacgccctggccggcgccgtgaaccagcacggcggccccagctggggcgacagagacccctacatcagccacagcgccaagcccaccgtgagccaggtgaaccagcccgcctgcggcatgctgacccccagcagctggaccttcctgcccgcctgcttccccgccgtgagcagagcccccagaaccctgcccggcatgggcggcacccaggccctgggcagcgccagattcaccctgggcaccgtgctgggcctggccaccctgcacacctacagaggcagactgagctacctgcccgccaccgtggagcccgccagccccacccccgcccacagcctgcccagagccaagagcgagctgaccctgacccccgaccccgccccccccatggcccacagccccctgcacagaagcgtgagcgacctgcccctgcccctgccccagcccgccctggccagccccggcagccccgagcccctgcccatcctgagcctgaacggcggcggccccgagctggccggcgactggggcggcgccggcgacgcccccctgagccccgaccccctgctgagcagcccccccggcagccccaaggccgccctgcacagccccgtgagcgagggcgcccccgtgatcccccccagcagcggcctgcccctgcccacccccgacgccagagtgggcgccagcacctgcggcccccccgaccacctgctgccccccctgggcacccccctgccccccgactgggtgaccctggagggcgacttcgtgctgatgctggccatcagccccagccacctgggcgccgacctggtggccgccccccacgccagattcgacgacggcctggtgcacctgtgctgggtgagaagcggcatcagcagagccgccctgctgagactgttcctggccatggagagaggcagccacttcagcctgggctgcccccagctgggctacgccgccgccagagccttcagactggagcccctgacccccagaggcgtgctgaccgtggacggcgagcaggtggagtacggccccctgcaggcccagatgcaccccggcatcggcaccctgctgaccggcccccccggctgccccggcagagagccctag

SEQ ID NO: 13014 - DNA, 1884 bp, Artificial Sequence
  Description of Artificial Sequence: Synthetic coding sequence
atgaacggccacctggaggccgaggagcagcaggaccagagacccgaccaggagctgaccggcagctggggccacggccccagaagcaccctggtgagagccaaggccatggcccccccccccccccccctggccgccagcacccccctgctgcacggcgagttcggcagctaccccgccagaggccccagattcgccctgaccctgaccagccaggccctgcacatccagagactgagacccaagcacagcgccgcctacttctgcatctacacctaccccagaggcagaagaggcgccagaagaagagccaccagaaccttcagagccgacggcgccgccacctacgaggagaacagagccgaggcccagagatgggccaccgccctgacctgcctgctgagaggcctgcccctgcccggcgacggcgagatcacccccgacctgctgcccagaccccccagactgctgctgctggtgaaccccttcggcggcagaggcctggcctggcagtggtgcaagaaccacgtgctgcccatgatcagcgaggccggcctgagcttcaacctgatccagaccgagagacagaaccacgccagagagctggtgcagggcctgagcctgagcgagtgggacggcatcgtgaccgtgagcggcgacggcctgctgcacgaggtgctgaacggcctgctggacagacccgactgggaggaggccgtgaagatgcccgtgggcatcctgccctgcggcagcggcaacgccctggccggcgccgtgaaccagcacggcggcttcgagcccgccctgggcctggacctgctgctgaactgcagcctgctgctgtgcagaggcggcggccaccccctggacctgctgagcgtgaccctggccagcggcagcagatgcttcagcttcctgagcgtggcctggggcttcgtgagcgacgtggacatccagagcgagagattcagagccctgggcagcgccagattcaccctgggcaccgtgctgggcctggccaccctgcacacctacagaggcagactgagctacctgcccgccaccgtggagcccgccagccccacccccgcccacagcctgcccagagccaagagcgagctgaccctgacccccgaccccgccccccccatggcccacagccccctgcacagaagcgtgagcgacctgcccctgcccctgccccagcccgccctggccagccccggcagccccgagcccctgcccatcctgagcctgaacggcggcggccccgagctggccggcgactggggcggcgccggcgacgcccccctgagccccgaccccctgctgagcagcccccccggcagccccaaggccgccctgcacagccccgtgagcgagggcgcccccgtgatcccccccagcagcggcctgcccctgcccacccccgacgccagagtgggcgccagcacctgcggcccccccgaccacctgctgccccccctgggcacccccctgccccccgactgggtgaccctggagggcgacttcgtgctgatgctggccatcagccccagccacctgggcgccgacctggtggccgccccccacgccagattcgacgacggcctggtgcacctgtgctgggtgagaagcggcatcagcagagccgccctgctgagactgttcctggccatggagagaggcagccacttcagcctgggctgcccccagctgggctacgccgccgccagagccttcagactggagcccctgacccccagaggcgtgctgaccgtggacggcgagcaggtggagtacggccccctgcaggcccagatgcaccccggcatcggcaccctgctgaccggcccccccggctgccccggcagagagccctag

SEQ ID NO: 13015 - DNA, 150 bp, Artificial Sequence
  Description of Artificial Sequence: Synthetic coding sequence
atgaacggccacctggaggccgaggagcagcaggaccagagaagccccctgacctgctacctgggcagacccggctgcttctactggagcatccccctgggcgtgggcgcctggcccggcagcggcgtgagaaccacctgcttcccctag

SEQ ID NO: 13016 - DNA, 2286 bp, Artificial Sequence
  Description of Artificial Sequence: Synthetic coding sequence
atgatcggctgcctgcacgccagagtgagcggccccctgtgggacgccggcctgtgccccgccagcagcagaagcgcccacacctgcctgagcctgagcgtgagcgacgcccccgtgagccccgccaccgccccccactgcctgctgctgagcaccgcccccgcccccccctgcccctgccacggcgtgctgaacagccaccccttcagcccccccttcccccagagacccgaccaggagctgaccggcagctggggccacggccccagaagcaccctggtgagagccaaggccatggcccccccccccccccccctggccgccagcacccccctgctgcacggcgagttcggcagctaccccgccagaggccccagattcgccctgaccctgaccagccaggccctgcacatccagagactgagacccaagcccgaggccagacccagaggcggcctggtgcccctggccgaggtgagcggctgctgcaccctgagaagcagaagccccagcgacagcgccgcctacttctgcatctacacctaccccagaggcagaagaggcgccagaagaagagccaccagaaccttcagagccgacggcgccgccacctacgaggagaacagagccgaggcccagagatgggccaccgccctgacctgcctgctgagaggcctgcccctgcccggcgacggcgagatcacccccgacctgctgcccagaccccccagactgctgctgctggtgaaccccttcggcggcagaggcctggcctggcagtggtgcaagaaccacgtgctgcccatgatcagcgaggccggcctgagcttcaacctgatccagaccgagagacagaaccacgccagagagctggtgcagggcctgagcctgagcgagtgggacggcatcgtgaccgtgagcggcgacggcctgctgcacgaggtgctgaacggcctgctggacagacccgactgggaggaggccgtgaagatgcccgtgggcatcctgccctgcggcagcggcaacgccctggccggcgccgtgaaccagcacggcggcttcgagcccgccctgggcctggacctgctgctgaactgcagcctgctgctgtgcagaggcggcggccaccccctggacctgctgagcgtgaccctggccagcggcagcagatgcttcagcttcctgagcgtggcctggggcttcgtgagcgacgtggacatccagagcgagagattcagagccctgggcagcgccagattcaccctgggcaccgtgctgggcctggccaccctgcacacctacagaggcagactgagctacctgcccgccaccgtggagcccgccagccccacccccgcccacagcctgcccagagccaagagcgagctgaccctgacccccgaccccgccccccccatggcccacagccccctgcacagaagcgtgagcgacctgcccctgcccctgccccagcccgccctggccagccccggcagccccgagcccctgcccatcctgagcctgaacggcggcggccccgagctggccggcgactggggcggcgccggcgacgcccccctgagccccgaccccctgctgagcagcccccccggcagccccaaggccgccctgcacagccccgtgagcgagggcgcccccgtgatcccccccagcagcggcctgcccctgcccacccccgacgccagagtgggcgccagcacctgcggcccccccgaccacctgctgccccccctgggcacccccctgccccccgactgggtgaccctggagggcgacttcgtgctgatgctggccatcagccccagccacctgggcgccgacctggtggccgccccccacgccagattcgacgacggcctggtgcacctgtgctgggtgagaagcggcatcagcagagccgccctgctgagactgttcctggccatggagagaggcagccacttcagcctgggctgcccccagctgggctacgccgccgccagagccttcagactggagcccctgacccccagaggcgtgctgaccgtggacggcgagcaggtggagtacggccccctgcaggcccagatgcaccccggcatcgccagaggcagaacccagacccccgccctgcccgccgcccccgccctgtacggcagacagcccggcgccgcccacggcctgcagcccgtgtgccagggcgccgccctgttcttccacaacagctggctgtggggcagccaggacctgttcagaatcgtgctgaccgaggccgtgggcggctag

SEQ ID NO: 13017 - DNA, 1965 bp, Artificial Sequence; identical to SEQ ID NO: 13012
  Description of Artificial Sequence: Synthetic coding sequence

SEQ ID NO: 13018 - DNA, 1857 bp, Artificial Sequence
  Description of Artificial Sequence: Synthetic coding sequence
atggcccccccccccccccccctggccgccagcacccccctgctgcacggcgagttcggcagctaccccgccagaggccccagattcgccctgaccctgaccagccaggccctgcacatccagagactgagacccaagcccgaggccagacccagaggcggcctggtgcccctggccgaggtgagcggctgctgcaccctgagaagcagaagccccagcgacagcgccgcctacttctgcatctacacctaccccagaggcagaagaggcgccagaagaagagccaccagaaccttcagagccgacggcgccgccacctacgaggagaacagagccgaggcccagagatgggccaccgccctgacctgcctgctgagaggcctgcccctgcccggcgacggcgagatcacccccgacctgctgcccagaccccccagactgctgctgctggtgaaccccttcggcggcagaggcctggcctggcagtggtgcaagaaccacgtgctgcccatgatcagcgaggccggcctgagcttcaacctgatccagaccgagagacagaaccacgccagagagctggtgcagggcctgagcctgagcgagtgggacggcatcgtgaccgtgagcggcgacggcctgctgcacgaggtgctgaacggcctgctggacagacccgactgggaggaggccgtgaagatgcccgtgggcatcctgccctgcggcagcggcaacgccctggccggcgccgtgaaccagcacggcggcttcgagcccgccctgggcctggacctgctgctgaactgcagcctgctgctgtgcagaggcggcggccaccccctggacctgctgagcgtgaccctggccagcggcagcagatgcttcagcttcctgagcgtggcctggggcttcgtgagcgacgtggacatccagagcgagagattcagagccctgggcagcgccagattcaccctgggcaccgtgctgggcctggccaccctgcacacctacagaggcagactgagctacctgcccgccaccgtggagcccgccagccccacccccgcccacagcctgcccagagccaagagcgagctgaccctgacccccgaccccgccccccccatggcccacagccccctgcacagaagcgtgagcgacctgcccctgcccctgccccagcccgccctggccagccccggcagccccgagcccctgcccatcctgagcctgaacggcggcggccccgagctggccggcgactggggcggcgccggcgacgcccccctgagccccgaccccctgctgagcagcccccccggcagccccaaggccgccctgcacagccccgtgagcgagggcgcccccgtgatcccccccagcagcggcctgcccctgcccacccccgacgccagagtgggcgccagcacctgcggcccccccgaccacctgctgccccccctgggcacccccctgccccccgactgggtgaccctggagggcgacttcgtgctgatgctggccatcagccccagccacctgggcgccgacctggtggccgccccccacgccagattcgacgacggcctggtgcacctgtgctgggtgagaagcggcatcagcagagccgccctgctgagactgttcctggccatggagagaggcagccacttcagcctgggctgcccccagctgggctacgccgccgccagagccttcagactggagcccctgacccccagaggcgtgctgaccgtggacggcgagcaggtggagtacggccccctgcaggcccagatgcaccccggcatcggcaccctgctgaccggcccccccggctgccccggcagagagccctag

SEQ ID NO: 13019 - DNA, 1149 bp, Artificial Sequence
  Description of Artificial Sequence: Synthetic coding sequence
atgggccccaccagcgtgcccctggtgaaggcccacagaagcagcgtgagcgactacgtgaactacgacatcatcgtgagacactacaactacaccggcaagctgaacatcagcgccgacaaggagaacagcatcaagctgaccagcgtggtgttcatcctgatctgctgcttcatcatcctggagaacatcttcgtgctgctgaccatctggaagaccaagaagttccacagacccatgtactacttcatcggcaacctggccctgagcgacctgctggccggcgtggcctacaccgccaacctgctgctgagcggcgccaccacctacaagctgacccccgcccagtggttcctgagagagggcagcatgttcgtggccctgagcgccagcgtgttcagcctgctggccatcgccatcgagagatacatcaccatgctgaagatgaagctgcacaacggcagcaacaacttcagactgttcctgctgatcagcgcctgctgggtgatcagcctgatcctgggcggcctgcccatcatgggctggaactgcatcagcgccctgagcagctgcagcaccgtgctgcccctgtaccacaagcactacatcctgttctgcaccaccgtgttcaccctgctgctgctgagcatcgtgatcctgtactgcagaatctacagcctggtgagaaccagaagcagaagactgaccttcagaaagaacatcagcaaggccagcagaagcagcgagaagagcctggccctgctgaagaccgtgatcatcgtgctgagcgtgttcatcgcctgctgggcccccctgttcatcctgctgctgctggacgtgggctgcaaggtgaagacctgcgacatcctgttcagagccgagtacttcctggtgctggccgtgctgaacagcggcaccaaccccatcatctacaccctgaccaacaaggagatgagaagagccttcatcagaatcatgagctgctgcaagtgccccagcggcgacagcgccggcaagttcaagagacccatcatcgccggcatggagttcagcagaagcaagagcgacaacagcagccacccccagaaggacgagggcgacaaccccgagaccatcatgagcagcggcaacgtgaacagcagcagctag

SEQ ID NO: 13020 - DNA, 1353 bp, Artificial Sequence
  Description of Artificial Sequence: Synthetic coding sequence
atgggccccaccagcgtgcccctggtgaaggcccacagaagcagcgtgagcgactacgtgaactacgacatcatcgtgagacactacaactacaccggcaagctgaacatcagcgccgacaaggagaacagcatcaagctgaccagcgtggtgttcatcctgatctgctgcttcatcatcctggagaacatcttcgtgctgctgaccatctggaagaccaagaagttccacagacccatgtactacttcatcggcaacctggccctgagcgacctgctggccggcgtggcctacaccgccaacctgctgctgagcggcgccaccacctacaagctgacccccgcccagtggttcctgagagagggcagcatgttcgtggccctgagcgccagcgtgttcagcctgctggccatcgccatcgagagatacatcaccatgctgaagatgaagctgcacaacggcagcaacaacttcagactgttcctgctgatcagcgcctgctgggtgatcagcctgatcctgggcggcctgcccatcatgggctggaactgcatcagcgccctgagcagctgcagcaccgtgctgcccctgtaccacaagcactacatcctgttctgcaccaccgtgttcaccctgctgctgctgagcatcgtgatcctgtactgcagaatctacagcctggtgagaaccagaagcagaagactgaccttcagaaagaacatcagcaaggccagcagaagcagcgagaagagcctggccctgctgaagaccgtgatcatcgtgctgagcgtgttcatcgcctgctgggcccccctgttcatcctgctgctgctggacgtgggctgcaaggtgaagacctgcgacatcctgttcagagccgagtacttcctggtgctggccgtgctgaacagcggcaccaaccccatcatctacaccctgaccaacaaggagaccctgctggccaacagcagcgaccccagcagccccgcctggaacagcgccgccgccaacagaaccatcccccccacccccagaaagaccaagggcaccacccagagacccctgtgcctgctggagaccagcaccctgctgcccagaaccggcagctgcccccccaccggcagcgccctgtacctggtggccggccaccccagcgtgtggaagaagatcagcggcctgagactgctgcccggcagaagctgctgcaagcccgagggcggcagaggcagaatcagaaccgcctggtggtgcagagtgctggtgggcagagtgagcagctgcgagcagtgcaccggcaagggcggcgaccaggtgcccgcctggaacatcttcagcacccccctggagctgtag

SEQ ID NO: 13021 - DNA, 726 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgccgtgggcatggcctgcgccatcagcatcctgatgaaggacctggccgacgagctggccctggtggacgtgatcgaggacaagctgaagggcgagatgatggacctgcagcacggcagcctgttcctgagaacccccaagatcgtgagcggcaaggactacaacgtgaccgccaacagcaagctggtgatcatcaccgccggcgccagacagcaggagggcgagagcagactgaacctggtgcagagaaacgtgaacatcttcaagttcatcatccccaacgtggtgaagtacagccccaactgcaagctgctgatcgtgagcaaccccgtggacatcctgacctacgtggcctggaagatcagcggcttccccaagaacagagtgatcggcagcggctgcaacctggacagcgccagattcagatacctgatgggcgagagactgggcgtgcaccccctgagctgccacggctgggtgctgggcgagcacggcgacagcagcgtgcccgtgtggagcggcatgaacgtggccggcgtgagcctgaagaccctgcaccccgacctgggcaccgacaaggacaaggagcagtggaaggaggtgcacaagcaggtggtggagagagtgttcaccgagtag

SEQ ID NO: 13022 - DNA, 813 bp, Artificial Sequence
  Description of Artificial Sequence: Synthetic coding sequence
atgctgcaggcctgcaagatggagggcttccccctggtgcccccccccagcgaggacctggtgccctacgacaccgacctgtaccagagacagacccacgagtactacccctacctgagcagcgacggcgagagccacagcgaccactactgggacttccacccccaccacgtgcacagcgagttcgagagcttcgccgagaacaacttcaccgagctgcagagcgtgcagcccccccagctgcagcagctgtacagacacatggagctggagcagatgcacgtgctggacacccccatggtgcccccccaccccagcctgggccaccaggtgagctacctgcccagaatgtgcctgcagtaccccagcctgagccccgcccagcccagcagcgacgaggaggagggcgagagacagagcccccccctggaggtgagcgacggcgaggccgacggcctggagcccggccccggcctgctgcccggcgagaccggcagcaagaagaagatcagactgtaccagttcctgctggacctgctgagaagcggcgacatgaaggacagcatctggtgggtggacaaggacaagggcaccttccagttcagcagcaagcacaaggaggccctggcccacagatggggcatccagaagggcaacagaaagaagatgacctaccagaagatggccagagccctgagaaactacggcaagaccggcgaggtgaagaaggtgaagaagaagctgacctaccagttcagcggcgaggtgctgggcagaggcggcctggccgagagaagacaccccccccactag

SEQ ID NO: 13023 - DNA, 2403 bp, Artificial Sequence
  Description of Artificial Sequence: Synthetic coding sequence
atgggcagcagcaagaagcacagaggcgagaaggaggccgccggcaccaccgccgccgccggcaccggcggcgccaccgagcagccccccagacacagagagcacaagaagcacaagcacagaagcggcggcagcggcggcagcggcggcgagagaagaaagagaagcagagagagaggcggcgagagaggcagcggcagaagaggcgccgaggccgaggccagaagcagcacccacggcagagagagaagccaggccgagcccagcgagagaagagtgaagagagagaagagagacgacggctacgaggccgccgccagcagcaagaccagcagcggcgacgccagcagcctgagcatcgaggagaccaacaagctgagagccaagctgggcctgaagcccctggaggtgaacgccatcaagaaggaggccggcaccaaggaggagcccgtgaccgccgacgtgatcaaccccatggccctgagacagagagaggagctgagagagaagctggccgccgccaaggagaagagactgctgaaccagaagctgggcaagatcaagaccctgggcgaggacgacccctggctggacgacaccgccgcctggatcgagagaagcagacagctgcagaaggagaaggacctggccgagaagagagccaagctgctggaggagatggaccaggagttcggcgtgagcaccctggtggaggaggagttcggccagagaagacaggacctgtacagcgccagagacctgcagggcctgaccgtggagcacgccatcgacagcttcagagagggcgagaccatgatcctgaccctgaaggacaagggcgtgctgcaggaggaggaggacgtgctggtgaacgtgaacctggtggacaaggagagagccgagaagaacgtggagctgagaaagaagaagcccgactacctgccctacgccgaggacgagagcgtggacgacctggcccagcagaagcccagaagcatcctgagcaagtacgacgaggagctggagggcgagagaccccacagcttcagactggagcagggcggcaccgccgacggcctgagagagagagagctggaggagatcagagccaagctgagactgcaggcccagagcctgagcaccgtgggccccagactggccagcgagtacctgacccccgaggagatggtgaccttcaagaagaccaagagaagagtgaagaagatcagaaagaaggagaaggaggtggtggtgagagccgacgacctgctgcccctgggcgaccagacccaggacggcgacttcggcagcagactgagaggcagaggcagaagaagagtgagcgaggtggaggaggagaaggagcccgtgccccagcccctgcccagcgacgacaccagagtggagaacatggacatcagcgacgaggaggagggcggcgcccccccccccggcagcccccaggtgctggaggaggacgaggccgagctggagctgcagaagcagctggagaagggcagaagactgagacagctgcagcagctgcagcagctgagagacagcggcgagaaggtggtggagatcgtgaagaagctggagagcagacagagaggctgggaggaggacgaggaccccgagagaaagggcgccatcgtgttcaacgccaccagcgagttctgcagaaccctgggcgagatccccacctacggcctggccggcaacagagaggagcaggaggagctgatggacttcgagagagacgaggagagaagcgccaacggcggcagcgagagcgacggcgaggagaacatcggctggagcaccgtgaacctggacgaggagaagcagcagcaggacttcagcgccagcagcaccaccatcctggacgaggagcccatcgtgaacagaggcctggccgccgccctgctgctgtgccagaacaagggcctgctggagaccaccgtgcagaaggtggccagagtgaaggcccccaacaagagcctgcccagcgccgtgtactgcatcgaggacaagatggccatcgacgacaagtacagcagaagagaggagtacagaggcttcacccaggacttcaaggagaaggacggctacaagcccgacgtgaagatcgagtacgtggacgagaccggcagaaagctgacccccaaggaggccttcagacagctgagccacagattccacggcaagggcagcggcaagatgaagaccgagagaagaatgaagaagctggacgaggaggccctgctgaagaagatgagcagcagcgacacccccctgggcaccgtggccctgctgcaggagaagcagaaggcccagaagaccccctacatcgtgctgagcggcagcggcaagagcatgaacgccaacaccatcaccaagtag

SEQ ID NO: 13024 - DNA, 1929 bp, Artificial Sequence
  Description of Artificial Sequence: Synthetic coding sequence
atggccctgagacagagagaggagctgagagagaagctggccgccgccaaggagaagagactgctgaaccagaagctgggcaagatcaagaccctgggcgaggacgacccctggctggacgacaccgccgcctggatcgagagaagcagacagctgcagaaggagaaggacctggccgagaagagagccaagctgctggaggagatggaccaggagttcggcgtgagcaccctggtggaggaggagttcggccagagaagacaggacctgtacagcgccagagacctgcagggcctgaccgtggagcacgccatcgacagcttcagagagggcgagaccatgatcctgaccctgaaggacaagggcgtgctgcaggaggaggaggacgtgctggtgaacgtgaacctggtggacaaggagagagccgagaagaacgtggagctgagaaagaagaagcccgactacctgccctacgccgaggacgagagcgtggacgacctggcccagcagaagcccagaagcatcctgagcaagtacgacgaggagctggagggcgagagaccccacagcttcagactggagcagggcggcaccgccgacggcctgagagagagagagctggaggagatcagagccaagctgagactgcaggcccagagcctgagcaccgtgggccccagactggccagcgagtacctgacccccgaggagatggtgaccttcaagaagaccaagagaagagtgaagaagatcagaaagaaggagaaggaggtggtggtgagagccgacgacctgctgcccctgggcgaccagacccaggacggcgacttcggcagcagactgagaggcagaggcagaagaagagtgagcgaggtggaggaggagaaggagcccgtgccccagcccctgcccagcgacgacaccagagtggagaacatggacatcagcgacgaggaggagggcggcgcccccccccccggcagcccccaggtgctggaggaggacgaggccgagctggagctgcagaagcagctggagaagggcagaagactgagacagctgcagcagctgcagcagctgagagacagcggcgagaaggtggtggagatcgtgaagaagctggagagcagacagagaggctgggaggaggacgaggaccccgagagaaagggcgccatcgtgttcaacgccaccagcgagttctgcagaaccctgggcgagatccccacctacggcctggccggcaacagagaggagcaggaggagctgatggacttcgagagagacgaggagagaagcgccaacggcggcagcgagagcgacggcgaggagaacatcggctggagcaccgtgaacctggacgaggagaagcagcagcaggacttcagcgccagcagcaccaccatcctggacgaggagcccatcgtgaacagaggcctggccgccgccctgctgctgtgccagaacaagggcctgctggagaccaccgtgcagaaggtggccagagtgaaggcccccaacaagagcctgcccagcgccgtgtactgcatcgaggacaagatggccatcgacgacaagtacagcagaagagaggagtacagaggcttcacccaggacttcaaggagaaggacggctacaagcccgacgtgaagatcgagtacgtggacgagaccggcagaaagctgacccccaaggaggccttcagacagctgagccacagattccacggcaagggcagcggcaagatgaagaccgagagaagaatgaagaagctggacgaggaggccctgctgaagaagatgagcagcagcgacacccccctgggcaccgtggccctgctgcaggagaagcagaaggcccagaagaccccctacatcgtgctgagcggcagcggcaagagcatgaacgccaacaccatcaccaagtag

SEQ ID NO: 13025 - DNA, 4392 bp, Artificial Sequence
  Description of Artificial Sequence: Synthetic coding sequence
atgaagaagaagaccgtgtgcaccctgaacatgggcgacaagaagtacgaggacatggagggcgaggagaacggcgacaacaccatcagcaccggcctgctgtacagcgaggccgacagatgccccatctgcctgaactgcctgctggagaaggaggtgggcttccccgagagctgcaaccacgtgttctgcatgacctgcatcctgaagtgggccgagaccctggccagctgccccatcgacagaaagcccttccaggccgtgttcaagttcagcgccctggagggctacgtgaaggtgcaggtgaagaagcagctgagagagaccaaggacaagaagaacgagaacagcttcgagaagcaggtgagctgccacgagaacagcaagagctgcatcagaagaaaggccatcgtgagagaggacctgctgagcgccaaggtgtgcgacctgaagtggatccacagaaacagcctgtacagcgagaccggcggcaagaagaacgccgccatcaagatcaacaagccccagagaagcaactggagcaccaaccagtgcttcagaaacttcttcagcaacatgttcagcagcgtgagccacagcggcgagagcagcttcacctacagagcctactgcaccgagttcatcgaggccagcgagatcagcgccctgatcagacagaagagacacgagctggagctgagctggttccccgacaccctgcccggcatcggcagaatcggcttcatcccctggaacgtggagaccgaggtgctgcccctgatcagcagcgtgctgcccagaaccatcttccccaccagcaccatcagcttcgagcacttcggcaccagctgcaagggctacgccctggcccacacccaggagggcgaggagaagaagcagaccagcggcaccagcaacaccagaggcagcagaagaaagcccgccatgaccacccccaccagaagaagcaccagaaacaccagagccgagaccgccagccagagccagagaagccccatcagcgacaacagcggctgcgacgcccccggcaacagcaaccccagcctgagcgtgcccagcagcgccgagagcgagaagcagaccagacaggcccccaagagaaagagcgtgagaagaggcagaaagccccccctgctgaagaagaagctgagaagcagcgtggccgcccccgagaagagcagcagcaacgacagcgtggacgaggagaccgccgagagcgacaccagccccgtgctggagaaggagcaccagcccgacgtggacagcagcaacatctgcaccgtgcagacccacgtggagaaccagagcgccaactgcctgaagagctgcaacgagcagatcgaggagagcgagaagcacaccgccaactacgacaccgaggagagagtgggcagcagcagcagcgagagctgcgcccaggacctgcccgtgctggtgggcgaggagggcgaggtgaagaagctggagaacaccggcatcgaggccaacgtgctgtgcctggagagcgagatcagcgagaacatcctggagaagggcggcgaccccctggagaagcaggaccagatcagcggcctgagccagagcgaggtgaagaccgacgtgtgcaccgtgcacctgcccaacgacttccccacctgcctgaccagcgagagcaaggtgtaccagcccgtgagctgccccctgagcgacctgagcgagaacgtggagagcgtggtgaacgaggagaagatcaccgagagcagcctggtggagatcaccgagcacaaggacttcaccctgaagaccgaggagctgatcgagagccccaagctggagagcagcgagggcgagatcatccagaccgtggacagacagagcgtgaagagccccgaggtgcagctgctgggccacgtggagaccgaggacgtggagatcatcgccacctgcgacaccttcggcaacgaggacttcaacaacatccaggacagcgagaacaacctgctgaagaacaacctgctgaacaccaagctggagaagagcctggaggagaagaacgagagcctgaccgagcaccccagaagcaccgagctgcccaagacccacatcgagcagatccagaagcacttcagcgaggacaacaacgagatgatccccatggagtgcgacagcttctgcagcgaccagaacgagagcgaggtggagcccagcgtgaacgccgacctgaagcagatgaacgagaacagcgtgacccactgcagcgagaacaacatgcccagcagcgacctggccgacgagaaggtggagaccgtgagccagcccagcgagagccccaaggacaccatcgacaagaccaagaagcccagaaccagaagaagcagattccacagccccagcaccacctggagccccaacaaggacaccccccaggagaagaagagaccccagagccccagccccagaagagagaccggcaaggagagcagaaagagccagagccccagccccaagaacgagagcgccagaggcagaaagaagagcagaagccagagccccaagaaggacatcgccagagagagaagacagagccagagcagaagccccaagagagacaccaccagagagagcagaagaagcgagagcctgagccccagaagagagaccagcagagagaacaagagaagccagcccagagtgaaggacagcagccccggcgagaagagcagaagccagagcagagagagagagagcgacagagacggccagagaagagagagagagagaagaaccagaaagtggagcagaagcagaagccacagcagaagccccagcagatgcagaaccaagagcaagagcagcagcttcggcagaatcgacagagacagctacagccccagatggaagggcagatgggccaacgacggctggagatgccccagaggcaacgacagatacagaaagaacgaccccgagaagcagaacgagaacaccagaaaggagaagaacgacatccacctggacgccgacgaccccaacagcgccgacaagcacagaaacgactgccccaactggatcaccgagaagatcaacagcggccccgaccccagaaccagaaaccccgagaagctgaaggagagccactgggaggagaacagaaacgagaacagcggcaacagctggaacaagaacttcggcagcggctgggtgagcaacagaggcagaggcagaggcaacagaggcagaggcacctacagaagcagcttcgcctacaaggaccagaacgagaacagatggcagaacagaaagcccctgagcggcaacagcaacagcagcggcagcgagagcttcaagttcgtggagcagcagagctacaagagaaagagcgagcaggagttcagcttcgacacccccgccgacagaagcggctggaccagcgccagcagctgggccgtgagaaagaccctgcccgccgacgtgcagaactactacagcagaagaggcagaaacagcagcggcccccagagcggctggatgaagcaggaggaggagaccagcggccaggacagcagcctgaaggaccagaccaaccagcaggtggacggcagccagctgcccatcaacatgatgcagccccagatgaacgtgatgcagcagcagatgaacgcccagcaccagcccatgaacatcttcccctaccccgtgggcgtgcacgcccccctgatgaacatccagagaaaccccttcaacatccacccccagctgcccctgcacctgcacaccggcgtgcccctgatgcaggtggccacccccaccagcgtgagccagggcctgcccccccccccccccccccccccccccagccagcaggtgaactacatcgccagccagcccgacggcaagcagctgcagggcatccccagcagcagccacgtgagcaacaacatgagcacccccgtgctgcccgcccccaccgccgcccccggcaacaccggcatggtgcagggccccagcagcggcaacaccagcagcagcagccacagcaaggccagcaacgccgccgtgaagctggccgagagcaaggtgagcgtggccgtggaggccagcgccgacagcagcaagaccgacaagaagctgcagatccaggagaaggccgcccaggaggtgaagctggccatcaagcccttctaccagaacaaggacatcaccaaggaggagtacaaggagatcgtgagaaaggccgtggacaaggtgtgccacagcaagagcggcgaggtgaacagcaccaaggtggccaacctggtgaaggcctacgtggacaagtacaagtacagcagaaagggcagccagaagaagaccctggaggagcccgtgagcaccgagaagaacatcggctag

SEQ ID NO: 13026 - DNA, 4392 bp, Artificial Sequence; identical to SEQ ID NO: 13025
  Description of Artificial Sequence: Synthetic coding sequence

SEQ ID NO: 13027 - DNA, 3447 bp, Artificial Sequence
  Description of Artificial Sequence: Synthetic coding sequence
atgaccacccccaccagaagaagcaccagaaacaccagagccgagaccgccagccagagccagagaagccccatcagcgacaacagcggctgcgacgcccccggcaacagcaaccccagcctgagcgtgcccagcagcgccgagagcgagaagcagaccagacaggcccccaagagaaagagcgtgagaagaggcagaaagccccccctgctgaagaagaagctgagaagcagcgtggccgcccccgagaagagcagcagcaacgacagcgtggacgaggagaccgccgagagcgacaccagccccgtgctggagaaggagcaccagcccgacgtggacagcagcaacatctgcaccgtgcagacccacgtggagaaccagagcgccaactgcctgaagagctgcaacgagcagatcgaggagagcgagaagcacaccgccaactacgacaccgaggagagagtgggcagcagcagcagcgagagctgcgcccaggacctgcccgtgctggtgggcgaggagggcgaggtgaagaagctggagaacaccggcatcgaggccaacgtgctgtgcctggagagcgagatcagcgagaacatcctggagaagggcggcgaccccctggagaagcaggaccagatcagcggcctgagccagagcgaggtgaagaccgacgtgtgcaccgtgcacctgcccaacgacttccccacctgcctgaccagcgagagcaaggtgtaccagcccgtgagctgccccctgagcgacctgagcgagaacgtggagagcgtggtgaacgaggagaagatcaccgagagcagcctggtggagatcaccgagcacaaggacttcaccctgaagaccgaggagctgatcgagagccccaagctggagagcagcgagggcgagatcatccagaccgtggacagacagagcgtgaagagccccgaggtgcagctgctgggccacgtggagaccgaggacgtggagatcatcgccacctgcgacaccttcggcaacgaggacttcaacaacatccaggacagcgagaacaacctgctgaagaacaacctgctgaacaccaagctggagaagagcctggaggagaagaacgagagcctgaccgagcaccccagaagcaccgagctgcccaagacccacatcgagcagatccagaagcacttcagcgaggacaacaacgagatgatccccatggagtgcgacagcttctgcagcgaccagaacgagagcgaggtggagcccagcgtgaacgccgacctgaagcagatgaacgagaacagcgtgacccactgcagcgagaacaacatgcccagcagcgacctggccgacgagaaggtggagaccgtgagccagcccagcgagagccccaaggacaccatcgacaagaccaagaagcccagaaccagaagaagcagattccacagccccagcaccacctggagccccaacaaggacaccccccaggagaagaagagaccccagagccccagccccagaagagagaccggcaaggagagcagaaagagccagagccccagccccaagaacgagagcgccagaggcagaaagaagagcagaagccagagccccaagaaggacatcgccagagagagaagacagagccagagcagaagccccaagagagacaccaccagagagagcagaagaagcgagagcctgagccccagaagagagaccagcagagagaacaagagaagccagcccagagtgaaggacagcagccccggcgagaagagcagaagccagagcagagagagagagagcgacagagacggccagagaagagagagagagagaagaaccagaaagtggagcagaagcagaagccacagcagaagccccagcagatgcagaaccaagagcaagagcagcagcttcggcagaatcgacagagacagctacagccccagatggaagggcagatgggccaacgacggctggagatgccccagaggcaacgacagatacagaaagaacgaccccgagaagcagaacgagaacaccagaaaggagaagaacgacatccacctggacgccgacgaccccaacagcgccgacaagcacagaaacgactgccccaactggatcaccgagaagatcaacagcggccccgaccccagaaccagaaaccccgagaagctgaaggagagccactgggaggagaacagaaacgagaacagcggcaacagctggaacaagaacttcggcagcggctgggtgagcaacagaggcagaggcagaggcaacagaggcagaggcacctacagaagcagcttcgcctacaaggaccagaacgagaacagatggcagaacagaaagcccctgagcggcaacagcaacagcagcggcagcgagagcttcaagttcgtggagcagcagagctacaagagaaagagcgagcaggagttcagcttcgacacccccgccgacagaagcggctggaccagcgccagcagctgggccgtgagaaagaccctgcccgccgacgtgcagaactactacagcagaagaggcagaaacagcagcggcccccagagcggctggatgaagcaggaggaggagaccagcggccaggacagcagcctgaaggaccagaccaaccagcaggtggacggcagccagctgcccatcaacatgatgcagccccagatgaacgtgatgcagcagcagatgaacgcccagcaccagcccatgaacatcttcccctaccccgtgggcgtgcacgcccccctgatgaacatccagagaaaccccttcaacatccacccccagctgcccctgcacctgcacaccggcgtgcccctgatgcaggtggccacccccaccagcgtgagccagggcctgcccccccccccccccccccccccccccagccagcaggtgaactacatcgccagccagcccgacggcaagcagctgcagggcatccccagcagcagccacgtgagcaacaacatgagcacccccgtgctgcccgcccccaccgccgcccccggcaacaccggcatggtgcagggccccagcagcggcaacaccagcagcagcagccacagcaaggccagcaacgccgccgtgaagctggccgagagcaaggtgagcgtggccgtggaggccagcgccgacagcagcaagaccgacaagaagctgcagatccaggagaaggccgcccaggaggtgaagctggccatcaagcccttctaccagaacaaggacatcaccaaggaggagtacaaggagatcgtgagaaaggccgtggacaaggtgtgccacagcaagagcggcgaggtgaacagcaccaaggtggccaacctggtgaaggcctacgtggacaagtacaagtacagcagaaagggcagccagaagaagaccctggaggagcccgtgagcaccgagaagaacatcggctag

SEQ ID NO: 13028 - DNA, 1401 bp, Artificial Sequence
  Description of Artificial Sequence: Synthetic coding sequence
atggccgaggagcaggacctgagcgaggtggagctgagccccgtgggcagcgaggagcccagatgcctgagccccggcagcgcccccagcctgggccccgacggcggcggcggcggcagcggcctgagagccagccccggccccggcgagctgggcaaggtgaagaaggagcagcaggacggcgaggccgacgacgacaagttccccgtgtgcatcagagaggccgtgagccaggtgctgagcggctacgactggaccctggtgcccatgcccgtgagagtgaacggcgccagcaagagcaagccccacgtgaagagacccatgaacgccttcatggtgtgggcccaggccgccagaagaaagctggccgaccagtacccccacctgcacaacgccgagctgagcaagaccctgggcaagctgtggagactgctgaacgagagcgacaagagacccttcatcgaggaggccgagagactgagaatgcagcacaagaaggaccaccccgactacaagtaccagcccagaagaagaaagaacggcaaggccgcccagggcgaggccgagtgccccggcggcgaggccgagcagggcggcaccgccgccatccaggcccactacaagagcgcccacctggaccacagacaccccggcgagggcagccccatgagcgacggcaaccccgagcaccccagcggccagagccacggcccccccaccccccccaccacccccaagaccgagctgcagagcggcaaggccgaccccaagagagacggcagaagcatgggcgagggcggcaagccccacatcgacttcggcaacgtggacatcggcgagatcagccacgaggtgatgagcaacatggagaccttcgacgtggccgagctggaccagtacctgccccccaacggccaccccggccacgtgagcagctacagcgccgccggctacggcctgggcagcgccctggccgtggccagcggccacagcgcctggatcagcaagccccccggcgtggccctgcccaccgtgagcccccccggcgtggacgccaaggcccaggtgaagaccgagaccgccggcccccagggccccccccactacaccgaccagcccagcaccagccagatcgcctacaccagcctgagcctgccccactacggcagcgccttccccagcatcagcagaccccagttcgactacagcgaccaccagcccagcggcccctactacggccacagcggccaggccagcggcctgtacagcgccttcagctacatgggccccagccagagacccctgtacaccgccatcagcgaccccagccccagcggcccccagagccacagccccacccactgggagcagcccgtgtacaccaccctgagcagaccctag

SEQ ID NO: 13029 - DNA, 1401 bp, Artificial Sequence; identical to SEQ ID NO: 13028
  Description of Artificial Sequence: Synthetic coding sequence

SEQ ID NO: 13030 - DNA, 861 bp, Artificial Sequence
  Description of Artificial Sequence: Synthetic coding sequence
atggccgaggagcaggacctgagcgaggtggagctgagccccgtgggcagcgaggagcccagatgcctgagccccggcagcgcccccagcctgggccccgacggcggcggcggcggcagcggcctgagagccagccccggccccggcgagctgggcaaggtgaagaaggagcagcaggacggcgaggccgacgacgacaagttccccgtgtgcatcagagaggccgtgagccaggtgctgagcggctacgactggaccctggtgcccatgcccgtgagagtgaacggcgccagcaagagcaagccccacgtgaagagacccatgaacgccttcatggtgtgggcccaggccgccagaagaaagctggccgaccagtacccccacctgcacaacgccgagctgagcaagaccctgggcaagctgtggagactgctgaacgagagcgacaagagacccttcatcgaggaggccgagagactgagaatgcagcacaagaaggaccaccccgactacaagtaccagcccagaagaagaaagaacggcaaggccgcccagggcgaggccgagtgccccggcggcgaggccgagcagggcggcaccgccgccatccaggcccactacaagagcgcccacctggaccacagacaccccggcgagggcagccccatgagcgacggcaaccccgagcaccccagcggccagagccacggcccccccaccccccccaccacccccaagaccgagctgcagagcggcaaggccgaccccaagagagacggcagacccagccccagcggcccccagagccacagccccacccactgggagcagcccgtgtacaccaccctgagcagaccctag

SEQ ID NO: 13031 - DNA, 642 bp, Artificial Sequence
  Description of Artificial Sequence: Synthetic coding sequence
atggccgaggagcaggacctgagcgaggtggagctgagccccgtgggcagcgaggagcccagatgcctgagccccggcagcgcccccagcctgggccccgacggcggcggcggcggcagcggcctgagagccagccccggccccggcgagctgggcaaggtgaagaaggagcagcaggacggcgaggccgacgacgacaagttccccgtgtgcatcagagaggccgtgagccaggtgctgagcggctacgactggaccctggtgcccatgcccgtgagagtgaacggcgccagcaagagcaagccccacgtgaagagacccatgaacgccttcatggtgtgggcccaggccgccagaagaaagctggccgaccagtacccccacctgcacaacgccgagctgagcaagaccctgggcaagctgtggagactgctgaacgagagcgacaagagacccttcatcgaggaggccgagagactgagaatgcagcacaagaaggaccaccccgactacaagtaccagcccagaagaagaaagaacggcaaggccgcccagggcgaggccgagtgccccggcggcgaggccgagcagggcggcaccgccgccatccaggcccactacaagagcgcccacctggactag

SEQ ID NO: 13032 - DNA, 1425 bp, Artificial Sequence
  Description of Artificial Sequence: Synthetic coding sequence
atggtgcagcagaccaacaacgccgagaacaccgaggccctgctggccggcgagagcagcgacagcggcgccggcctggagctgggcatcgccagcagccccacccccggcagcaccgccagcaccggcggcaaggccgacgaccccagctggtgcaagacccccagcggccacatcaagagacccatgaacgccttcatggtgtggagccagatcgagagaagaaagatcatggagcagagccccgacatgcacaacgccgagatcagcaagagactgggcaagagatggaagctgctgaaggacagcgacaagatccccttcatcagagaggccgagagactgagactgaagcacatggccgactaccccgactacaagtacagacccagaaagaaggtgaagagcggcaacgccaacagcagcagcagcgccgccgccagcagcaagcccggcgagaagggcgacaaggtgggcggcagcggcggcggcggccacggcggcggcggcggcggcggcagcagcaacgccggcggcggcggcggcggcgccagcggcggcggcgccaacagcaagcccgcccagaagaagagctgcggcagcaaggtggccggcggcgccggcggcggcgtgagcaagccccacgccaagctgatcctggccggcggcggcggcggcggcaaggccgccgccgccgccgccgccagcttcgccgccgagcaggccggcgccgccgccctgctgcccctgggcgccgccgccgaccaccacagcctgtacaaggccagaacccccagcgccagcgccagcgccagcagcgccgccagcgccagcgccgccctggccgcccccggcaagcacctggccgagaagaaggtgaagagagtgtacctgttcggcggcctgggcaccagcagcagccccgtgggcggcgtgggcgccggcgccgaccccagcgaccccctgggcctgtacgaggaggagggcgccggctgcagccccgacgcccccagcctgagcggcagaagcagcgccgccagcagccccgccgccggcagaagccccgccgaccacagaggctacgccagcctgagagccgccagccccgcccccagcagcgcccccagccacgccagcagcagcgccagcagccacagcagcagcagcagcagcagcggcagcagcagcagcgacgacgagttcgaggacgacctgctggacctgaaccccagcagcaacttcgagagcatgagcctgggcagcttcagcagcagcagcgccctggacagagacctggacttcaacttcgagcccggcagcggcagccacttcgagttccccgactactgcacccccgaggtgagcgagatgatcagcggcgactggctggagagcagcatcagcaacctggtgttcacctactag

SEQ ID NO: 13033 - DNA, 1425 bp, Artificial Sequence; identical to SEQ ID NO: 13032
  Description of Artificial Sequence: Synthetic coding sequence

SEQ ID NO: 13034 - DNA, 3318 bp, Artificial Sequence
  Description of Artificial Sequence: Synthetic coding sequence
atgctggagcccagcagcgtgctgcacgccaacgtgaaccaggcccccctgtggtgcctggtgctgagatggtgcagagagtgcaaggacaccgtgtgcggcggcaagcagaagagcagagtgaaccacaccttccagagaagagagatcgaggccaaggaggcctgcgactggctgagagccgccggcttcccccagtacgcccagctgtacgaggacagccagttccccatcaacatcgtggccgtgaagaacgaccacgacttcctggagaaggacctggtggagcccctgtgcagaagactgaacaccctgaacaagtgcgccagcatgaagctggacgtgaacttccagagaaagaagggcgacgacagcgacgaggaggacctgtgcatcagcaacaagtggaccttccagagaaccagcagaagatggagcagagtggacgacctgtacaccctgctgcccagaggcgacagaaacggcagccccggcggcaccggcatgagaaacaccaccagcagcgagagcgtgctgaccgacctgagcgagcccgaggtgtgcagcatccacagcgagagcagcggcggcagcgacagcagaagccagcccggccagtgctgcaccgacaaccccgtgatgctggacgcccccctggtgagcagcagcctgccccagccccccagagacgtgctgaaccaccccttccaccccaagaacgagaagcccaccagagccagagccaagagcttcctgaagagaatggagaccctgagaggcaagggcgcccacggcagacacaagggcagcggcagaaccggcggcctggtgatcagcggccccatgctgcagcaggagcccgagagcttcaaggccatgcagtgcatccagatccccaacggcgacctgcagaacagccccccccccgcctgcagaaagggcctgccctgcagcggcaagagcagcggcgagagcagccccagcgagcacagcagcagcggcgtgagcaccccctgcctgaaggagagaaagtgccacgaggccaacaagagaggcggcatgtacctggaggacctggacgtgctggccggcaccgccctgcccgacgccggcgaccagagcagaatgcacgagttccacagccaggagaacctggtggtgcacatccccaaggaccacaagcccggcaccttccccaaggccctgagcatcgagagcctgagccccaccgacagcagcaacggcgtgaactggagaaccggcagcatcagcctgggcagagagcaggtgcccggcgccagagagcccagactgatggccagctgccacagagccagcagagtgagcatctacgacaacgtgcccggcagccacctgtacgccagcaccggcgacctgctggacctggagaaggacgacctgttcccccacctggacgacatcctgcagcacgtgaacggcctgcaggaggtggtggacgactggagcaaggacgtgctgcccgagctgcagacccacgacaccctggtgggcgagcccggcctgagcaccttccccagccccaaccagatcaccctggacttcgagggcaacagcgtgagcgagggcagaaccacccccagcgacgtggagagagacgtgaccagcctgaacgagagcgagccccccggcgtgagagacagaagagacagcggcgtgggcgccagcctgaccagacccaacagaagactgagatggaacagcttccagctgagccaccagcccagacccgcccccgccagcccccacatcagcagccagaccgccagccagctgagcctgctgcagagattcagcctgctgagactgaccgccatcatggagaagcacagcatgagcaacaagcacggctggacctggagcgtgcccaagttcatgaagagaatgaaggtgcccgactacaaggacaaggccgtgttcggcgtgcccctgatcgtgcacgtgcagagaaccggccagcccctgccccagagcatccagcaggccctgagatacctgagaagcaactgcctggaccaggtgggcctgttcagaaagagcggcgtgaagagcagaatccacgccctgagacagatgaacgagaacttccccgagaacgtgaactacgaggaccagagcgcctacgacgtggccgacatggtgaagcagttcttcagagacctgcccgagcccctgttcaccaacaagctgagcgagaccttcctgcacatctaccagtacgtgagcaaggagcagagactgcaggccgtgcaggccgccatcctgctgctggccgacgagaacagagaggtgctgcagaccctgctgtgcttcctgaacgacgtggtgaacctggtggaggagaaccagatgacccccatgaacctggccgtgtgcctggcccccagcctgttccacctgaacctgctgaagaaggagagcagccccagagtgatccagaagaagtacgccaccggcaagcccgaccagaaggacctgaacgagaacctggccgccgcccagggcctggcccacatgatcatggagtgcgacagactgttcgaggtgccccacgagctggtggcccagagcagaaacagctacgtggaggccgagatccacgtgcccaccctggaggagctgggcacccagctggaggagagcggcgccaccttccacacctacctgaaccacctgatccagggcctgcagaaggaggccaaggagaagttcaagggctgggtgacctgcagcagcaccgacaacaccgacctggccttcaagaaggtgggcgacggcaaccccctgaagctgtggaaggccagcgtggaggtggaggccccccccagcgtggtgctgaacagagtgctgagagagagacacctgtgggacgaggacttcgtgcagtggaaggtggtggagaccctggacagacagaccgagatctaccagtacgtgctgaacagcatggccccccaccccagcagagacttcgtggtgctgagaacctggaagaccgacctgcccaagggcatgtgcaccctggtgagcctgagcgtggagcacgaggaggcccagctgctgggcggcgtgagagccgtggtgatggacagccagtacctgatcgagccctgcggcagcggcaagagcagactgacccacatctgcagaatcgacctgaagggccacagccccgagtggtacagcaagggcttcggccacctgtgcgccgccgaggtggccagaatcagaaacagcttccagcccctgatcgccgagggccccgagaccaagatctag

SEQ ID NO: 13035 - DNA, 3342 bp, Artificial Sequence
  Description of Artificial Sequence: Synthetic coding sequence
atgttcagccaggtgcccagaacccccgccagcggctgctactacctgaacagcatgacccccgagggccaggagatgtacctgagattcgaccagaccaccagaagaagcccctacagaatgagcagaatcctggccagacaccagctggtgaccaagatccagcaggagatcgaggccaaggaggcctgcgactggctgagagccgccggcttcccccagtacgcccagctgtacgaggacagccagttccccatcaacatcgtggccgtgaagaacgaccacgacttcctggagaaggacctggtggagcccctgtgcagaagactgaacaccctgaacaagtgcgccagcatgaagctggacgtgaacttccagagaaagaagggcgacgacagcgacgaggaggacctgtgcatcagcaacaagtggaccttccagagaaccagcagaagatggagcagagtggacgacctgtacaccctgctgcccagaggcgacagaaacggcagccccggcggcaccggcatgagaaacaccaccagcagcgagagcgtgctgaccgacctgagcgagcccgaggtgtgcagcatccacagcgagagcagcggcggcagcgacagcagaagccagcccggccagtgctgcaccgacaaccccgtgatgctggacgcccccctggtgagcagcagcctgccccagccccccagagacgtgctgaaccaccccttccaccccaagaacgagaagcccaccagagccagagccaagagcttcctgaagagaatggagaccctgagaggcaagggcgcccacggcagacacaagggcagcggcagaaccggcggcctggtgatcagcggccccatgctgcagcaggagcccgagagcttcaaggccatgcagtgcatccagatccccaacggcgacctgcagaacagccccccccccgcctgcagaaagggcctgccctgcagcggcaagagcagcggcgagagcagccccagcgagcacagcagcagcggcgtgagcaccccctgcctgaaggagagaaagtgccacgaggccaacaagagaggcggcatgtacctggaggacctggacgtgctggccggcaccgccctgcccgacgccggcgaccagagcagaatgcacgagttccacagccaggagaacctggtggtgcacatccccaaggaccacaagcccggcaccttccccaaggccctgagcatcgagagcctgagccccaccgacagcagcaacggcgtgaactggagaaccggcagcatcagcctgggcagagagcaggtgcccggcgccagagagcccagactgatggccagctgccacagagccagcagagtgagcatctacgacaacgtgcccggcagccacctgtacgccagcaccggcgacctgctggacctggagaaggacgacctgttcccccacctggacgacatcctgcagcacgtgaacggcctgcaggaggtggtggacgactggagcaaggacgtgctgcccgagctgcagacccacgacaccctggtgggcgagcccggcctgagcaccttccccagccccaaccagatcaccctggacttcgagggcaacagcgtgagcgagggcagaaccacccccagcgacgtggagagagacgtgaccagcctgaacgagagcgagccccccggcgtgagagacagaagagacagcggcgtgggcgccagcctgaccagacccaacagaagactgagatggaacagcttccagctgagccaccagcccagacccgcccccgccagcccccacatcagcagccagaccgccagccagctgagcctgctgcagagattcagcctgctgagactgaccgccatcatggagaagcacagcatgagcaacaagcacggctggacctggagcgtgcccaagttcatgaagagaatgaaggtgcccgactacaaggacaaggccgtgttcggcgtgcccctgatcgtgcacgtgcagagaaccggccagcccctgccccagagcatccagcaggccctgagatacctgagaagcaactgcctggaccaggtgggcctgttcagaaagagcggcgtgaagagcagaatccacgccctgagacagatgaacgagaacttccccgagaacgtgaactacgaggaccagagcgcctacgacgtggccgacatggtgaagcagttcttcagagacctgcccgagcccctgttcaccaacaagctgagcgagaccttcctgcacatctaccagtacgtgagcaaggagcagagactgcaggccgtgcaggccgccatcctgctgctggccgacgagaacagagaggtgctgcagaccctgctgtgcttcctgaacgacgtggtgaacctggtggaggagaaccagatgacccccatgaacctggccgtgtgcctggcccccagcctgttccacctgaacctgctgaagaaggagagcagccccagagtgatccagaagaagtacgccaccggcaagcccgaccagaaggacctgaacgagaacctggccgccgcccagggcctggcccacatgatcatggagtgcgacagactgttcgaggtgccccacgagctggtggcccagagcagaaacagctacgtggaggccgagatccacgtgcccaccctggaggagctgggcacccagctggaggagagcggcgccaccttccacacctacctgaaccacctgatccagggcctgcagaaggaggccaaggagaagttcaagggctgggtgacctgcagcagcaccgacaacaccgacctggccttcaagaaggtgggcgacggcaaccccctgaagctgtggaaggccagcgtggaggtggaggccccccccagcgtggtgctgaacagagtgctgagagagagacacctgtgggacgaggacttcgtgcagtggaaggtggtggagaccctggacagacagaccgagatctaccagtacgtgctgaacagcatggccccccaccccagcagagacttcgtggtgctgagaacctggaagaccgacctgcccaagggcatgtgcaccctggtgagcctgagcgtggagcacgaggaggcccagctgctgggcggcgtgagagccgtggtgatggacagccagtacctgatcgagccctgcggcagcggcaagagcagactgacccacatctgcagaatcgacctgaagggccacagccccgagtggtacagcaagggcttcggccacctgtgcgccgccgaggtggccagaatcagaaacagcttccagcccctgatcgccgagggccccgagaccaagatctag

SEQ ID NO: 13036 - DNA, 2064 bp, Artificial Sequence
  Description of Artificial Sequence: Synthetic coding sequence
atgctggagcccagcagcgtgctgcacgccaacgtgaaccaggcccccctgtggtgcctggtgctgagatggtgcagagagtgcaaggacaccgtgtgcggcggcaagcagaagagcagagtgaaccacaccttccagagaagagagatcgaggccaaggaggcctgcgactggctgagagccgccggcttcccccagtacgcccagctgtacgaggacagccagttccccatcaacatcgtggccgtgaagaacgaccacgacttcctggagaaggacctggtggagcccctgtgcagaagactgaacaccctgaacaagtgcgccagcatgaagctggacgtgaacttccagagaaagaagggcgacgacagcgacgaggaggacctgtgcatcagcaacaagtggaccttccagagaaccagcagaagatggagcagagtggacgacctgtacaccctgctgcccagaggcgacagaaacggcagccccggcggcaccggcatgagaaacaccaccagcagcgagagcgtgctgaccgacctgagcgagcccgaggtgtgcagcatccacagcgagagcagcggcggcagcgacagcagaagccagcccggccagtgctgcaccgacaaccccgtgatgctggacgcccccctggtgagcagcagcctgccccagccccccagagacgtgctgaaccaccccttccaccccaagaacgagaagcccaccagagccagagccaagagcttcctgaagagaatggagaccctgagaggcaagggcgcccacggcagacacaagggcagcggcagaaccggcggcctggtgatcagcggccccatgctgcagcaggagcccgagagcttcaaggccatgcagtgcatccagatccccaacggcgacctgcagaacagccccccccccgcctgcagaaagggcctgccctgcagcggcaagagcagcggcgagagcagccccagcgagcacagcagcagcggcgtgagcaccccctgcctgaaggagagaaagtgccacgaggccaacaagagaggcggcatgtacctggaggacctggacgtgctggccggcaccgccctgcccgacgccggcgaccagagcagaatgcacgagttccacagccaggagaacctggtggtgcacatccccaaggaccacaagcccggcaccttccccaaggccctgagcatcgagagcctgagccccaccgacagcagcaacggcgtgaactggagaaccggcagcatcagcctgggcagagagcaggtgcccggcgccagagagcccagactgatggccagctgccacagagccagcagagtgagcatctacgacaacgtgcccggcagccacctgtacgccagcaccggcgacctgctggacctggagaaggacgacctgttcccccacctggacgacatcctgcagcacgtgaacggcctgcaggaggtggtggacgactggagcaaggacgtgctgcccgagctgcagacccacgacaccctggtgggcgagcccggcctgagcaccttccccagccccaaccagatcaccctggacttcgagggcaacagcgtgagcgagggcagaaccacccccagcgacgtggagagagacgtgaccagcctgaacgagagcgagccccccggcgtgagagacagaagagacagcggcgtgggcgccagcctgaccagacccaacagaagactgagatggaacagcttccagctgagccaccagcccagacccgcccccgccagcccccacatcagcagccagaccgccagccagctgagcctgctgcagagattcagcctgctgagactgaccgccatcatggagaagcacagcatgagcaacaagcacggctggacctggagcgtgcccaagttcatgaagagaatgaaggtgcccgactacaaggacaaggccgtgttcggcgtgcccctgatcgtgcacgtgcagagaaccggccagcccctgccccagagcatccagcaggccctgagatacctgagaagcaactgcctggaccaggagtag

SEQ ID NO: 13037 - DNA, 2988 bp, Artificial Sequence
  Description of Artificial Sequence: Synthetic coding sequence
atgaagctggacgtgaacttccagagaaagaagggcgacgacagcgacgaggaggacctgtgcatcagcaacaagtggaccttccagagaaccagcagaagatggagcagagtggacgacctgtacaccctgctgcccagaggcgacagaaacggcagccccggcggcaccggcatgagaaacaccaccagcagcgagagcgtgctgaccgacctgagcgagcccgaggtgtgcagcatccacagcgagagcagcggcggcagcgacagcagaagccagcccggccagtgctgcaccgacaaccccgtgatgctggacgcccccctggtgagcagcagcctgccccagccccccagagacgtgctgaaccaccccttccaccccaagaacgagaagcccaccagagccagagccaagagcttcctgaagagaatggagaccctgagaggcaagggcgcccacggcagacacaagggcagcggcagaaccggcggcctggtgatcagcggccccatgctgcagcaggagcccgagagcttcaaggccatgcagtgcatccagatccccaacggcgacctgcagaacagccccccccccgcctgcagaaagggcctgccctgcagcggcaagagcagcggcgagagcagccccagcgagcacagcagcagcggcgtgagcaccccctgcctgaaggagagaaagtgccacgaggccaacaagagaggcggcatgtacctggaggacctggacgtgctggccggcaccgccctgcccgacgccggcgaccagagcagaatgcacgagttccacagccaggagaacctggtggtgcacatccccaaggaccacaagcccggcaccttccccaaggccctgagcatcgagagcctgagccccaccgacagcagcaacggcgtgaactggagaaccggcagcatcagcctgggcagagagcaggtgcccggcgccagagagcccagactgatggccagctgccacagagccagcagagtgagcatctacgacaacgtgcccggcagccacctgtacgccagcaccggcgacctgctggacctggagaaggacgacctgttcccccacctggacgacatcctgcagcacgtgaacggcctgcaggaggtggtggacgactggagcaaggacgtgctgcccgagctgcagacccacgacaccctggtgggcgagcccggcctgagcaccttccccagccccaaccagatcaccctggacttcgagggcaacagcgtgagcgagggcagaaccacccccagcgacgtggagagagacgtgaccagcctgaacgagagcgagccccccggcgtgagagacagaagagacagcggcgtgggcgccagcctgaccagacccaacagaagactgagatggaacagcttccagctgagccaccagcccagacccgcccccgccagcccccacatcagcagccagaccgccagccagctgagcctgctgcagagattcagcctgctgagactgaccgccatcatggagaagcacagcatgagcaacaagcacggctggacctggagcgtgcccaagttcatgaagagaatgaaggtgcccgactacaaggacaaggccgtgttcggcgtgcccctgatcgtgcacgtgcagagaaccggccagcccctgccccagagcatccagcaggccctgagatacctgagaagcaactgcctggaccaggtgggcctgttcagaaagagcggcgtgaagagcagaatccacgccctgagacagatgaacgagaacttccccgagaacgtgaactacgaggaccagagcgcctacgacgtggccgacatggtgaagcagttcttcagagacctgcccgagcccctgttcaccaacaagctgagcgagaccttcctgcacatctaccagtacgtgagcaaggagcagagactgcaggccgtgcaggccgccatcctgctgctggccgacgagaacagagaggtgctgcagaccctgctgtgcttcctgaacgacgtggtgaacctggtggaggagaaccagatgacccccatgaacctggccgtgtgcctggcccccagcctgttccacctgaacctgctgaagaaggagagcagccccagagtgatccagaagaagtacgccaccggcaagcccgaccagaaggacctgaacgagaacctggccgccgcccagggcctggcccacatgatcatggagtgcgacagactgttcgaggtgccccacgagctggtggcccagagcagaaacagctacgtggaggccgagatccacgtgcccaccctggaggagctgggcacccagctggaggagagcggcgccaccttccacacctacctgaaccacctgatccagggcctgcagaaggaggccaaggagaagttcaagggctgggtgacctgcagcagcaccgacaacaccgacctggccttcaagaaggtgggcgacggcaaccccctgaagctgtggaaggccagcgtggaggtggaggccccccccagcgtggtgctgaacagagtgctgagagagagacacctgtgggacgaggacttcgtgcagtggaaggtggtggagaccctggacagacagaccgagatctaccagtacgtgctgaacagcatggccccccaccccagcagagacttcgtggtgctgagaacctggaagaccgacctgcccaagggcatgtgcaccctggtgagcctgagcgtggagcacgaggaggcccagctgctgggcggcgtgagagccgtggtgatggacagccagtacctgatcgagccctgcggcagcggcaagagcagactgacccacatctgcagaatcgacctgaagggccacagccccgagtggtacagcaagggcttcggccacctgtgcgccgccgaggtggccagaatcagaaacagcttccagcccctgatcgccgagggccccgagaccaagatctag

SEQ ID NO: 13038 - DNA, 450 bp, Artificial Sequence
  Description of Artificial Sequence: Synthetic coding sequence
atggccagcagcgacatccaggtgaaggagctggagaagagagccagcggccaggccttcgagctgatcctgagccccagaagcaaggagagcgtgcccgagttccccctgagcccccccaagaagaaggacctgagcctggaggagatccagaagaagctggaggccgccgaggagagaagaaagagccacgaggccgaggtgctgaagcagctggccgagaagagagagcacgagaaggaggtgctgcagaaggccatcgaggagaacaacaacttcagcaagatggccgaggagaagctgacccacaagatggaggccaacaaggagaacagagaggcccagatggccgccaagctggagagactgagagagaaggacaagcacatcgaggaggtgagaaagaacaaggagagcaaggaccccgccgacgagaccgaggccgactag

SEQ ID NO: 13039 - DNA, 450 bp, Artificial Sequence; identical to SEQ ID NO: 13038
  Description of Artificial Sequence: Synthetic coding sequence

SEQ ID NO: 13040 - DNA, 450 bp, Artificial Sequence; identical to SEQ ID NO: 13038
  Description of Artificial Sequence: Synthetic coding sequence

SEQ ID NO: 13041 - DNA, 525 bp, Artificial Sequence
  Description of Artificial Sequence: Synthetic coding sequence
atggccagcagcgacatccaggtgaaggagctggagaagagagccagcggccaggccttcgagctgatcctgagccccagaagcaaggagagcgtgcccgagttccccctgagcccccccaagaagaaggacctgagcctggaggagatccagaagaagctggaggccgccgaggagagaagaaagagccacgaggccgaggtgctgaagcagctggccgagaagagagagcacgagaaggaggtgctgcagaaggccatcgaggagaacaacaacttcagcaagatggccgaggagaagctgacccacaagatggaggccaacaaggagaacagagaggcccagatggccgccaagctggagagactgagagagaagatgtacttctggacccacggccccggcgcccaccccgcccagatcagcgccgagcagagctgcctgcacagcgtgcccgccctgtgccccgccctgggcctgcagagcgccctgatcacctggagcgacctgagccaccaccactag

SEQ ID NO: 13042 - DNA, 261 bp, Artificial Sequence
  Description of Artificial Sequence: Synthetic coding sequence
atggccagcagcgacatccaggtgaaggagctggagaagagagccagcggccaggccttcgagctgatcctgagccccagaagcaaggagagcgtgcccgagttccccctgagcccccccaagaagaaggacctgagcctggaggagatccagaagaagctggaggccgccgaggagagaagaaagagccacgaggccgaggtgctgaagcagctggccgagaagagagagcacgagaaggaggtgctgcagaaggcctag

SEQ ID NO: 13043 - DNA, 450 bp, Artificial Sequence; identical to SEQ ID NO: 13038
  Description of Artificial Sequence: Synthetic coding sequence

SEQ ID NO: 13044 - DNA, 3615 bp, Artificial Sequence
  Description of Artificial Sequence: Synthetic coding sequence
atgagcttcttcaacttcagaaagatcttcaagctgggcagcgagaagaagaagaagcagtacgagcacgtgaagagagacctgaaccccgaggacttctgggagatcatcggcgagctgggcgacggcgccttcggcaaggtgtacaaggcccagaacaaggagaccagcgtgctggccgccgccaaggtgatcgacaccaagagcgaggaggagctggaggactacatggtggagatcgacatcctggccagctgcgaccaccccaacatcgtgaagctgctggacgccttctactacgagaacaacctgtggatcctgatcgagttctgcgccggcggcgccgtggacgccgtgatgctggagctggagagacccctgaccgagagccagatccaggtggtgtgcaagcagaccctggacgccctgaactacctgcacgacaacaagatcatccacagagacctgaaggccggcaacatcctgttcaccctggacggcgacatcaagctggccgacttcggcgtgagcgccaagaacaccagaaccatccagagaagagacagcttcatcggcaccccctactggatggcccccgaggtggtgatgtgcgagaccagcaaggacagaccctacgactacaaggccgacgtgtggagcctgggcatcaccctgatcgagatggccgagatcgagcccccccaccacgagctgaaccccatgagagtgctgctgaagatcgccaagagcgagccccccaccctggcccagcccagcagatggagcagcaacttcaaggacttcctgaagaagtgcctggagaagaacgtggacgccagatggaccaccagccagctgctgcagcaccccttcgtgaccgtggacagcaacaagcccatcagagagctgatcgccgaggccaaggccgaggtgaccgaggaggtggaggacggcaaggaggaggacgaggaggaggagaccgagaacagcctgcccatccccgccagcaagagagccagcagcgacctgagcatcgccagcagcgaggaggacaagctgagccagaacgcctgcatcctggagagcgtgagcgagaagaccgagagaagcaacagcgaggacaagctgaacagcaagatcctgaacgagaagcccaccaccgacgagcccgagaaggccgtggaggacatcaacgagcacatcaccgacgcccagctggaggccatgaccgagctgcacgacagaaccgccgtgatcaaggagaacgagagagagaagagacccaagctggagaacctgcccgacaccgaggaccaggagaccgtggacatcaacagcgtgagcgagggcaaggagaacaacatcatgatcaccctggagaccaacatcgagcacaacctgaagagcgaggaggagaaggaccaggagaagcagcagatgttcgagaacaagctgatcaagagcgaggagatcaaggacaccatcctgcagaccgtggacctggtgagccaggagaccggcgagaaggaggccaacatccaggccgtggacagcgaggtgggcctgaccaaggaggacacccaggagaagctgggcgaggacgacaagacccagaaggacgtgatcagcaacaccagcgacgtgatcggcacctgcgaggccgccgacgtggcccagaaggtggacgaggacagcgccgaggacacccagagcaacgacggcaaggaggtggtggaggtgggccagaagctgatcaacaagcccatggtgggccccgaggccggcggcaccaaggaggtgcccatcaaggagatcgtggagatgaacgagatcgaggagggcaagaacaaggagcaggccatcaacagcagcgagaacatcatggacatcaacgaggagcccggcaccaccgagggcgaggagatcaccgagagcagcagcaccgaggagatggaggtgagaagcgtggtggccgacaccgaccagaaggccctgggcagcgaggtgcaggacgccagcaaggtgaccacccagatcgacaaggagaagaaggagatccccgtgagcatcaagaaggagcccgaggtgaccgtggtgagccagcccaccgagccccagcccgtgctgatccccagcatcaacatcaacagcgacagcggcgagaacaaggaggagatcggcagcctgagcaagaccgagaccatcctgccccccgagagcgagaaccccaaggagaacgacaacgacagcggcaccggcagcaccgccgacaccagcagcatcgacctgaacctgagcatcagcagcttcctgagcaagaccaaggacagcggcagcatcagcctgcaggagaccagaagacagaagaagaccctgaagaagaccagaaagttcatcgtggacggcgtggaggtgagcgtgaccaccagcaagatcgtgaccgacagcgacagcaagaccgaggagctgagattcctgagaagacaggagctgagagagctgagattcctgcagaaggaggagcagagagcccagcagcagctgaacagcaagctgcagcagcagagagagcagatcttcagaagattcgagcaggagatgatgagcaagaagagacagtacgaccaggagatcgagaacctggagaagcagcagaagcagaccatcgagagactggagcaggagcacaccaacagactgagagacgaggccaagagaatcaagggcgagcaggagaaggagctgagcaagttccagaacatgctgaagaacagaaagaaggaggagcaggagttcgtgcagaagcagcagcaggagctggacggcagcctgaagaagatcatccagcagcagaaggccgagctggccaacatcgagagagagtgcctgaacaacaagcagcagctgatgagagccagagaggccgccatctgggagctggaggagagacacctgcaggagaagcaccagctgctgaagcagcagctgaaggaccagtacttcatgcagagacaccagctgctgaagagacacgagaaggagaccgagcagatgcagagatacaaccagagactgatcgaggagctgaagaacagacagacccaggagagagccagactgcccaagatccagagaagcgaggccaagaccagaatggccatgttcaagaagagcctgagaatcaacagcaccgccacccccgaccaggacagagacaagatcaagcagttcgccgcccaggaggagaagagacagaagaacgagagaatggcccagcaccagaagcacgagaaccagatgagagacctgcagctgcagtgcgaggccaacgtgagagagctgcaccagctgcagaacgagaagtgccacctgctggtggagcacgagacccagaagctgaaggagctggacgaggagcacagccaggagctgaaggagtggagagagaagctgagacccagaaagaagaccctggaggaggagttcgccagaaagctgcaggagcaggaggtgttcttcaagatgaccggcgagagcgagtgcctgaaccccagcacccagagcagaatcagcaagttctaccccatccccagcctgcacagcaccggcagctag

SEQ ID NO: 13045 - DNA, 3708 bp, Artificial Sequence
  Description of Artificial Sequence: Synthetic coding sequence
atgagcttcttcaacttcagaaagatcttcaagctgggcagcgagaagaagaagaagcagtacgagcacgtgaagagagacctgaaccccgaggacttctgggagatcatcggcgagctgggcgacggcgccttcggcaaggtgtacaaggcccagaacaaggagaccagcgtgctggccgccgccaaggtgatcgacaccaagagcgaggaggagctggaggactacatggtggagatcgacatcctggccagctgcgaccaccccaacatcgtgaagctgctggacgccttctactacgagaacaacctgtggatcctgatcgagttctgcgccggcggcgccgtggacgccgtgatgctggagctggagagacccctgaccgagagccagatccaggtggtgtgcaagcagaccctggacgccctgaactacctgcacgacaacaagatcatccacagagacctgaaggccggcaacatcctgttcaccctggacggcgacatcaagctggccgacttcggcgtgagcgccaagaacaccagaaccatccagagaagagacagcttcatcggcaccccctactggatggcccccgaggtggtgatgtgcgagaccagcaaggacagaccctacgactacaaggccgacgtgtggagcctgggcatcaccctgatcgagatggccgagatcgagcccccccaccacgagctgaaccccatgagagtgctgctgaagatcgccaagagcgagccccccaccctggcccagcccagcagatggagcagcaacttcaaggacttcctgaagaagtgcctggagaagaacgtggacgccagatggaccaccagccagctgctgcagcaccccttcgtgaccgtggacagcaacaagcccatcagagagctgatcgccgaggccaaggccgaggtgaccgaggaggtggaggacggcaaggaggaggacgaggaggaggagaccgagaacagcctgcccatccccgccagcaagagagccagcagcgacctgagcatcgccagcagcgaggaggacaagctgagccagaacgcctgcatcctggagagcgtgagcgagaagaccgagagaagcaacagcgaggacaagctgaacagcaagatcctgaacgagaagcccaccaccgacgagcccgagaaggccgtggaggacatcaacgagcacatcaccgacgcccagctggaggccatgaccgagctgcacgacagaaccgccgtgatcaaggagaacgagagagagaagagacccaagctggagaacctgcccgacaccgaggaccaggagaccgtggacatcaacagcgtgagcgagggcaaggagaacaacatcatgatcaccctggagaccaacatcgagcacaacctgaagagcgaggaggagaaggaccaggagaagcagcagatgttcgagaacaagctgatcaagagcgaggagatcaaggacaccatcctgcagaccgtggacctggtgagccaggagaccggcgagaaggaggccaacatccaggccgtggacagcgaggtgggcctgaccaaggaggacacccaggagaagctgggcgaggacgacaagacccagaaggacgtgatcagcaacaccagcgacgtgatcggcacctgcgaggccgccgacgtggcccagaaggtggacgaggacagcgccgaggacacccagagcaacgacggcaaggaggtggtggaggtgggccagaagctgatcaacaagcccatggtgggccccgaggccggcggcaccaaggaggtgcccatcaaggagatcgtggagatgaacgagatcgaggagggcaagaacaaggagcaggccatcaacagcagcgagaacatcatggacatcaacgaggagcccggcaccaccgagggcgaggagatcaccgagagcagcagcaccgaggagatggaggtgagaagcgtggtggccgacaccgaccagaaggccctgggcagcgaggtgcaggacgccagcaaggtgaccacccagatcgacaaggagaagaaggagatccccgtgagcatcaagaaggagcccgaggtgaccgtggtgagccagcccaccgagccccagcccgtgctgatccccagcatcaacatcaacagcgacagcggcgagaacaaggaggagatcggcagcctgagcaagaccgagaccatcctgccccccgagagcgagaaccccaaggagaacgacaacgacagcggcaccggcagcaccgccgacaccagcagcatcgacctgaacctgagcatcagcagcttcctgagcaagaccaaggacagcggcagcatcagcctgcaggagaccagaagacagaagaagaccctgaagaagaccagaaagttcatcgtggacggcgtggaggtgagcgtgaccaccagcaagatcgtgaccgacagcgacagcaagaccgaggagctgagattcctgagaagacaggagctgagagagctgagattcctgcagaaggaggagcagagagcccagcagcagctgaacagcaagctgcagcagcagagagagcagatcttcagaagattcgagcaggagatgatgagcaagaagagacagtacgaccaggagatcgagaacctggagaagcagcagaagcagaccatcgagagactggagcaggagcacaccaacagactgagagacgaggccaagagaatcaagggcgagcaggagaaggagctgagcaagttccagaacatgctgaagaacagaaagaaggaggtgatcaacgaggtggagaaggcccccaaggagctgagaaaggagctgatgaagagaagaaaggaggagctggcccagagccagcacgcccaggagcaggagttcgtgcagaagcagcagcaggagctggacggcagcctgaagaagatcatccagcagcagaaggccgagctggccaacatcgagagagagtgcctgaacaacaagcagcagctgatgagagccagagaggccgccatctgggagctggaggagagacacctgcaggagaagcaccagctgctgaagcagcagctgaaggaccagtacttcatgcagagacaccagctgctgaagagacacgagaaggagaccgagcagatgcagagatacaaccagagactgatcgaggagctgaagaacagacagacccaggagagagccagactgcccaagatccagagaagcgaggccaagaccagaatggccatgttcaagaagagcctgagaatcaacagcaccgccacccccgaccaggacagagacaagatcaagcagttcgccgcccaggaggagaagagacagaagaacgagagaatggcccagcaccagaagcacgagaaccagatgagagacctgcagctgcagtgcgaggccaacgtgagagagctgcaccagctgcagaacgagaagtgccacctgctggtggagcacgagacccagaagctgaaggagctggacgaggagcacagccaggagctgaaggagtggagagagaagctgagacccagaaagaagaccctggaggaggagttcgccagaaagctgcaggagcaggaggtgttcttcaagatgaccggcgagagcgagtgcctgaaccccagcacccagagcagaatcagcaagttctaccccatccccagcctgcacagcaccggcagctag

SEQ ID NO: 13046 - DNA, 3444 bp, Artificial Sequence
  Description of Artificial Sequence: Synthetic coding sequence
atggacgagccccccttcagcgaggccgccctggagcaggccctgggcgagccctgcgacctggacgccgccctgctgaccgacatcgaggacatgctgcagctgatcaacaaccaggacagcgacttccccggcctgttcgaccccccctacgccggcagcggcgccggcggcaccgaccccgccagccccgacaccagcagccccggcagcctgagccccccccccgccaccctgagcagcagcctggaggccttcctgagcggcccccaggccgcccccagccccctgagccccccccagcccgcccccacccccctgaagatgtaccccagcatgcccgccttcagccccggccccggcatcaaggaggagagcgtgcccctgagcatcctgcagacccccaccccccagcccctgcccggcgccctgctgccccagagcttccccgcccccgcccccccccagttcagcagcacccccgtgctgggctaccccagcccccccggcggcttcagcaccggcagcccccccggcaacacccagcagcccctgcccggcctgcccctggccagcccccccggcgtgccccccgtgagcctgcacacccaggtgcagagcgtggtgccccagcagctgctgaccgtgaccgccgcccccaccgccgcccccgtgaccaccaccgtgaccagccagatccagcaggtgcccgtgctgctgcagccccacttcatcaaggccgacagcctgctgctgaccgccatgaagaccgacggcgccaccgtgaaggccgccggcctgagccccctggtgagcggcaccaccgtgcagaccggccccctgcccaccctggtgagcggcggcaccatcctggccaccgtgcccctggtggtggacgccgagaagctgcccatcaacagactggccgccggcagcaaggcccccgccagcgcccagagcagaggcgagaagagaaccgcccacaacgccatcgagaagagatacagaagcagcatcaacgacaagatcatcgagctgaaggacctggtggtgggcaccgaggccaagctgaacaagagcgccgtgctgagaaaggccatcgactacatcagattcctgcagcacagcaaccagaagctgaagcaggagaacctgagcctgagaaccgccgtgcacaagagcaagagcctgaaggacctggtgagcgcctgcggcagcggcggcaacaccgacgtgctgatggagggcgtgaagaccgaggtggaggacaccctgacccccccccccagcgacgccggcagccccttccagagcagccccctgagcctgggcagcagaggcagcggcagcggcggcagcggcagcgacagcgagcccgacagccccgtgttcgaggacagcaaggccaagcccgagcagagacccagcctgcacagcagaggcatgctggacagaagcagactggccctgtgcaccctggtgttcctgtgcctgagctgcaaccccctggccagcctgctgggcgccagaggcctgcccagccccagcgacaccaccagcgtgtaccacagccccggcagaaacgtgctgggcaccgagagcagagacggccccggctgggcccagtggctgctgccccccgtggtgtggctgctgaacggcctgctggtgctggtgagcctggtgctgctgttcgtgtacggcgagcccgtgaccagaccccacagcggccccgccgtgtacttctggagacacagaaagcaggccgacctggacctggccagaggcgacttcgcccaggccgcccagcagctgtggctggccctgagagccctgggcagacccctgcccaccagccacctggacctggcctgcagcctgctgtggaacctgatcagacacctgctgcagagactgtgggtgggcagatggctggccggcagagccggcggcctgcagcaggactgcgccctgagagtggacgccagcgccagcgccagagacgccgccctggtgtaccacaagctgcaccagctgcacaccatgggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgtggaccccgtggccaagtggtgggccagcctgaccgccgtggtgatccactggctgagaagagacgaggaggccgccgagagactgtgccccctggtggagcacctgcccagagtgctgcaggagagcgagagacccctgcccagagccgccctgcacagcttcaaggccgccagagccctgctgggctgcgccaaggccgagagcggccccgccagcctgaccatctgcgagaaggccagcggctacctgcaggacagcctggccaccacccccgccagcagcagcatcgacaaggccgtgcagctgttcctgtgcgacctgctgctggtggtgagaaccagcctgtggagacagcagcagccccccgcccccgcccccgccgcccagggcaccagcagcagaccccaggccagcgccctggagctgagaggcttccagagagacctgagcagcctgagaagactggcccagagcttcagacccgccatgagaagagtgttcctgcacgaggccaccgccagactgatggccggcgccagccccaccagaacccaccagctgctggacagaagcctgagaagaagagccggccccggcggcaagggcggcgccgtggccgagctggagcccagacccaccagaagagagcacgccgaggccctgctgctggccagctgctacctgccccccggcttcctgagcgcccccggccagagagtgggcatgctggccgaggccgccagaaccctggagaagctgggcgacagaagactgctgcacgactgccagcagatgctgatgagactgggcggcggcaccaccgtgaccagcagctag

SEQ ID NO: 13047 - DNA, 3216 bp, Artificial Sequence
  Description of Artificial Sequence: Synthetic coding sequence
atggacgagccccccttcagcgaggccgccctggagcaggccctgggcgagccctgcgacctggacgccgccctgctgaccgacatcgaggacatgctgcagctgatcaacaaccaggacagcgacttccccggcctgttcgaccccccctacgccggcagcggcgccggcggcaccgaccccgccagccccgacaccagcagccccggcagcctgagccccccccccgccaccctgagcagcagcctggaggccttcctgagcggcccccaggccgcccccagccccctgagccccccccagcccgcccccacccccctgaagatgtaccccagcatgcccgccttcagccccggccccggcatcaaggaggagagcgtgcccctgagcatcctgcagacccccaccccccagcccctgcccggcgccctgctgccccagagcttccccgcccccgcccccccccagttcagcagcacccccgtgctgggctaccccagcccccccggcggcttcagcaccggcagcccccccggcaacacccagcagcccctgcccggcctgcccctggccagcccccccggcgtgccccccgtgagcctgcacacccaggtgcagagcgtggtgccccagcagctgctgaccgtgaccgccgcccccaccgccgcccccgtgaccaccaccgtgaccagccagatccagcaggtgcccgtgctgctgcagccccacttcatcaaggccgacagcctgctgctgaccgccatgaagaccgacggcgccaccgtgaaggccgccggcctgagccccctggtgagcggcaccaccgtgcagaccggccccctgcccaccctggtgagcggcggcaccatcctggccaccgtgcccctggtggtggacgccgagaagctgcccatcaacagactggccgccggcagcaaggcccccgccagcgcccagagcagaggcgagaagagaaccgcccacaacgccatcgagaagagatacagaagcagcatcaacgacaagatcatcgagctgaaggacctggtggtgggcaccgaggccaagctgaacaagagcgccgtgctgagaaaggccatcgactacatcagattcctgcagcacagcaaccagaagctgaagcaggagaacctgagcctgagaaccgccgtgcacaagagcaagagcctgaaggacctggtgagcgcctgcggcagcggcggcaacaccgacgtgctgatggagggcgtgaagaccgaggtggaggacaccctgacccccccccccagcgacgccggcagccccttccagagcagccccctgagcctgggcagcagaggcagcggcagcggcggcagcggcagcgacagcgagcccgacagccccgtgttcgaggacagcaaggccaagcccgagcagagacccagcctgcacagcagaggcatgctggacagaagcagactggccctgtgcaccctggtgttcctgtgcctgagctgcaaccccctggccagcctgctgggcgccagaggcctgcccagccccagcgacaccaccagcgtgtaccacagccccggcagaaacgtgctgggcaccgagagcagagacggccccggctgggcccagtggctgctgccccccgtggtgtggctgctgaacggcctgctggtgctggtgagcctggtgctgctgttcgtgtacggcgagcccgtgaccagaccccacagcggccccgccgtgtacttctggagacacagaaagcaggccgacctggacctggccagaggcgacttcgcccaggccgcccagcagctgtggctggccctgagagccctgggcagacccctgcccaccagccacctggacctggcctgcagcctgctgtggaacctgatcagacacctgctgcagagactgtgggtgggcagatggctggccggcagagccggcggcctgcagcaggactgcgccctgagagtggacgccagcgccagcgccagagacgccgccctggtgtaccacaagctgcaccagctgcacaccatgggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgtggaccccgtggccaagtggtgggccagcctgaccgccgtggtgatccactggctgagaagagacgaggaggccgccgagagactgtgccccctggtggagcacctgcccagagtgctgcaggagagcgagagacccctgcccagagccgccctgcacagcttcaaggccgccagagccctgctgggctgcgccaaggccgagagcggccccgccagcctgaccatctgcgagaaggccagcggctacctgcaggacagcctggccaccacccccgccagcagcagcatcgacaaggccgtgcagctgttcctgtgcgacctgctgctggtggtgagaaccagcctgtggagacagcagcagccccccgcccccgcccccgccgcccagggcaccagcagcagaccccaggccagcgccctggagctgagaggcttccagagagacctgagcagcctgagaagactggcccagagcttcagacccgccatgagaagactgatggacgtgctgaccagcgagagcgcctgggccctgccccagcacctgggcaagggcttccccagccccagcggccacaaggtgcccggctggcacggcagaatggactag

SEQ ID NO: 13048 - DNA, 3534 bp, Artificial Sequence
  Description of Artificial Sequence: Synthetic coding sequence
atggacgagccccccttcagcgaggccgccctggagcaggccctgggcgagccctgcgacctggacgccgccctgctgaccgacatcgagggcgaggtgggcgccggcagaggcagagccaacggcctggacgcccccagagccggcgccgacagaggcgccatggactgcaccttcgaggacatgctgcagctgatcaacaaccaggacagcgacttccccggcctgttcgaccccccctacgccggcagcggcgccggcggcaccgaccccgccagccccgacaccagcagccccggcagcctgagccccccccccgccaccctgagcagcagcctggaggccttcctgagcggcccccaggccgcccccagccccctgagccccccccagcccgcccccacccccctgaagatgtaccccagcatgcccgccttcagccccggccccggcatcaaggaggagagcgtgcccctgagcatcctgcagacccccaccccccagcccctgcccggcgccctgctgccccagagcttccccgcccccgcccccccccagttcagcagcacccccgtgctgggctaccccagcccccccggcggcttcagcaccggcagcccccccggcaacacccagcagcccctgcccggcctgcccctggccagcccccccggcgtgccccccgtgagcctgcacacccaggtgcagagcgtggtgccccagcagctgctgaccgtgaccgccgcccccaccgccgcccccgtgaccaccaccgtgaccagccagatccagcaggtgcccgtgctgctgcagccccacttcatcaaggccgacagcctgctgctgaccgccatgaagaccgacggcgccaccgtgaaggccgccggcctgagccccctggtgagcggcaccaccgtgcagaccggccccctgcccaccctggtgagcggcggcaccatcctggccaccgtgcccctggtggtggacgccgagaagctgcccatcaacagactggccgccggcagcaaggcccccgccagcgcccagagcagaggcgagaagagaaccgcccacaacgccatcgagaagagatacagaagcagcatcaacgacaagatcatcgagctgaaggacctggtggtgggcaccgaggccaagctgaacaagagcgccgtgctgagaaaggccatcgactacatcagattcctgcagcacagcaaccagaagctgaagcaggagaacctgagcctgagaaccgccgtgcacaagagcaagagcctgaaggacctggtgagcgcctgcggcagcggcggcaacaccgacgtgctgatggagggcgtgaagaccgaggtggaggacaccctgacccccccccccagcgacgccggcagccccttccagagcagccccctgagcctgggcagcagaggcagcggcagcggcggcagcggcagcgacagcgagcccgacagccccgtgttcgaggacagcaaggccaagcccgagcagagacccagcctgcacagcagaggcatgctggacagaagcagactggccctgtgcaccctggtgttcctgtgcctgagctgcaaccccctggccagcctgctgggcgccagaggcctgcccagccccagcgacaccaccagcgtgtaccacagccccggcagaaacgtgctgggcaccgagagcagagacggccccggctgggcccagtggctgctgccccccgtggtgtggctgctgaacggcctgctggtgctggtgagcctggtgctgctgttcgtgtacggcgagcccgtgaccagaccccacagcggccccgccgtgtacttctggagacacagaaagcaggccgacctggacctggccagaggcgacttcgcccaggccgcccagcagctgtggctggccctgagagccctgggcagacccctgcccaccagccacctggacctggcctgcagcctgctgtggaacctgatcagacacctgctgcagagactgtgggtgggcagatggctggccggcagagccggcggcctgcagcaggactgcgccctgagagtggacgccagcgccagcgccagagacgccgccctggtgtaccacaagctgcaccagctgcacaccatgggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgtggaccccgtggccaagtggtgggccagcctgaccgccgtggtgatccactggctgagaagagacgaggaggccgccgagagactgtgccccctggtggagcacctgcccagagtgctgcaggagagcgagagacccctgcccagagccgccctgcacagcttcaaggccgccagagccctgctgggctgcgccaaggccgagagcggccccgccagcctgaccatctgcgagaaggccagcggctacctgcaggacagcctggccaccacccccgccagcagcagcatcgacaaggccgtgcagctgttcctgtgcgacctgctgctggtggtgagaaccagcctgtggagacagcagcagccccccgcccccgcccccgccgcccagggcaccagcagcagaccccaggccagcgccctggagctgagaggcttccagagagacctgagcagcctgagaagactggcccagagcttcagacccgccatgagaagagtgttcctgcacgaggccaccgccagactgatggccggcgccagccccaccagaacccaccagctgctggacagaagcctgagaagaagagccggccccggcggcaagggcggcgccgtggccgagctggagcccagacccaccagaagagagcacgccgaggccctgctgctggccagctgctacctgccccccggcttcctgagcgcccccggccagagagtgggcatgctggccgaggccgccagaaccctggagaagctgggcgacagaagactgctgcacgactgccagcagatgctgatgagactgggcggcggcaccaccgtgaccagcagctag

SEQ ID NO: 13049 - DNA, 3468 bp, Artificial Sequence
  Description of Artificial Sequence: Synthetic coding sequence
tgaaagatcagaagagccctgaccggcgaggtgggcgccggcagaggcagagccaacggcctggacgcccccagagccggcgccgacagaggcgccatggactgcaccttcgaggacatgctgcagctgatcaacaaccaggacagcgacttccccggcctgttcgaccccccctacgccggcagcggcgccggcggcaccgaccccgccagccccgacaccagcagccccggcagcctgagccccccccccgccaccctgagcagcagcctggaggccttcctgagcggcccccaggccgcccccagccccctgagccccccccagcccgcccccacccccctgaagatgtaccccagcatgcccgccttcagccccggccccggcatcaaggaggagagcgtgcccctgagcatcctgcagacccccaccccccagcccctgcccggcgccctgctgccccagagcttccccgcccccgcccccccccagttcagcagcacccccgtgctgggctaccccagcccccccggcggcttcagcaccggcagcccccccggcaacacccagcagcccctgcccggcctgcccctggccagcccccccggcgtgccccccgtgagcctgcacacccaggtgcagagcgtggtgccccagcagctgctgaccgtgaccgccgcccccaccgccgcccccgtgaccaccaccgtgaccagccagatccagcaggtgcccgtgctgctgcagccccacttcatcaaggccgacagcctgctgctgaccgccatgaagaccgacggcgccaccgtgaaggccgccggcctgagccccctggtgagcggcaccaccgtgcagaccggccccctgcccaccctggtgagcggcggcaccatcctggccaccgtgcccctggtggtggacgccgagaagctgcccatcaacagactggccgccggcagcaaggcccccgccagcgcccagagcagaggcgagaagagaaccgcccacaacgccatcgagaagagatacagaagcagcatcaacgacaagatcatcgagctgaaggacctggtggtgggcaccgaggccaagctgaacaagagcgccgtgctgagaaaggccatcgactacatcagattcctgcagcacagcaaccagaagctgaagcaggagaacctgagcctgagaaccgccgtgcacaagagcaagagcctgaaggacctggtgagcgcctgcggcagcggcggcaacaccgacgtgctgatggagggcgtgaagaccgaggtggaggacaccctgacccccccccccagcgacgccggcagccccttccagagcagccccctgagcctgggcagcagaggcagcggcagcggcggcagcggcagcgacagcgagcccgacagccccgtgttcgaggacagcaaggccaagcccgagcagagacccagcctgcacagcagaggcatgctggacagaagcagactggccctgtgcaccctggtgttcctgtgcctgagctgcaaccccctggccagcctgctgggcgccagaggcctgcccagccccagcgacaccaccagcgtgtaccacagccccggcagaaacgtgctgggcaccgagagcagagacggccccggctgggcccagtggctgctgccccccgtggtgtggctgctgaacggcctgctggtgctggtgagcctggtgctgctgttcgtgtacggcgagcccgtgaccagaccccacagcggccccgccgtgtacttctggagacacagaaagcaggccgacctggacctggccagaggcgacttcgcccaggccgcccagcagctgtggctggccctgagagccctgggcagacccctgcccaccagccacctggacctggcctgcagcctgctgtggaacctgatcagacacctgctgcagagactgtgggtgggcagatggctggccggcagagccggcggcctgcagcaggactgcgccctgagagtggacgccagcgccagcgccagagacgccgccctggtgtaccacaagctgcaccagctgcacaccatgggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgtggaccccgtggccaagtggtgggccagcctgaccgccgtggtgatccactggctgagaagagacgaggaggccgccgagagactgtgccccctggtggagcacctgcccagagtgctgcaggagagcgagagacccctgcccagagccgccctgcacagcttcaaggccgccagagccctgctgggctgcgccaaggccgagagcggccccgccagcctgaccatctgcgagaaggccagcggctacctgcaggacagcctggccaccacccccgccagcagcagcatcgacaaggccgtgcagctgttcctgtgcgacctgctgctggtggtgagaaccagcctgtggagacagcagcagccccccgcccccgcccccgccgcccagggcaccagcagcagaccccaggccagcgccctggagctgagaggcttccagagagacctgagcagcctgagaagactggcccagagcttcagacccgccatgagaagagtgttcctgcacgaggccaccgccagactgatggccggcgccagccccaccagaacccaccagctgctggacagaagcctgagaagaagagccggccccggcggcaagggcggcgccgtggccgagctggagcccagacccaccagaagagagcacgccgaggccctgctgctggccagctgctacctgccccccggcttcctgagcgcccccggccagagagtgggcatgctggccgaggccgccagaaccctggagaagctgggcgacagaagactgctgcacgactgccagcagatgctgatgagactgggcggcggcaccaccgtgaccagcagctag

SEQ ID NO: 13050 - DNA, 2301 bp, Artificial Sequence
  Description of Artificial Sequence: Synthetic coding sequence
atgctggcccacctgagcagagccgccccctgccccctggccgccggcgccgtggccgccgtggccgtggccgtgaccagaagcctgaccgcccagagcctgagaaccgccagactgggccccgccaccgtgccccccagccccctgcccgccatcagcagcgagccccacgacagagccggcaagaccctgaccgaccccaccagccacttcatcgacagaatcaccgaggcctggagccacgtgggcagccacagcaaggccaagcccgagcagagacccagcctgcacagcagaggcatgctggacagaagcagactggccctgtgcaccctggtgttcctgtgcctgagctgcaaccccctggccagcctgctgggcgccagaggcctgcccagccccagcgacaccaccagcgtgtaccacagccccggcagaaacgtgctgggcaccgagagcagagacggccccggctgggcccagtggctgctgccccccgtggtgtggctgctgaacggcctgctggtgctggtgagcctggtgctgctgttcgtgtacggcgagcccgtgaccagaccccacagcggccccgccgtgtacttctggagacacagaaagcaggccgacctggacctggccagaggcgacttcgcccaggccgcccagcagctgtggctggccctgagagccctgggcagacccctgcccaccagccacctggacctggcctgcagcctgctgtggaacctgatcagacacctgctgcagagactgtgggtgggcagatggctggccggcagagccggcggcctgcagcaggactgcgccctgagagtggacgccagcgccagcgccagagacgccgccctggtgtaccacaagctgcaccagctgcacaccatgggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgtggaccccgtggccaagtggtgggccagcctgaccgccgtggtgatccactggctgagaagagacgaggaggccgccgagagactgtgccccctggtggagcacctgcccagagtgctgcaggagagcgagagacccctgcccagagccgccctgcacagcttcaaggccgccagagccctgctgggctgcgccaaggccgagagcggccccgccagcctgaccatctgcgagaaggccagcggctacctgcaggacagcctggccaccacccccgccagcagcagcatcgacaaggccgtgcagctgttcctgtgcgacctgctgctggtggtgagaaccagcctgtggagacagcagcagccccccgcccccgcccccgccgcccagggcaccagcagcagaccccaggccagcgccctggagctgagaggcttccagagagacctgagcagcctgagaagactggcccagagcttcagacccgccatgagaagagtgttcctgcacgaggccaccgccagactgatggccggcgccagccccaccagaacccaccagctgctggacagaagcctgagaagaagagccggccccggcggcaagggcggcgccgtggccgagctggagcccagacccaccagaagagagcacgccgaggccctgctgctggccagctgctacctgccccccggcttcctgagcgcccccggccagagagtgggcatgctggccgaggccgccagaaccctggagaagctgggcgacagaagactgctgcacgactgccagcagatgctgatgagactgggcggcggcaccaccgtgaccagcagctag

SEQ ID NO: 13051 - DNA, 2682 bp, Artificial Sequence
  Description of Artificial Sequence: Synthetic coding sequence
atgaagaccgacggcgccaccgtgaaggccgccggcctgagccccctggtgagcggcaccaccgtgcagaccggccccctgcccaccctggtgagcggcggcaccatcctggccaccgtgcccctggtggtggacgccgagaagctgcccatcaacagactggccgccggcagcaaggcccccgccagcgcccagagcagaggcgagaagagaaccgcccacaacgccatcgagaagagatacagaagcagcatcaacgacaagatcatcgagctgaaggacctggtggtgggcaccgaggccaagctgaacaagagcgccgtgctgagaaaggccatcgactacatcagattcctgcagcacagcaaccagaagctgaagcaggagaacctgagcctgagaaccgccgtgcacaagagcaagagcctgaaggacctggtgagcgcctgcggcagcggcggcaacaccgacgtgctgatggagggcgtgaagaccgaggtggaggacaccctgacccccccccccagcgacgccggcagccccttccagagcagccccctgagcctgggcagcagaggcagcggcagcggcggcagcggcagcgacagcgagcccgacagccccgtgttcgaggacagcaaggccaagcccgagcagagacccagcctgcacagcagaggcatgctggacagaagcagactggccctgtgcaccctggtgttcctgtgcctgagctgcaaccccctggccagcctgctgggcgccagaggcctgcccagccccagcgacaccaccagcgtgtaccacagccccggcagaaacgtgctgggcaccgagagcagagacggccccggctgggcccagtggctgctgccccccgtggtgtggctgctgaacggcctgctggtgctggtgagcctggtgctgctgttcgtgtacggcgagcccgtgaccagaccccacagcggccccgccgtgtacttctggagacacagaaagcaggccgacctggacctggccagaggcgacttcgcccaggccgcccagcagctgtggctggccctgagagccctgggcagacccctgcccaccagccacctggacctggcctgcagcctgctgtggaacctgatcagacacctgctgcagagactgtgggtgggcagatggctggccggcagagccggcggcctgcagcaggactgcgccctgagagtggacgccagcgccagcgccagagacgccgccctggtgtaccacaagctgcaccagctgcacaccatgggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgtggaccccgtggccaagtggtgggccagcctgaccgccgtggtgatccactggctgagaagagacgaggaggccgccgagagactgtgccccctggtggagcacctgcccagagtgctgcaggagagcgagagacccctgcccagagccgccctgcacagcttcaaggccgccagagccctgctgggctgcgccaaggccgagagcggccccgccagcctgaccatctgcgagaaggccagcggctacctgcaggacagcctggccaccacccccgccagcagcagcatcgacaaggccgtgcagctgttcctgtgcgacctgctgctggtggtgagaaccagcctgtggagacagcagcagccccccgcccccgcccccgccgcccagggcaccagcagcagaccccaggccagcgccctggagctgagaggcttccagagagacctgagcagcctgagaagactggcccagagcttcagacccgccatgagaagagtgttcctgcacgaggccaccgccagactgatggccggcgccagccccaccagaacccaccagctgctggacagaagcctgagaagaagagccggccccggcggcaagggcggcgccgtggccgagctggagcccagacccaccagaagagagcacgccgaggccctgctgctggccagctgctacctgccccccggcttcctgagcgcccccggccagagagtgggcatgctggccgaggccgccagaaccctggagaagctgggcgacagaagactgctgcacgactgccagcagatgctgatgagactgggcggcggcaccaccgtgaccagcagctag

SEQ ID NO: 13052 - DNA, 2955 bp, Artificial Sequence
  Description of Artificial Sequence: Synthetic coding sequence
atggactgcaccttcgaggacatgctgcagctgatcaacaaccaggacagcgacttccccggcctgttcgaccccccctacgccggcagcggcgccggcggcaccgaccccgccagccccgacaccagcagccccggcagcctgagccccccccccgccaccctgagcagcagcctggaggccttcctgagcggcccccaggccgcccccagccccctgagccccccccagcccgcccccacccccctgaagatgtaccccagcatgcccgccttcagccccggccccggcatcaaggaggagagcgtgcccctgagcatcctgcagacccccaccccccagcccctgcccgtgcccaccctggtgagcggcggcaccatcctggccaccgtgcccctggtggtggacgccgagaagctgcccatcaacagactggccgccggcagcaaggcccccgccagcgcccagagcagaggcgagaagagaaccgcccacaacgccatcgagaagagatacagaagcagcatcaacgacaagatcatcgagctgaaggacctggtggtgggcaccgaggccaagctgaacaagagcgccgtgctgagaaaggccatcgactacatcagattcctgcagcacagcaaccagaagctgaagcaggagaacctgagcctgagaaccgccgtgcacaagagcaagagcctgaaggacctggtgagcgcctgcggcagcggcggcaacaccgacgtgctgatggagggcgtgaagaccgaggtggaggacaccctgacccccccccccagcgacgccggcagccccttccagagcagccccctgagcctgggcagcagaggcagcggcagcggcggcagcggcagcgacagcgagcccgacagccccgtgttcgaggacagcaaggccaagcccgagcagagacccagcctgcacagcagaggcatgctggacagaagcagactggccctgtgcaccctggtgttcctgtgcctgagctgcaaccccctggccagcctgctgggcgccagaggcctgcccagccccagcgacaccaccagcgtgtaccacagccccggcagaaacgtgctgggcaccgagagcagagacggccccggctgggcccagtggctgctgccccccgtggtgtggctgctgaacggcctgctggtgctggtgagcctggtgctgctgttcgtgtacggcgagcccgtgaccagaccccacagcggccccgccgtgtacttctggagacacagaaagcaggccgacctggacctggccagaggcgacttcgcccaggccgcccagcagctgtggctggccctgagagccctgggcagacccctgcccaccagccacctggacctggcctgcagcctgctgtggaacctgatcagacacctgctgcagagactgtgggtgggcagatggctggccggcagagccggcggcctgcagcaggactgcgccctgagagtggacgccagcgccagcgccagagacgccgccctggtgtaccacaagctgcaccagctgcacaccatgggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgtggaccccgtggccaagtggtgggccagcctgaccgccgtggtgatccactggctgagaagagacgaggaggccgccgagagactgtgccccctggtggagcacctgcccagagtgctgcaggagagcgagagacccctgcccagagccgccctgcacagcttcaaggccgccagagccctgctgggctgcgccaaggccgagagcggccccgccagcctgaccatctgcgagaaggccagcggctacctgcaggacagcctggccaccacccccgccagcagcagcatcgacaaggccgtgcagctgttcctgtgcgacctgctgctggtggtgagaaccagcctgtggagacagcagcagccccccgcccccgcccccgccgcccagggcaccagcagcagaccccaggccagcgccctggagctgagaggcttccagagagacctgagcagcctgagaagactggcccagagcttcagacccgccatgagaagagtgttcctgcacgaggccaccgccagactgatggccggcgccagccccaccagaacccaccagctgctggacagaagcctgagaagaagagccggccccggcggcaagggcggcgccgtggccgagctggagcccagacccaccagaagagagcacgccgaggccctgctgctggccagctgctacctgccccccggcttcctgagcgcccccggccagagagtgggcatgctggccgaggccgccagaaccctggagaagctgggcgacagaagactgctgcacgactgccagcagatgctgatgagactgggcggcggcaccaccgtgaccagcagctag

SEQ ID NO: 13053 - DNA, 3222 bp, Artificial Sequence
  Description of Artificial Sequence: Synthetic coding sequence
atggactgcaccttcgaggacatgctgcagctgatcaacaaccaggacagcgacttccccggcctgttcgaccccccccagcccgcccccacccccctgaagatgtaccccagcatgcccgccttcagccccggccccggcatcaaggaggagagcgtgcccctgagcatcctgcagacccccaccccccagcccctgcccggcgccctgctgccccagagcttccccgcccccgcccccccccagttcagcagcacccccgtgctgggctaccccagcccccccggcggcttcagcaccggcagcccccccggcaacacccagcagcccctgcccggcctgcccctggccagcccccccggcgtgccccccgtgagcctgcacacccaggtgcagagcgtggtgccccagcagctgctgaccgtgaccgccgcccccaccgccgcccccgtgaccaccaccgtgaccagccagatccagcaggtgcccgtgctgctgcagccccacttcatcaaggccgacagcctgctgctgaccgccatgaagaccgacggcgccaccgtgaaggccgccggcctgagccccctggtgagcggcaccaccgtgcagaccggccccctgcccaccctggtgagcggcggcaccatcctggccaccgtgcccctggtggtggacgccgagaagctgcccatcaacagactggccgccggcagcaaggcccccgccagcgcccagagcagaggcgagaagagaaccgcccacaacgccatcgagaagagatacagaagcagcatcaacgacaagatcatcgagctgaaggacctggtggtgggcaccgaggccaagctgaacaagagcgccgtgctgagaaaggccatcgactacatcagattcctgcagcacagcaaccagaagctgaagcaggagaacctgagcctgagaaccgccgtgcacaagagcaagagcctgaaggacctggtgagcgcctgcggcagcggcggcaacaccgacgtgctgatggagggcgtgaagaccgaggtggaggacaccctgacccccccccccagcgacgccggcagccccttccagagcagccccctgagcctgggcagcagaggcagcggcagcggcggcagcggcagcgacagcgagcccgacagccccgtgttcgaggacagcaaggccaagcccgagcagagacccagcctgcacagcagaggcatgctggacagaagcagactggccctgtgcaccctggtgttcctgtgcctgagctgcaaccccctggccagcctgctgggcgccagaggcctgcccagccccagcgacaccaccagcgtgtaccacagccccggcagaaacgtgctgggcaccgagagcagagacggccccggctgggcccagtggctgctgccccccgtggtgtggctgctgaacggcctgctggtgctggtgagcctggtgctgctgttcgtgtacggcgagcccgtgaccagaccccacagcggccccgccgtgtacttctggagacacagaaagcaggccgacctggacctggccagaggcgacttcgcccaggccgcccagcagctgtggctggccctgagagccctgggcagacccctgcccaccagccacctggacctggcctgcagcctgctgtggaacctgatcagacacctgctgcagagactgtgggtgggcagatggctggccggcagagccggcggcctgcagcaggactgcgccctgagagtggacgccagcgccagcgccagagacgccgccctggtgtaccacaagctgcaccagctgcacaccatgggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgtggaccccgtggccaagtggtgggccagcctgaccgccgtggtgatccactggctgagaagagacgaggaggccgccgagagactgtgccccctggtggagcacctgcccagagtgctgcaggagagcgagagacccctgcccagagccgccctgcacagcttcaaggccgccagagccctgctgggctgcgccaaggccgagagcggccccgccagcctgaccatctgcgagaaggccagcggctacctgcaggacagcctggccaccacccccgccagcagcagcatcgacaaggccgtgcagctgttcctgtgcgacctgctgctggtggtgagaaccagcctgtggagacagcagcagccccccgcccccgcccccgccgcccagggcaccagcagcagaccccaggccagcgccctggagctgagaggcttccagagagacctgagcagcctgagaagactggcccagagcttcagacccgccatgagaagagtgttcctgcacgaggccaccgccagactgatggccggcgccagccccaccagaacccaccagctgctggacagaagcctgagaagaagagccggccccggcggcaagggcggcgccgtggccgagctggagcccagacccaccagaagagagcacgccgaggccctgctgctggccagctgctacctgccccccggcttcctgagcgcccccggccagagagtgggcatgctggccgaggccgccagaaccctggagaagctgggcgacagaagactgctgcacgactgccagcagatgctgatgagactgggcggcggcaccaccgtgaccagcagctag

SEQ ID NO: 13054 - DNA, 1413 bp, Artificial Sequence
  Description of Artificial Sequence: Synthetic coding sequence
atggacgagccccccttcagcgaggccgccctggagcaggccctgggcgagccctgcgacctggacgccgccctgctgaccgacatcgaggacatgctgcagctgatcaacaaccaggacagcgacttccccggcctgttcgaccccccctacgccggcagcggcgccggcggcaccgaccccgccagccccgacaccagcagccccggcagcctgagccccccccccgccaccctgagcagcagcctggaggccttcctgagcggcccccaggccgcccccagccccctgagccccccccagcccgcccccacccccctgaagatgtaccccagcatgcccgccttcagccccggccccggcatcaaggaggagagcgtgcccctgagcatcctgcagacccccaccccccagcccctgcccggcgccctgctgccccagagcttccccgcccccgcccccccccagttcagcagcacccccgtgctgggctaccccagcccccccggcggcttcagcaccggcagcccccccggcaacacccagcagcccctgcccggcctgcccctggccagcccccccggcgtgccccccgtgagcctgcacacccaggtgcagagcgtggtgccccagcagctgctgaccgtgaccgccgcccccaccgccgcccccgtgaccaccaccgtgaccagccagatccagcaggtgcccgtgctgctgcagccccacttcatcaaggccgacagcctgctgctgaccgccatgaagaccgacggcgccaccgtgaaggccgccggcctgagccccctggtgagcggcaccaccgtgcagaccggccccctgcccaccctggtgagcggcggcaccatcctggccaccgtgcccctggtggtggacgccgagaagctgcccatcaacagactggccgccggcagcaaggcccccgccagcgcccagagcagaggcgagaagagaaccgcccacaacgccatcgagaagagatacagaagcagcatcaacgacaagatcatcgagctgaaggacctggtggtgggcaccgaggccaagctgaacaagagcgccgtgctgagaaaggccatcgactacatcagattcctgcagcacagcaaccagaagctgaagcaggagaacctgagcctgagaaccgccgtgcacaagagcaagagcctgaaggacctggtgagcgcctgcggcagcggcggcaacaccgacgtgctgatggagggcgtgaagaccgaggtggaggacaccctgacccccccccccagcgacgccggcagccccttccagagcagccccctgagcctgggcagcagaggcagcggcagcggcggcagcggcagcgacagcgagcccgacagccccgtgttcgaggacagcaagaccgagtag

SEQ ID NO: 13055 - DNA, 645 bp, Artificial Sequence
  Description of Artificial Sequence: Synthetic coding sequence
ctgatgcccgcctgcctgcccggcaagcacaccggcggccacctgaccgccaccaacctggccctgagcgccctgaacctggccgagtgcgccggcgacgccgtgagcgtggccaccctggccgagatctacgtggccgccgccctgagagtgaagaccagcctgcccagagccctgcacttcctgaccagattcttcctgagcagcgccagacaggcctgcctggcccagagcggcagcgtgccccccgccatgcagtggctgtgccaccccgtgggccacagattcttcgtggacggcgactggagcgtgctgagcaccccctgggagagcctgtacagcctggccggcaaccccgtggaccccctggcccaggtgacccagctgttcagagagcacctgctggagagagccctgaactgcgtgacccagcccaaccccagccccggcagcgccgacggcgacaaggagttcagcgacgccctgggctacctgcagctgctgaacagctgcagcgacgccgccggcgcccccgcctacagcttcagcatcagcagcagcatggccaccaccaccggcgacccctgccccggccagctgtgcacccccagcagactgcccggcccctgctgggccgtgccctag

SEQ ID NO: 13056 - DNA, 747 bp, Artificial Sequence
  Description of Artificial Sequence: Synthetic coding sequence
atggagagagccagcctgatccagaaggccaagctggccgagcaggccgagagatacgaggacatggccgccttcatgaagggcgccgtggagaagggcgaggagctgagctgcgaggagagaaacctgctgagcgtggcctacaagaacgtggtgggcggccagagagccgcctggagagtgctgagcagcatcgagcagaagagcaacgaggagggcagcgaggagaagggccccgaggtgagagagtacagagagaaggtggagaccgagctgcagggcgtgtgcgacaccgtgctgggcctgctggacagccacctgatcaaggaggccggcgacgccgagagcagagtgttctacctgaagatgaagggcgactactacagatacctggccgaggtggccaccggcgacgacaagaagagaatcatcgacagcgccagaagcgcctaccaggaggccatggacatcagcaagaaggagatgccccccaccaaccccatcagactgggcctggccctgaacttcagcgtgttccactacgagatcgccaacagccccgaggaggccatcagcctggccaagaccaccttcgacgaggccatggccgacctgcacaccctgagcgaggacagctacaaggacagcaccctgatcatgcagctgctgagagacaacctgaccctgtggaccgccgacaacgccggcgaggagggcggcgaggccccccaggagccccagagctag

SEQ ID NO: 13057 - DNA, 651 bp, Artificial Sequence
  Description of Artificial Sequence: Synthetic coding sequence
atggagagagccagcctgatccagaaggccaagctggccgagcaggccgagagatacgaggacatggccgccttcatgaagggcgccgtggagaagggcgaggagctgagctgcgaggagagaaacctgctgagcgtggcctacaagaacgtggtgggcggccagagagccgcctggagagtgctgagcagcatcgagcagaagagcaacgaggagggcagcgaggagaagggccccgaggtgagagagtacagagtgttctacctgaagatgaagggcgactactacagatacctggccgaggtggccaccggcgacgacaagaagagaatcatcgacagcgccagaagcgcctaccaggaggccatggacatcagcaagaaggagatgccccccaccaaccccatcagactgggcctggccctgaacttcagcgtgttccactacgagatcgccaacagccccgaggaggccatcagcctggccaagaccaccttcgacgaggccatggccgacctgcacaccctgagcgaggacagctacaaggacagcaccctgatcatgcagctgctgagagacaacctgaccctgtggaccgccgacaacgccggcgaggagggcggcgaggccccccaggagccccagagctag

SEQ ID NO: 13058 - DNA, 3702 bp, Artificial Sequence
  Description of Artificial Sequence: Synthetic coding sequence
atgggcttcctgaagctgatcgagatcgagaacttcaagagctacaagggcagacagatcatcggccccttccagagattcaccgccatcatcggccccaacggcagcggcaagagcaacctgatggacgccatcagcttcgtgctgggcgagaagaccagcaacctgagagtgaagaccctgagagacctgatccacggcgcccccgtgggcaagcccgccgccaacagagccttcgtgagcatggtgtacagcgaggagggcgccgaggacagaaccttcgccagagtgatcgtgggcggcagcagcgagtacaagatcaacaacaaggtggtgcagctgcacgagtacagcgaggagctggagaagctgggcatcctgatcaaggccagaaacttcctggtgttccagggcgccgtggagagcatcgccatgaagaaccccaaggagagaaccgccctgttcgaggagatcagcagaagcggcgagctggcccaggagtacgacaagagaaagaaggagatggtgaaggccgaggaggacacccagttcaactaccacagaaagaagaacatcgccgccgagagaaaggaggccaagcaggagaaggaggaggccgacagataccagagactgaaggacgaggtggtgagagcccaggtgcagctgcagctgttcaagctgtaccacaacgaggtggagatcgagaagctgaacaaggagctggccagcaagaacaaggagatcgagaaggacaagaagagaatggacaaggtggaggacgagctgaaggagaagaagaaggagctgggcaagatgatgagagagcagcagcagatcgagaaggagatcaaggagaaggacagcgagctgaaccagaagagaccccagtacatcaaggccaaggagaacaccagccacaagatcaagaagctggaggccgccaagaagagcctgcagaacgcccagaagcactacaagaagagaaagggcgacatggacgagctggagaaggagatgctgagcgtggagaaggccagacaggagttcgaggagagaatggaggaggagagccagagccagggcagagacctgaccctggaggagaaccaggtgaagaagtaccacagactgaaggaggaggccagcaagagagccgccaccctggcccaggagctggagaagttcaacagagaccagaaggccgaccaggacagactggacctggaggagagaaagaaggtggagaccgaggccaagatcaagcagaagctgagagagatcgaggagaaccagaagagaatcgagaagctggaggagtacatcaccaccagcaagcagagcctggaggagcagaagaagctggagggcgagctgaccgaggaggtggagatggccaagagaagaatcgacgagatcaacaaggagctgaaccaggtgatggagcagctgggcgacgccagaatcgacagacaggagagcagcagacagcagagaaaggccgagatcatggagagcatcaagagactgtaccccggcagcgtgtacggcagactgatcgacctgtgccagcccacccagaagaagtaccagatcgccgtgaccaaggtgctgggcaagaacatggacgccatcatcgtggacagcgagaagaccggcagagactgcatccagtacatcaaggagcagagaggcgagcccgagaccttcctgcccctggactacctggaggtgaagcccaccgacgagaagctgagagagctgaagggcgccaagctggtgatcgacgtgatcagatacgagcccccccacatcaagaaggccctgcagtacgcctgcggcaacgccctggtgtgcgacaacgtggaggacgccagaagaatcgccttcggcggccaccagagacacaagaccgtggccctggacggcaccctgttccagaagagcggcgtgatcagcggcggcgccagcgacctgaaggccaaggccagaagatgggacgagaaggccgtggacaagctgaaggagaagaaggagagactgaccgaggagctgaaggagcagatgaaggccaagagaaaggaggccgagctgagacaggtgcagagccaggcccacggcctgcagatgagactgaagtacagccagagcgacctggagcagaccaagaccagacacctggccctgaacctgcaggagaagagcaagctggagagcgagctggccaacttcggccccagaatcaacgacatcaagagaatcatccagagcagagagagagagatgaaggacctgaaggagaagatgaaccaggtggaggacgaggtgttcgaggagttctgcagagagatcggcgtgagaaacatcagagagttcgaggaggagaaggtgaagagacagaacgagatcgccaagaagagactggagttcgagaaccagaagaccagactgggcatccagctggacttcgagaagaaccagctgaaggaggaccaggacaaggtgcacatgtgggagcagaccgtgaagaaggacgagaacgagatcgagaagctgaagaaggaggagcagagacacatgaagatcatcgacgagaccatggcccagctgcaggacctgaagaaccagcacctggccaagaagagcgaggtgaacgacaagaaccacgagatggaggagatcagaaagaagctgggcggcgccaacaaggagatgacccacctgcagaaggaggtgaccgccatcgagaccaagctggagcagaagagaagcgacagacacaacctgctgcaggcctgcaagatgcaggacatcaagctgcccctgagcaagggcaccatggacgacatcagccaggaggagggcagcagccagggcgaggacagcgtgagcggcagccagagaatcagcagcatctacgccagagaggccctgatcgagatcgactacggcgacctgtgcgaggacctgaaggacgcccaggccgaggaggagatcaagcaggagatgaacaccctgcagcagaagctgaacgagcagcagagcgtgctgcagagaatcgccgcccccaacatgaaggccatggagaagctggagagcgtgagagacaagttccaggagaccagcgacgagttcgaggccgccagaaagagagccaagaaggccaagcaggccttcgagcagatcaagaaggagagattcgacagattcaacgcctgcttcgagagcgtggccaccaacatcgacgagatctacaaggccctgagcagaaacagcagcgcccaggccttcctgggccccgagaaccccgaggagccctacctggacggcatcaactacaactgcgtggcccccggcaagagattcagacccatggacaacctgagcggcggcgagaagaccgtggccgccctggccctgctgttcgccatccacagctacaagcccgcccccttcttcgtgctggacgagatcgacgccgccctggacaacaccaacatcggcaaggtggccaactacatcaaggagcagagcacctgcaacttccaggccatcgtgatcagcctgaaggaggagttctacaccaaggccgagagcctgatcggcgtgtaccccgagcagggcgactgcgtgatcagcaaggtgctgaccttcgacctgaccaagtaccccgacgccaaccccaaccccaacgagcagtag

SEQ ID NO: 13059 - DNA, 612 bp, Artificial Sequence
  Description of Artificial Sequence: Synthetic coding sequence
atgggcttcctgaagctgatcgagatcgagaacttcaagagctacaagggcagacagatcatcggccccttccagagattcaccgccatcatcggccccaacggcagcggcaagagcaacctgatggacgccatcagcttcgtgctgggcgagaagaccagcaacctgagagtgaagaccctgagagacctgatccacggcgcccccgtgggcaagcccgccgccaacagagccttcgtgagcatggtgtacagcgaggagggcgccgaggacagaaccttcgccagagtgatcgtgggcggcagcagcgagtacaagatcaacaacaaggtggtgcagctgcacgagtacagcgaggagctggagaagctgggcatcctgatcaaggccagaaacttcctggtgttccagggctgctgcggcatctactgccacgagacccccaagagaggccagctgtacctgaagatcagcagaagcggcgagctggcccaggagtacgacaagagaaagaaggagatggtgaaggccgaggaggacacccagttcaactaccacagaaagaagaacatcgccgccgagagaaaggaggccaagcaggagaaggagtag

SEQ ID NO: 13060 - DNA, 1551 bp, Artificial Sequence
  Description of Artificial Sequence: Synthetic coding sequence
atgggcttcctgaagctgatcgagatcgagaacttcaagagctacaagggcagacagatcatcggccccttccagagattcaccgccatcatcggccccaacggcagcggcaagagcaacctgatggacgccatcagcttcgtgctgggcgagaagaccagcaacctgagagtgaagaccctgagagacctgatccacggcgcccccgtgggcaagcccgccgccaacagagccttcgtgagcatggtgtacagcgaggagggcgccgaggacagaaccttcgccagagtgatcgtgggcggcagcagcgagtacaagatcaacaacaaggtggtgcagctgcacgagtacagcgaggagctggagaagctgggcatcctgatcaaggccagaaacttcctggtgttccaggtgaagaagtaccacagactgaaggaggaggccagcaagagagccgccaccctggcccaggagctggagaagttcaacagagaccagaaggccgaccaggacagactggacctggaggagagaaagaaggtggagaccgaggccaagatcaagcagaagctgagagagatcgaggagaaccagaagagaatcgagaagctggaggagtacatcaccaccagcaagcagagcctggaggagcagaagaagctggagggcgagctgaccgaggaggtggagatggccaagagaagaatcgacgagatcaacaaggagctgaaccaggtgatggagcagctgggcgacgccagaatcgacagacaggagagcagcagacagcagagaaaggccgagatcatggagagcatcaagagactgtaccccggcagcgtgtacggcagactgatcgacctgtgccagcccacccagaagaagtaccagatcgccgtgaccaaggtgctgggcaagaacatggacgccatcatcgtggacagcgagaagaccggcagagactgcatccagtacatcaaggagcagagaggcgagcccgagaccttcctgcccctggactacctggaggtgaagcccaccgacgagaagctgagagagctgaagggcgccaagctggtgatcgacgtgatcagatacgagcccccccacatcaagaaggccctgcagtacgcctgcggcaacgccctggtgtgcgacaacgtggaggacgccagaagaatcgccttcggcggccaccagagacacaagaccgtggccctggacggcaccctgttccagaagagcggcgtgatcagcggcggcgccagcgacctgaaggccaaggccagaagatgggacgagaaggccgtggacaagctgaaggagaagaaggagagactgaccgaggagctgaaggagcagatgaaggccaagagaaaggaggccgagctgagacaggtgcagagccaggcccacggcctgcagatgagactgaagtacagccagagcgacctggagcagaccaagaccagacacctggccctgaacctgcaggtgggccccggcctgcagccctgcagccccaaggccatccacaccttcctggcctag

SEQ ID NO: 13061 - DNA, 870 bp, Artificial Sequence
  Description of Artificial Sequence: Synthetic coding sequence
tgatggtacacccccacccccttctacagcagcctggaggccgccctgctgaacttcagacccagcgcccccgtgttcagaatgctggaggtgagcatccccaccccccacagatacgtgagaggcaagagcaacctgatggacgccatcagcttcgtgctgggcgagaagaccagcaacctgagagtgaagaccctgagagacctgatccacggcgcccccgtgggcaagcccgccgccaacagagccttcgtgagcatggtgtacagcgaggagggcgccgaggacagaaccttcgccagagtgatcgtgggcggcagcagcgagtacaagatcaacaacaaggtggtgcagctgcacgagtacagcgaggagctggagaagctgggcatcctgatcaaggccagaaacttcctggtgttccagggcgccgtggagagcatcgccatgaagaaccccaaggagagaaccgccctgttcgaggagatcagcagaagcggcgagctggcccaggagtacgacaagagaaagaaggagatggtgaaggccgaggaggacacccagttcaactaccacagaaagaagaacatcgccgccgagagaaaggaggccaagcaggagaaggaggaggccgacagataccagagactgaaggacgaggtggtgagagcccaggtgcagctgcagctgttcaagctgtaccacaacgaggtggagatcgagaagctgaacaaggagctggccagcaagaacaaggagatcgagaaggacaagaagagaatggacaaggtggaggacgagctgaaggagaagaagaaggagctgggcaagatgatgagagagcagcagcagatcgagaaggagatctag

SEQ ID NO: 13062 - DNA, 1995 bp, Artificial Sequence
  Description of Artificial Sequence: Synthetic coding sequence
atgagcggcgtgagaggcctgagcagactgctgagcgccagaagactggccctggccaaggcctggcccaccgtgctgcagaccggcaccagaggcttccacttcaccgtggacggcaacaagagagccagcgccaaggtgagcgacagcatcagcgcccagtaccccgtggtggaccacgagttcgacgccgtggtggtgggcgccggcggcgccggcctgagagccgccttcggcctgagcgaggccggcttcaacaccgcctgcgtgaccaagctgttccccaccagaagccacaccgtggccgcccagggcggcatcaacgccgccctgggcaacatggaggaggacaactggagatggcacttctacgacaccgtgaagggcagcgactggctgggcgaccaggacgccatccactacatgaccgagcaggcccccgccgccgtggtggagctggagaactacggcatgcccttcagcagaaccgaggacggcaagatctaccagagagccttcggcggccagagcctgaagttcggcaagggcggccaggcccacagatgctgctgcgtggccgacagaaccggccacagcctgctgcacaccctgtacggcagaagcctgagatacgacaccagctacttcgtggagtacttcgccctggacctgctgatggagaacggcgagtgcagaggcgtgatcgccctgtgcatcgaggacggcagcatccacagaatcagagccaagaacaccgtggtggccaccggcggctacggcagaacctacttcagctgcaccagcgcccacaccagcaccggcgacggcaccgccatgatcaccagagccggcctgccctgccaggacctggagttcgtgcagttccaccccaccggcatctacggcgccggctgcctgatcaccgagggctgcagaggcgagggcggcatcctgatcaacagccagggcgagagattcatggagagatacgcccccgtggccaaggacctggccagcagagacgtggtgagcagaagcatgaccctggagatcagagagggcagaggctgcggccccgagaaggaccacgtgtacctgcagctgcaccacctgccccccgagcagctggccaccagactgcccggcatcagcgagaccgccatgatcttcgccggcgtggacgtgaccaaggagcccatccccgtgctgcccaccgtgcactacaacatgggcggcatccccaccaactacaagggccaggtgctgagacacgtgaacggccaggaccagatcgtgcccggcctgtacgcctgcggcgaggccgcctgcgccagcgtgcacggcgccaacagactgggcgccaacagcctgctggacctggtggtgttcggcagagcctgcgccctgagcatcgaggagagctgcagacccggcgacaaggtgccccccatcaagcccaacgccggcgaggagagcgtgatgaacctggacaagctgagattcgccgacggcagcatcagaaccagcgagctgagactgagcatgcagaagagcatgcagaaccacgccgccgtgttcagagtgggcagcgtgctgcaggagggctgcggcaagatcagcaagctgtacggcgacctgaagcacctgaagaccttcgacagaggcatggtgtggaacaccgacctggtggagaccctggagctgcagaacctgatgctgtgcgccctgcagaccatctacggcgccgaggccagaaaggagagcagaggcgcccacgccagagaggactacaaggtgagaatcgacgagtacgactacagcaagcccatccagggccagcagaagaagcccttcgaggagcactggagaaagcacaccctgagctacgtggacgtgggcaccggcaaggtgaccctggagtacagacccgtgatcgacaagaccctgaacgaggccgactgcgccaccgtgccccccgccatcagaagctactag

SEQ ID NO: 13063 - DNA, 1560 bp, Artificial Sequence
  Description of Artificial Sequence: Synthetic coding sequence
atgagcggcgtgagaggcctgagcagactgctgagcgccagaagactggccctggccaaggcctggcccaccgtgctgcagaccggcaccagaggcttccacttcaccgtggacggcaacaagagagccagcgccaaggtgagcgacagcatcagcgcccagtaccccgtggtggaccacgagttcgacgccgtggtggtgggcgccggcggcgccggcctgagagccgccttcggcctgagcgaggccggcttcaacaccgcctgcgtgaccaagctgttccccaccagaagccacaccgtggccgcccagggcggcatcaacgccgccctgggcaacatggaggaggacaactggagatggcacttctacgacaccagcaccggcgacggcaccgccatgatcaccagagccggcctgccctgccaggacctggagttcgtgcagttccaccccaccggcatctacggcgccggctgcctgatcaccgagggctgcagaggcgagggcggcatcctgatcaacagccagggcgagagattcatggagagatacgcccccgtggccaaggacctggccagcagagacgtggtgagcagaagcatgaccctggagatcagagagggcagaggctgcggccccgagaaggaccacgtgtacctgcagctgcaccacctgccccccgagcagctggccaccagactgcccggcatcagcgagaccgccatgatcttcgccggcgtggacgtgaccaaggagcccatccccgtgctgcccaccgtgcactacaacatgggcggcatccccaccaactacaagggccaggtgctgagacacgtgaacggccaggaccagatcgtgcccggcctgtacgcctgcggcgaggccgcctgcgccagcgtgcacggcgccaacagactgggcgccaacagcctgctggacctggtggtgttcggcagagcctgcgccctgagcatcgaggagagctgcagacccggcgacaaggtgccccccatcaagcccaacgccggcgaggagagcgtgatgaacctggacaagctgagattcgccgacggcagcatcagaaccagcgagctgagactgagcatgcagaagagcatgcagaaccacgccgccgtgttcagagtgggcagcgtgctgcaggagggctgcggcaagatcagcaagctgtacggcgacctgaagcacctgaagaccttcgacagaggcatggtgtggaacaccgacctggtggagaccctggagctgcagaacctgatgctgtgcgccctgcagaccatctacggcgccgaggccagaaaggagagcagaggcgcccacgccagagaggactacaaggtgagaatcgacgagtacgactacagcaagcccatccagggccagcagaagaagcccttcgaggagcactggagaaagcacaccctgagctacgtggacgtgggcaccggcaaggtgaccctggagtacagacccgtgatcgacaagaccctgaacgaggccgactgcgccaccgtgccccccgccatcagaagctactag

SEQ ID NO: 13064 - DNA, 6645 bp, Artificial Sequence
  Description of Artificial Sequence: Synthetic coding sequence
atgaagagaaaggagagaatcgccagaagactggagggcatcgagaacgacacccagcccatcctgctgcagagctgcaccggcctggtgacccacagactgctggaggaggacacccccagatacatgagagccagcgaccccgccagcccccacatcggcagaagcaacgaggaggaggagaccagcgacagcagcctggagaagcagaccagaagcaagtactgcaccgagaccagcggcgtgcacggcgacagcccctacggcagcggcaccatggacacccacagcctggagagcaaggccgagagaatcgccagatacaaggccgagagaagaagacagctggccgagaagtacggcctgaccctggaccccgaggccgacagcgagtacctgagcagatacaccaagagcagaaaggagcccgacgccgtggagaagagaggcggcaagagcgacaagcaggaggagagcagcagagacgccagcagcctgtaccccggcaccgagaccatgggcctgagaacctgcgccggcgagagcaaggactacgccctgcacgtgggcgacggcagcagcgaccccgaggtgctgctgaacatcgagaaccagagaagaggccaggagctgagcgccaccagacaggcccacgacctgagccccgccgccgagagcagcagcaccttcagcttcagcggcagagacagcagcttcaccgaggtgcccagaagccccaagcacgcccacagcagcagcctgcagcaggccgccagcagaagccccagcttcggcgacccccagctgagccccgaggccagacccagcaccggcaagcccaagcacgagtggttcctgcagaaggacagcgagggcgacacccccagcctgatcaactggcccagcagagtgaaggtgagagagaagctggtgaaggaggagagcgccagaaacagccccgagctggccagcgagagcgtgacccagagaagacaccagcccgcccccgtgcactacgtgagcttccagagcgagcacagcgccttcgacagagtgcccagcaaggccgccggcagcaccagacagcccatcagaggctacgtgcagcccgccgacaccggccacaccgccaagctggtgacccccgagacccccgagaacgccagcgagtgcagctgggtggccagcgccacccagaacgtgcccaagccccccagcctgaccgtgctggagggcgacggcagagacagccccgtgctgcacgtgtgcgagagcaaggccgaggaggaggagggcgagggcgagggcgaggagaaggaggaggacgtgtgcttcaccgaggccctggagcagagcaagaagaccctgctggccctggagggcgacggcctggtgagaagccccgaggaccccagcagaaacgaggacttcggcaagcccgccgtgagcaccgtgaccctggagcaccagaaggagctggagaacgtggcccagcccccccaggccccccaccagcccaccgagagaaccggcagaagcgagatggtgctgtacatccagagcgagcccgtgagccaggacgccaagcccaccggccacaacagagaggccagcaagaagagaaaggtgagaaccagaagcctgagcgacttcaccggccccccccagctgcaggccctgaagtacaaggaccccgccagcagaagagagctggagctgcccagcagcaagaccgagggcccctacggcgagatcagcatgctggacaccaaggtgagcgtggcccagctgagaagcgccttcctggccagcgccaacgcctgcagaagacccgagctgaagagcagagtggagagaagcgccgagggccccggcctgcccaccggcgtggagagagagagaggcagcagaaagcccagaagatacttcagccccggcgagagcagaaagaccagcgagagattcagaacccagcccatcaccagcgccgagagaaaggagagcgacagatgcaccagccacagcgagacccccaccgtggacgacgaggagaaggtggacgagagagccaagctgagcgtggccgccaagagactgctgttcagagagatggagaagagcttcgacgagcagaacgtgcccaagagaagaagcagaaacaccgccgtggagcagagactgagaagactgcaggacagaagcctgacccagcccatcaccaccgaggaggtggtgatcgccgccaccgagcccatccccgccagctgcagcggcggcacccaccccgtgatggccagactgcccagccccaccgtggccagaagcgccgtgcagcccgccagactgcaggccagcgcccaccagaaggccctggccaaggaccagaccaacgagggcaaggagctggccgagcagggcgagcccgacagcagcaccctgagcctggccgagaagctggccctgttcaacaagctgagccagcccgtgagcaaggccatcagcaccagaaacagaatcgacaccagacagagaagaatgaacgccagataccagacccagcccgtgaccctgggcgaggtggagcaggtgcagagcggcaagctgatccccttcagccccgccgtgaacaccagcgtgagcaccgtggccagcaccgtggcccccatgtacgccggcgacctgagaaccaagccccccctggaccacaacgccagcgccaccgactacaagttcagcagcagcatcgagaacagcgacagccccgtgagaagcatcctgaagagccaggcctggcagcccctggtggagggcagcgagaacaagggcatgctgagagagtacggcgagaccgagagcaagagagccctgaccggcagagacagcggcatggagaagtacggcagcttcgaggaggccgaggccagctaccccatcctgaacagagccagagagggcgacagccacaaggagagcaagtacgccgtgcccagaagaggcagcctggagagagccaacccccccatcacccacctgggcgacgagcccaaggagttcagcatggccaagatgaacgcccagggcaacctggacctgagagacagactgcccttcgaggagaaggtggaggtggagaacgtgatgaagagaaagttcagcctgagagccgccgagttcggcgagcccaccagcgagcagaccggcaccgccgccggcaagaccatcgcccagaccaccgcccccgtgagctggaagccccaggacagcagcgagcagccccaggagaagctgtgcaagaacccctgcgccatgttcgccgccggcgagatcaagacccccaccggcgagggcctgctggacagccccagcaagaccatgagcatcaaggagagactggccctgctgaagaagagcggcgaggaggactggagaaacagactgagcagaagacaggagggcggcaaggcccccgccagcagcctgcacacccaggaggccggcagaagcctgatcaagaagagagtgaccgagagcagagagagccagatgaccatcgaggagagaaagcagctgatcaccgtgagagaggaggcctggaagaccagaggcagaggcgccgccaacgacagcacccagttcaccgtggccggcagaatggtgaagaagggcctggccagccccaccgccatcacccccgtggccagccccatctgcggcaagaccagaggcaccacccccgtgagcaagcccctggaggacatcgaggccagacccgacatgcagctggagagcgacctgaagctggacagactggagaccttcctgagaagactgaacaacaaggtgggcggcatgcacgagaccgtgctgaccgtgaccggcaagagcgtgaaggaggtgatgaagcccgacgacgacgagaccttcgccaagttctacagaagcgtggactacaacatgcccagaagccccgtggagatggacgaggacttcgacgtgatcttcgacccctacgcccccaagctgaccagcagcgtggccgagcacaagagagccgtgagacccaagagaagagtgcaggccagcaagaaccccctgaagatgctggccgccagagaggacctgctgcaggagtacaccgagcagagactgaacgtggccttcatggagagcaagagaatgaaggtggagaagatgagcagcaacagcaacttcagcgaggtgaccctggccggcctggccagcaaggagaacttcagcaacgtgagcctgagaagcgtgaacctgaccgagcagaacagcaacaacagcgccgtgccctacaagagactgatgctgctgcagatcaagggcagaagacacgtgcagaccagactggtggagcccagagccagcgccctgaacagcggcgactgcttcctgctgctgagcccccactgctgcttcctgtgggtgggcgagttcgccaacgtgatcgagaaggccaaggccagcgagctggccaccctgatccagaccaagagagagctgggctgcagagccacctacatccagaccatcgaggagggcatcaacacccacacccacgccgccaaggacttctggaagctgctgggcggccagaccagctaccagagcgccggcgaccccaaggaggacgagctgtacgaggccgccatcatcgagaccaactgcatctacagactgatggacgacaagctggtgcccgacgacgactactggggcaagatccccaagtgcagcctgctgcagcccaaggaggtgctggtgttcgacttcggcagcgaggtgtacgtgtggcacggcaaggaggtgaccctggcccagagaaagatcgccttccagctggccaagcacctgtggaacggcaccttcgactacgagaactgcgacatcaaccccctggaccccggcgagtgcaaccccctgatccccagaaagggccagggcagacccgactgggccatcttcggcagactgaccgagcacaacgagaccatcctgttcaaggagaagttcctggactggaccgagctgaagagaagcaacgagaagaaccccggcgagctggcccagcacaaggaggaccccagaaccgacgtgaaggcctacgacgtgaccagaatggtgagcatgccccagaccaccgccggcaccatcctggacggcgtgaacgtgggcagaggctacggcctggtggagggccacgacagaagacagttcgagatcaccagcgtgagcgtggacgtgtggcacatcctggagttcgactacagcagactgcccaagcagagcatcggccagttccacgagggcgacgcctacgtggtgaagtggaagttcatggtgagcaccgccgtgggcagcagacagaagggcgagcacagcgtgagagccgccggcaaggagaagtgcgtgtacttcttctggcagggcagacacagcaccgtgagcgagaagggcaccagcgccctgatgaccgtggagctggacgaggagagaggcgcccaggtgcaggtgctgcagggcaaggagcccccctgcttcctgcagtgcttccagggcggcatggtggtgcacagcggcagaagagaggaggaggaggagaacgtgcagagcgagtggagactgtactgcgtgagaggcgaggtgcccgtggagggcaacctgctggaggtggcctgccactgcagcagcctgagaagcagaaccagcatggtggtgctgaacgtgaacaaggccctgatctacctgtggcacggctgcaaggcccaggcccacaccaaggaggtgggcagaaccgccgccaacaagatcaaggagcagtgccccctggaggccggcctgcacagcagcagcaaggtgaccatccacgagtgcgacgagggcagcgagcccctgggcttctgggacgccctgggcagaagagacagaaaggcctacgactgcatgctgcaggaccccggcagcttcaacttcgcccccagactgttcatcctgagcagcagcagcggcgacttcgccgccaccgagttcgtgtaccccgccagagcccccagcgtggtgagcagcatgcccttcctgcaggaggacctgtacagcgccccccagcccgccctgttcctggtggacaaccaccacgaggtgtacctgtggcagggctggtggcccatcgagaacaagatcaccggcagcgccagaatcagatgggccagcgacagaaagagcgccatggagaccgtgctgcagtactgcaagggcaagaacctgaagaagcccgcccccaagagctacctgatccacgccggcctggagcccctgaccttcaccaacatgttccccagctgggagcacagagaggacatcgccgagatcaccgagatggacaccgaggtgagcaaccagatcaccctggtggaggacgtgctggccaagctgtgcaagaccatctaccccctggccgacctgctggccagacccctgcccgagggcgtggaccccctgaagctggagatctacctgaccgacgaggacttcgagttcgccctggacatgaccagagacgagtacaacgccctgcccgcctggaagcaggtgaacctgaagaaggccaagggcctgttctag

SEQ ID NO: 13065 - DNA, 6645 bp, Artificial Sequence; identical to SEQ ID NO: 13064
  Description of Artificial Sequence: Synthetic coding sequence

SEQ ID NO: 13066 - DNA, 5367 bp, Artificial Sequence
  Description of Artificial Sequence: Synthetic coding sequence
atgaagagaaaggagagaatcgccagaagactggagggcatcgagaacgacacccagcccatcctgctgcagagctgcaccggcctggtgacccacagactgctggaggaggacacccccagatacatgagagccagcgaccccgccagcccccacatcggcagaagcaacgaggaggaggagaccagcgacagcagcctggagaagcagaccagaagcaagtactgcaccgagaccagcggcgtgcacggcgacagcccctacggcagcggcaccatggacacccacagcctggagagcaaggccgagagaatcgccagatacaaggccgagagaagaagacagctggccgagaagtacggcctgaccctggaccccgaggccgacagcgagtacctgagcagatacaccaagagcagaaaggagcccgacgccgtggagaagagaggcggcaagagcgacaagcaggaggagagcagcagagacgccagcagcctgtaccccggcaccgagaccatgggcctgagaacctgcgccggcgagagcaaggactacgccctgcacgtgggcgacggcagcagcgaccccgaggtgctgctgaacatcgagaaccagagaagaggccaggagctgagcgccaccagacaggcccacgacctgagccccgccgccgagagcagcagcaccttcagcttcagcggcagagacagcagcttcaccgaggtgcccagaagccccaagcacgcccacagcagcagcctgcagcaggccgccagcagaagccccagcttcggcgacccccagctgagccccgaggccagacccagatgcaccagccacagcgagacccccaccgtggacgacgaggagaaggtggacgagagagccaagctgagcgtggccgccaagagactgctgttcagagagatggagaagagcttcgacgagcagaacgtgcccaagagaagaagcagaaacaccgccgtggagcagagactgagaagactgcaggacagaagcctgacccagcccatcaccaccgaggaggtggtgatcgccgccaccctgcaggccagcgcccaccagaaggccctggccaaggaccagaccaacgagggcaaggagctggccgagcagggcgagcccgacagcagcaccctgagcctggccgagaagctggccctgttcaacaagctgagccagcccgtgagcaaggccatcagcaccagaaacagaatcgacaccagacagagaagaatgaacgccagataccagacccagcccgtgaccctgggcgaggtggagcaggtgcagagcggcaagctgatccccttcagccccgccgtgaacaccagcgtgagcaccgtggccagcaccgtggcccccatgtacgccggcgacctgagaaccaagccccccctggaccacaacgccagcgccaccgactacaagttcagcagcagcatcgagaacagcgacagccccgtgagaagcatcctgaagagccaggcctggcagcccctggtggagggcagcgagaacaagggcatgctgagagagtacggcgagaccgagagcaagagagccctgaccggcagagacagcggcatggagaagtacggcagcttcgaggaggccgaggccagctaccccatcctgaacagagccagagagggcgacagccacaaggagagcaagtacgccgtgcccagaagaggcagcctggagagagccaacccccccatcacccacctgggcgacgagcccaaggagttcagcatggccaagatgaacgcccagggcaacctggacctgagagacagactgcccttcgaggagaaggtggaggtggagaacgtgatgaagagaaagttcagcctgagagccgccgagttcggcgagcccaccagcgagcagaccggcaccgccgccggcaagaccatcgcccagaccaccgcccccgtgagctggaagccccaggacagcagcgagcagccccaggagaagctgtgcaagaacccctgcgccatgttcgccgccggcgagatcaagacccccaccggcgagggcctgctggacagccccagcaagaccatgagcatcaaggagagactggccctgctgaagaagagcggcgaggaggactggagaaacagactgagcagaagacaggagggcggcaaggcccccgccagcagcctgcacacccaggaggccggcagaagcctgatcaagaagagagtgaccgagagcagagagagccagatgaccatcgaggagagaaagcagctgatcaccgtgagagaggaggcctggaagaccagaggcagaggcgccgccaacgacagcacccagttcaccgtggccggcagaatggtgaagaagggcctggccagccccaccgccatcacccccgtggccagccccatctgcggcaagaccagaggcaccacccccgtgagcaagcccctggaggacatcgaggccagacccgacatgcagctggagagcgacctgaagctggacagactggagaccttcctgagaagactgaacaacaaggtgggcggcatgcacgagaccgtgctgaccgtgaccggcaagagcgtgaaggaggtgatgaagcccgacgacgacgagaccttcgccaagttctacagaagcgtggactacaacatgcccagaagccccgtggagatggacgaggacttcgacgtgatcttcgacccctacgcccccaagctgaccagcagcgtggccgagcacaagagagccgtgagacccaagagaagagtgcaggccagcaagaaccccctgaagatgctggccgccagagaggacctgctgcaggagtacaccgagcagagactgaacgtggccttcatggagagcaagagaatgaaggtggagaagatgagcagcaacagcaacttcagcgaggtgaccctggccggcctggccagcaaggagaacttcagcaacgtgagcctgagaagcgtgaacctgaccgagcagaacagcaacaacagcgccgtgccctacaagagactgatgctgctgcagatcaagggcagaagacacgtgcagaccagactggtggagcccagagccagcgccctgaacagcggcgactgcttcctgctgctgagcccccactgctgcttcctgtgggtgggcgagttcgccaacgtgatcgagaaggccaaggccagcgagctggccaccctgatccagaccaagagagagctgggctgcagagccacctacatccagaccatcgaggagggcatcaacacccacacccacgccgccaaggacttctggaagctgctgggcggccagaccagctaccagagcgccggcgaccccaaggaggacgagctgtacgaggccgccatcatcgagaccaactgcatctacagactgatggacgacaagctggtgcccgacgacgactactggggcaagatccccaagtgcagcctgctgcagcccaaggaggtgctggtgttcgacttcggcagcgaggtgtacgtgtggcacggcaaggaggtgaccctggcccagagaaagatcgccttccagctggccaagcacctgtggaacggcaccttcgactacgagaactgcgacatcaaccccctggaccccggcgagtgcaaccccctgatccccagaaagggccagggcagacccgactgggccatcttcggcagactgaccgagcacaacgagaccatcctgttcaaggagaagttcctggactggaccgagctgaagagaagcaacgagaagaaccccggcgagctggcccagcacaaggaggaccccagaaccgacgtgaaggcctacgacgtgaccagaatggtgagcatgccccagaccaccgccggcaccatcctggacggcgtgaacgtgggcagaggctacggcctggtggagggccacgacagaagacagttcgagatcaccagcgtgagcgtggacgtgtggcacatcctggagttcgactacagcagactgcccaagcagagcatcggccagttccacgagggcgacgcctacgtggtgaagtggaagttcatggtgagcaccgccgtgggcagcagacagaagggcgagcacagcgtgagagccgccggcaaggagaagtgcgtgtacttcttctggcagggcagacacagcaccgtgagcgagaagggcaccagcgccctgatgaccgtggagctggacgaggagagaggcgcccaggtgcaggtgctgcagggcaaggagcccccctgcttcctgcagtgcttccagggcggcatggtggtgcacagcggcagaagagaggaggaggaggagaacgtgcagagcgagtggagactgtactgcgtgagaggcgaggtgcccgtggagggcaacctgctggaggtggcctgccactgcagcagcctgagaagcagaaccagcatggtggtgctgaacgtgaacaaggccctgatctacctgtggcacggctgcaaggcccaggcccacaccaaggaggtgggcagaaccgccgccaacaagatcaaggagcagtgccccctggaggccggcctgcacagcagcagcaaggtgaccatccacgagtgcgacgagggcagcgagcccctgggcttctgggacgccctgggcagaagagacagaaaggcctacgactgcatgctgcaggaccccggcagcttcaacttcgcccccagactgttcatcctgagcagcagcagcggcgacttcgccgccaccgagttcgtgtaccccgccagagcccccagcgtggtgagcagcatgcccttcctgcaggaggacctgtacagcgccccccagcccgccctgttcctggtggacaaccaccacgaggtgtacctgtggcagggctggtggcccatcgagaacaagatcaccggcagcgccagaatcagatgggccagcgacagaaagagcgccatggagaccgtgctgcagtactgcaagggcaagaacctgaagaagcccgcccccaagagctacctgatccacgccggcctggagcccctgaccttcaccaacatgttccccagctgggagcacagagaggacatcgccgagatcaccgagatggacaccgaggtgagcaaccagatcaccctggtggaggacgtgctggccaagctgtgcaagaccatctaccccctggccgacctgctggccagacccctgcccgagggcgtggaccccctgaagctggagatctacctgaccgacgaggacttcgagttcgccctggacatgaccagagacgagtacaacgccctgcccgcctggaagcaggtgaacctgaagaaggccaagggcctgttctag

SEQ ID NO: 13067 - DNA, 3387 bp, Artificial Sequence
  Description of Artificial Sequence: Synthetic coding sequence
atgttcgccgccggcgagatcaagacccccaccggcgagggcctgctggacagccccagcaagaccatgagcatcaaggagagactggccctgctgaagaagagcggcgaggaggactggagaaacagactgagcagaagacaggagggcggcaaggcccccgccagcagcctgcacacccaggaggccggcagaagcctgatcaagaaggaggagggcggcgtggccgacgacagcgccatcagcaacctgctgtggagagtgaccgagagcagagagagccagatgaccatcgaggagagaaagcagctgatcaccgtgagagaggaggcctggaagaccagaggcagaggcgccgccaacgacagcacccagttcaccgtggccggcagaatggtgaagaagggcctggccagccccaccgccatcacccccgtggccagccccatctgcggcaagaccagaggcaccacccccgtgagcaagcccctggaggacatcgaggccagacccgacatgcagctggagagcgacctgaagctggacagactggagaccttcctgagaagactgaacaacaaggtgggcggcatgcacgagaccgtgctgaccgtgaccggcaagagcgtgaaggaggtgatgaagcccgacgacgacgagaccttcgccaagttctacagaagcgtggactacaacatgcccagaagccccgtggagatggacgaggacttcgacgtgatcttcgacccctacgcccccaagctgaccagcagcgtggccgagcacaagagagccgtgagacccaagagaagagtgcaggccagcaagaaccccctgaagatgctggccgccagagaggacctgctgcaggagtacaccgagcagagactgaacgtggccttcatggagagcaagagaatgaaggtggagaagatgagcagcaacagcaacttcagcgaggtgaccctggccggcctggccagcaaggagaacttcagcaacgtgagcctgagaagcgtgaacctgaccgagcagaacagcaacaacagcgccgtgccctacaagagactgatgctgctgcagatcaagggcagaagacacgtgcagaccagactggtggagcccagagccagcgccctgaacagcggcgactgcttcctgctgctgagcccccactgctgcttcctgtgggtgggcgagttcgccaacgtgatcgagaaggccaaggccagcgagctggccaccctgatccagaccaagagagagctgggctgcagagccacctacatccagaccatcgaggagggcatcaacacccacacccacgccgccaaggacttctggaagctgctgggcggccagaccagctaccagagcgccggcgaccccaaggaggacgagctgtacgaggccgccatcatcgagaccaactgcatctacagactgatggacgacaagctggtgcccgacgacgactactggggcaagatccccaagtgcagcctgctgcagcccaaggaggtgctggtgttcgacttcggcagcgaggtgtacgtgtggcacggcaaggaggtgaccctggcccagagaaagatcgccttccagctggccaagcacctgtggaacggcaccttcgactacgagaactgcgacatcaaccccctggaccccggcgagtgcaaccccctgatccccagaaagggccagggcagacccgactgggccatcttcggcagactgaccgagcacaacgagaccatcctgttcaaggagaagttcctggactggaccgagctgaagagaagcaacgagaagaaccccggcgagctggcccagcacaaggaggaccccagaaccgacgtgaaggcctacgacgtgaccagaatggtgagcatgccccagaccaccgccggcaccatcctggacggcgtgaacgtgggcagaggctacggcctggtggagggccacgacagaagacagttcgagatcaccagcgtgagcgtggacgtgtggcacatcctggagttcgactacagcagactgcccaagcagagcatcggccagttccacgagggcgacgcctacgtggtgaagtggaagttcatggtgagcaccgccgtgggcagcagacagaagggcgagcacagcgtgagagccgccggcaaggagaagtgcgtgtacttcttctggcagggcagacacagcaccgtgagcgagaagggcaccagcgccctgatgaccgtggagctggacgaggagagaggcgcccaggtgcaggtgctgcagggcaaggagcccccctgcttcctgcagtgcttccagggcggcatggtggtgcacagcggcagaagagaggaggaggaggagaacgtgcagagcgagtggagactgtactgcgtgagaggcgaggtgcccgtggagggcaacctgctggaggtggcctgccactgcagcagcctgagaagcagaaccagcatggtggtgctgaacgtgaacaaggccctgatctacctgtggcacggctgcaaggcccaggcccacaccaaggaggtgggcagaaccgccgccaacaagatcaaggagcagtgccccctggaggccggcctgcacagcagcagcaaggtgaccatccacgagtgcgacgagggcagcgagcccctgggcttctgggacgccctgggcagaagagacagaaaggcctacgactgcatgctgcaggaccccggcagcttcaacttcgcccccagactgttcatcctgagcagcagcagcggcgacttcgccgccaccgagttcgtgtaccccgccagagcccccagcgtggtgagcagcatgcccttcctgcaggaggacctgtacagcgccccccagcccgccctgttcctggtggacaaccaccacgaggtgtacctgtggcagggctggtggcccatcgagaacaagatcaccggcagcgccagaatcagatgggccagcgacagaaagagcgccatggagaccgtgctgcagtactgcaagggcaagaacctgaagaagcccgcccccaagagctacctgatccacgccggcctggagcccctgaccttcaccaacatgttccccagctgggagcacagagaggacatcgccgagatcaccgagatggacaccgaggtgagcaaccagatcaccctggtggaggacgtgctggccaagctgtgcaagaccatctaccccctggccgacctgctggccagacccctgcccgagggcgtggaccccctgaagctggagatctacctgaccgacgaggacttcgagttcgccctggacatgaccagagacgagtacaacgccctgcccgcctggaagcaggtgaacctgaagaaggccaagggcctgttctag

SEQ ID NO: 13068 - DNA, 2301 bp, Artificial Sequence
  Description of Artificial Sequence: Synthetic coding sequence
atgaagagaaagttcagcctgagagccgccgagttcggcgagcccaccagcgagcagaccggcaccgccgccggcaagaccatcgcccagaccaccgcccccgtgagctggaagccccaggacagcagcgagcagccccaggagaagctgtgcaagaacccctgcgccatgttcgccgccggcgagatcaagacccccaccggcgagggcctgctggacagccccagcaagaccatgagcatcaaggagagactggccctgctgaagaagagcggcgaggaggactggagaaacagactgagcagaagacaggagggcggcaaggcccccgccagcagcctgcacacccaggaggccggcagaagcctgatcaagaagagagtgaccgagagcagagagagccagatgaccatcgaggagagaaagcagctgatcaccgtgagagaggaggcctggaagaccagaggcagaggcgccgccaacgacagcacccagttcaccgtggccggcagaatggtgaagaagggcctggccagccccaccgccatcacccccgtggccagccccatctgcggcaagaccagaggcaccacccccgtgagcaagcccctggaggacatcgaggccagacccgacatgcagctggagagcgacctgaagctggacagactggagaccttcctgagaagactgaacaacaaggtgggcggcatgcacgagaccgtgctgaccgtgaccggcaagagcgtgaaggaggtgatgaagcccgacgacgacgagaccttcgccaagttctacagaagcgtggactacaacatgcccagaagccccgtggagatggacgaggacttcgacgtgatcttcgacccctacgcccccaagctgaccagcagcgtggccgagcacaagagagccgtgagacccaagagaagagtgcaggccagcaagaaccccctgaagatgctggccgccagagaggacctgctgcaggagtacaccgagcagagactgaacgtggccttcatggagagcaagagaatgaaggtggagaagatgagcagcaacagcaacttcagcgaggtgaccctggccggcctggccagcaaggagaacttcagcaacgtgagcctgagaagcgtgaacctgaccgagcagaacagcaacaacagcgccgtgccctacaagagactgatgctgctgcagatcaagggcagaagacacgtgcagaccagactggtggagcccagagccagcgccctgaacagcggcgactgcttcctgctgctgagcccccactgctgcttcctgtgggtgggcgagttcgccaacgtgatcgagaaggccaaggccagcgagctggccaccctgatccagaccaagagagagctgggctgcagagccacctacatccagaccatcgaggagggcatcaacacccacacccacgccgccaaggacttctggaagctgctgggcggccagaccagctaccagagcgccggcgaccccaaggaggacgagctgtacgaggccgccatcatcgagaccaactgcatctacagactgatggacgacaagctggtgcccgacgacgactactggggcaagatccccaagtgcagcctgctgcagcccaaggaggtgctggtgttcgacttcggcagcgaggtgtacgtgtggcacggcaaggaggtgaccctggcccagagaaagatcgccttccagctggccaagcacctgtggaacggcaccttcgactacgagaactgcgacatcaaccccctggaccccggcgagtgcaaccccctgatccccagaaagggccagggcagacccgactgggccatcttcggcagactgaccgagcacaacgagaccatcctgttcaaggagaagttcctggactggaccgagctgaagagaagcaacgagaagaaccccggcgagctggcccagcacaaggaggaccccagaaccgacgtgaaggcctacgacgtgaccagaatggtgagcatgccccagaccaccgccggcaccatcctggacggcgtgaacgtgggcagaggctacggcctggtggagggccacgacagaagacagttcgagatcaccagcgtgagcgtggacgtgtggcacatcctggagttcgactacagcagactgcccaagcagagcatcggccagttccacgagggcgacgcctacgtggtgaagtggaagttcatggtgagcaccgccgtgctgagagcctggagaggcgccagaggcagagagttcgccggcagcggcctgagcctgtag

SEQ ID NO: 13069 - DNA, 1758 bp, Artificial Sequence
  Description of Artificial Sequence: Synthetic coding sequence
atgaacagcagcgacgtgagcagcctgaagcaccccagcagcctggccagccccaccgccatcacccccgtggccagccccatctgcggcaagaccagaggcaccacccccgtgagcaagcccctggaggacatcgaggccagacccgacatgcagctggagagcgacctgaagctggacagactggagaccttcctgagaagactgaacaacaaggtgggcggcatgcacgagaccgtgctgaccgtgaccggcaagagcgtgaaggaggtgatgaagcccgacgacgacgagaccttcgccaagttctacagaagcgtggactacaacatgcccagaagccccgtggagatggacgaggacttcgacgtgatcttcgacccctacgcccccaagctgaccagcagcgtggccgagcacaagagagccgtgagacccaagagaagagtgcaggccagcaagaaccccctgaagatgctggccgccagagaggacctgctgcaggagtacaccgagcagagactgaacgtggccttcatggagagcaagagaatgaaggtggagaagatgagcagcaacagcaacttcagcgaggtgaccctggccggcctggccagcaaggagaacttcagcaacgtgagcctgagaagcgtgaacctgaccgagcagaacagcaacaacagcgccgtgccctacaagagactgatgctgctgcagatcaagggcagaagacacgtgcagaccagactggtggagcccagagccagcgccctgaacagcggcgactgcttcctgctgctgagcccccactgctgcttcctgtgggtgggcgagttcgccaacgtgatcgagaaggccaaggccagcgagctggccaccctgatccagaccaagagagagctgggctgcagagccacctacatccagaccatcgaggagggcatcaacacccacacccacgccgccaaggacttctggaagctgctgggcggccagaccagctaccagagcgccggcgaccccaaggaggacgagctgtacgaggccgccatcatcgagaccaactgcatctacagactgatggacgacaagctggtgcccgacgacgactactggggcaagatccccaagtgcagcctgctgcagcccaaggaggtgctggtgttcgacttcggcagcgaggtgtacgtgtggcacggcaaggaggtgaccctggcccagagaaagatcgccttccagctggccaagcacctgtggaacggcaccttcgactacgagaactgcgacatcaaccccctggaccccggcgagtgcaaccccctgatccccagaaagggccagggcagacccgactgggccatcttcggcagactgaccgagcacaacgagaccatcctgttcaaggagaagttcctggactggaccgagctgaagagaagcaacgagaagaaccccggcgagctggcccagcacaaggaggaccccagaaccgacgtgaaggcctacgacgtgaccagaatggtgagcatgccccagaccaccgccggcaccatcctggacggcgtgaacgtgggcagaggctacggcctggtggagggccacgacagaagacagttcgagatcaccagcgtgagcgtggacgtgtggcacatcctggagttcgactacagcagactgcccaagcagagcatcggccagttccacgagggcgacgcctacgtggtgaagtggaagttcatggtgagcaccgccggctag

SEQ ID NO: 13070 - DNA, 636 bp, Artificial Sequence
  Description of Artificial Sequence: Synthetic coding sequence
atggtggcccacaaccaggtggccgccgacaacgccgtgagcaccgccgccgagcccagaagaagacccgagcccagcagcagcagcagcagcagccccgccgcccccgccagacccagaccctgccccgccgtgcccgcccccgcccccggcgacacccacttcagaaccttcagaagccacgccgactacagaagaatcaccagagccagcgccctgctggacgcctgcggcttctactggggccccctgagcgtgcacggcgcccacgagagactgagagccgagcccgtgggcaccttcctggtgagagacagcagacagagaaactgcttcttcgccctgagcgtgaagatggccagcggccccaccagcatcagagtgcacttccaggccggcagattccacctggacggcagcagagagagcttcgactgcctgttcgagctgctggagcactacgtggccgcccccagaagaatgctgggcgcccccctgagacagagaagagtgagacccctgcaggagctgtgcagacagagaatcgtggccaccgtgggcagagagaacctggccagaatccccctgaaccccgtgctgagagactacctgagcagcttccccttccagatctag

SEQ ID NO: 13071 - DNA, 678 bp, Artificial Sequence
  Description of Artificial Sequence: Synthetic coding sequence
atggtgacccacagcaagttccccgccgccggcatgagcagacccctggacaccagcctgagactgaagaccttcagcagcaagagcgagtaccagctggtggtgaacgccgtgagaaagctgcaggagagcggcttctactggagcgccgtgaccggcggcgaggccaacctgctgctgagcgccgagcccgccggcaccttcctgatcagagacagcagcgaccagagacacttcttcaccctgagcgtgaagacccagagcggcaccaagaacctgagaatccagtgcgagggcggcagcttcagcctgcagagcgaccccagaagcacccagcccgtgcccagattcgactgcgtgctgaagctggtgcaccactacatgcccccccccggcgcccccagcttccccagcccccccaccgagcccagcagcgaggtgcccgagcagcccagcgcccagcccctgcccggcagcccccccagaagagcctactacatctacagcggcggcgagaagatccccctggtgctgagcagacccctgagcagcaacgtggccaccctgcagcacctgtgcagaaagaccgtgaacggccacctggacagctacgagaaggtgacccagctgcccggccccatcagagagttcctggaccagtacgacgcccccctgtag

SEQ ID NO: 13072 - DNA, 1302 bp, Artificial Sequence
  Description of Artificial Sequence: Synthetic coding sequence
atggccgagctgagacccagcggcgcccccggccccaccgccccccccgcccccggccccaccgccccccccgccttcgccagcctgttcccccccggcctgcacgccatctacggcgagtgcagaagactgtaccccgaccagcccaaccccctgcaggtgaccgccatcgtgaagtactggctgggcggccccgaccccctggactacgtgagcatgtacagaaacgtgggcagccccagcgccaacatccccgagcactggcactacatcagcttcggcctgagcgacctgtacggcgacaacagagtgcacgagttcaccggcaccgacggccccagcggcttcggcttcgagctgaccttcagactgaagagagagaccggcgagagcgccccccccacctggcccgccgagctgatgcagggcctggccagatacgtgttccagagcgagaacaccttctgcagcggcgaccacgtgagctggcacagccccctggacaacagcgagagcagaatccagcacatgctgctgaccgaggacccccagatgcagcccgtgcagacccccttcggcgtggtgaccttcctgcagatcgtgggcgtgtgcaccgaggagctgcacagcgcccagcagtggaacggccagggcatcctggagctgctgagaaccgtgcccatcgccggcggcccctggctgatcaccgacatgagaagaggcgagaccatcttcgagatcgacccccacctgcaggagagagtggacaagggcatcgagaccgacggcagcaacctgagcggcgtgagcgccaagtgcgcctgggacgacctgagcagaccccccgaggacgacgaggacagcagaagcatctgcatcggcacccagcccagaagactgagcggcaaggacaccgagcagatcagagagaccctgagaagaggcctggagatcaacagcaagcccgtgctgccccccatcaacccccagagacagaacggcctggcccacgacagagcccccagcagaaaggacagcctggagagcgacagcagcaccgccatcatcccccacgagctgatcagaaccagacagctggagagcgtgcacctgaagttcaaccaggagagcggcgccctgatccccctgtgcctgagaggcagactgctgcacggcagacacttcacctacaagagcatcaccggcgacatggccatcaccttcgtgagcaccggcgtggagggcgccttcgccaccgaggagcacccctacgccgcccacggcccctggctgcagctgtag

SEQ ID NO: 13073 - DNA, 1455 bp, Artificial Sequence
  Description of Artificial Sequence: Synthetic coding sequence
atggccgagctgagacccagcggcgcccccggccccaccgccccccccgcccccggccccaccgccccccccgccttcgccagcctgttcccccccggcctgcacgccatctacggcgagtgcagaagactgtaccccgaccagcccaaccccctgcaggtgaccgccatcgtgaagtactggctgggcggccccgaccccctggactacgtgagcatgtacagaaacgtgggcagccccagcgccaacatccccgagcactggcactacatcagcttcggcctgagcgacctgtacggcgacaacagagtgcacgagttcaccggcaccgacggccccagcggcttcggcttcgagctgaccttcagactgaagagagagaccggcgagagcgccccccccacctggcccgccgagctgatgcagggcctggccagatacgtgttccagagcgagaacaccttctgcagcggcgaccacgtgagctggcacagccccctggacaacagcgagagcagaatccagcacatgctgctgaccgaggacccccagatgcagcccgtgcagacccccttcggcgtggtgaccttcctgcagatcgtgggcgtgtgcaccgaggagctgcacagcgcccagcagtggaacggccagggcatcctggagctgctgagaaccgtgcccatcgccggcggcccctggctgatcaccgacatgagaagaggcgagaccatcttcgagatcgacccccacctgcaggagagagtggacaagggcatcgagaccgacggcagcaacctgagcggcgtgagcgccaagtgcgcctgggacgacctgagcagaccccccgaggacgacgaggacagcagaagcatctgcatcggcacccagcccagaagactgagcggcaaggacaccgagcagatcagagagaccctgagaagaggcctggagatcaacagcaagcccgtgctgccccccatcaacccccagagacagaacggcctggcccacgacagagcccccagcagaaaggacagcctggagagcgacagcagcaccgccatcatcccccacgagctgatcagaaccagacagctggagagcgtgcacctgaagttcaaccaggagagcggcgccctgatccccctgtgcctgagaggcagactgctgcacggcagacacttcacctacaagagcatcaccggcgacatggccatcaccttcgtgagcaccggcgtggagggcgccttcgccaccgaggagcacccctacgccgcccacggcccctggctgcagatcctgctgaccgaggagttcgtggagaagatgctggaggacctggaggacctgaccagccccgaggagttcaagctgcccaaggagtacagctggcccgagaagaagctgaaggtgagcatcctgcccgacgtggtgttcgacagccccctgcactag

SEQ ID NO: 13074 - DNA, 240 bp, Artificial Sequence
  Description of Artificial Sequence: Synthetic coding sequence
atggccagaagcagactgaccgccaccagcgtgagccaggtgcaggagaacggcttcgtgaagaagctggagcccaagagcggctggatgaccttcctggaggtgaccggcaagatctgcgagatgctgttctgccccgaggccatcctgctgaccagaaaggacaccccctactgcgagaccggcctgatcttcctgaccctgaccaagaccatcgccaacacctacttctacttctag

SEQ ID NO: 13075 - DNA, 240 bp, Artificial Sequence; identical to SEQ ID NO: 13074
  Description of Artificial Sequence: Synthetic coding sequence

SEQ ID NO: 13076 - DNA, 1245 bp, Artificial Sequence
  Description of Artificial Sequence: Synthetic coding sequence
atgaacctgcagagatactggggcgagatccccatcagcagcagccagaccaacagaagcagcttcgacctgctgcccagagagttcagactggtggaggtgcacgacccccccctgcaccagcccagcgccaacaagcccaagccccccaccatgctggacatccccagcgagccctgcagcctgaccatccacaccatccagctgatccagcacaacagaagactgagaaacctgatcgccaccgcccaggcccagaaccagcagcagaccgagggcgtgaagaccgaggagagcgagcccctgcccagctgccccggcagcccccccctgcccgacgacctgctgcccctggactgcaagaaccccaacgcccccttccagatcagacacagcgaccccgagagcgacttctacagaggcaagggcgagcccgtgaccgagctgagctggcacagctgcagacagctgctgtaccaggccgtggccaccatcctggcccacgccggcttcgactgcgccaacgagagcgtgctggagaccctgaccgacgtggcccacgagtactgcctgaagttcaccaagctgctgagattcgccgtggacagagaggccagactgggccagacccccttccccgacgtgatggagcaggtgttccacgaggtgggcatcggcagcgtgctgagcctgcagaagttctggcagcacagaatcaaggactaccacagctacatgctgcagatcagcaagcagctgagcgaggagtacgagagaatcgtgaaccccgagaaggccaccgaggacgccaagcccgtgaagatcaaggaggagcccgtgagcgacatcaccttccccgtgagcgaggagctggaggccgacctggccagcggcgaccagagcctgcccatgggcgtgctgggcgcccagagcgagagattccccagcaacctggaggtggaggccagcccccaggccagcagcgccgaggtgaacgccagccccctgtggaacctggcccacgtgaagatggagccccaggagagcgaggagggcaacgtgagcggccacggcgtgctgggcagcgacgtgttcgaggagcccatgagcggcatgagcgaggccggcatcccccagagccccgacgacagcgacagcagctacggcagccacagcaccgacagcctgatgggcagcagccccgtgttcaaccagagatgcaagaagagaatgagaaagatctag

SEQ ID NO: 13077 - DNA, 840 bp, Artificial Sequence
  Description of Artificial Sequence: Synthetic coding sequence
atgaacctgcagagcggcaagggcgagcccgtgaccgagctgagctggcacagctgcagacagctgctgtaccaggccgtggccaccatcctggcccacgccggcttcgactgcgccaacgagagcgtgctggagaccctgaccgacgtggcccacgagtactgcctgaagttcaccaagctgctgagattcgccgtggacagagaggccagactgggccagacccccttccccgacgtgatggagcaggtgttccacgaggtgggcatcggcagcgtgctgagcctgcagaagttctggcagcacagaatcaaggactaccacagctacatgctgcagatcagcaagcagctgagcgaggagtacgagagaatcgtgaaccccgagaaggccaccgaggacgccaagcccgtgaagatcaaggaggagcccgtgagcgacatcaccttccccgtgagcgaggagctggaggccgacctggccagcggcgaccagagcctgcccatgggcgtgctgggcgcccagagcgagagattccccagcaacctggaggtggaggccagcccccaggccagcagcgccgaggtgaacgccagccccctgtggaacctggcccacgtgaagatggagccccaggagagcgaggagggcaacgtgagcggccacggcgtgctgggcagcgacgtgttcgaggagcccatgagcggcatgagcgaggccggcatcccccagagccccgacgacagcgacagcagctacggcagccacagcaccgacagcctgatgggcagcagccccgtgttcaaccagagatgcaagaagagaatgagaaagatctag

SEQ ID NO: 13078 - DNA, 1239 bp, Artificial Sequence
  Description of Artificial Sequence: Synthetic coding sequence
atgctgagatactggggcgagatccccatcagcagcagccagaccaacagaagcagcttcgacctgctgcccagagagttcagactggtggaggtgcacgacccccccctgcaccagcccagcgccaacaagcccaagccccccaccatgctggacatccccagcgagccctgcagcctgaccatccacaccatccagctgatccagcacaacagaagactgagaaacctgatcgccaccgcccaggcccagaaccagcagcagaccgagggcgtgaagaccgaggagagcgagcccctgcccagctgccccggcagcccccccctgcccgacgacctgctgcccctggactgcaagaaccccaacgcccccttccagatcagacacagcgaccccgagagcgacttctacagaggcaagggcgagcccgtgaccgagctgagctggcacagctgcagacagctgctgtaccaggccgtggccaccatcctggcccacgccggcttcgactgcgccaacgagagcgtgctggagaccctgaccgacgtggcccacgagtactgcctgaagttcaccaagctgctgagattcgccgtggacagagaggccagactgggccagacccccttccccgacgtgatggagcaggtgttccacgaggtgggcatcggcagcgtgctgagcctgcagaagttctggcagcacagaatcaaggactaccacagctacatgctgcagatcagcaagcagctgagcgaggagtacgagagaatcgtgaaccccgagaaggccaccgaggacgccaagcccgtgaagatcaaggaggagcccgtgagcgacatcaccttccccgtgagcgaggagctggaggccgacctggccagcggcgaccagagcctgcccatgggcgtgctgggcgcccagagcgagagattccccagcaacctggaggtggaggccagcccccaggccagcagcgccgaggtgaacgccagccccctgtggaacctggcccacgtgaagatggagccccaggagagcgaggagggcaacgtgagcggccacggcgtgctgggcagcgacgtgttcgaggagcccatgagcggcatgagcgaggccggcatcccccagagccccgacgacagcgacagcagctacggcagccacagcaccgacagcctgatgggcagcagccccgtgttcaaccagagatgcaagaagagaatgagaaagatctag

SEQ ID NO: 13079 - DNA, 1239 bp, Artificial Sequence; identical to SEQ ID NO: 13078
  Description of Artificial Sequence: Synthetic coding sequence

SEQ ID NO: 13080 - DNA, 1239 bp, Artificial Sequence; identical to SEQ ID NO: 13078
  Description of Artificial Sequence: Synthetic coding sequence

SEQ ID NO: 13081 - DNA, 1272 bp, Artificial Sequence
  Description of Artificial Sequence: Synthetic coding sequence
atggtgggcatgagcagactgagaaacgacagactggccgaccccctgaccggctgcagcgtgtgctgcaagagcagctggaaccagctgcaggacctgtgcagactggccaagctgagctgccccgccctgggcatcagcaagagaaacctgtacgacttcgaggtggagtacctgtgcgactacaagaagatcagagagcaggagtactacctggtgaagtggagaggctaccccgacagcgagagcacctgggagcccagacagaacctgaagtgcgtgagaatcctgaagcagttccacaaggacctggagagagagctgctgagaagacaccacagaagcaagacccccagacacctggaccccagcctggccaactacctggtgcagaaggccaagcagagaagagccctgagaagatgggagcaggagctgaacgccaagagaagccacctgggcagaatcaccgtggagaacgaggtggacctggacggcccccccagagccttcgtgtacatcaacgagtacagagtgggcgagggcatcaccctgaaccaggtggccgtgggctgcgagtgccaggactgcctgtgggcccccaccggcggctgctgccccggcgccagcctgcacaagttcgcctacaacgaccagggccaggtgagactgagagccggcctgcccatctacgagtgcaacagcagatgcagatgcggctacgactgccccaacagagtggtgcagaagggcatcagatacgacctgtgcatcttcagaaccgacgacggcagaggctggggcgtgagaaccctggagaagatcagaaagaacagcttcgtgatggagtacgtgggcgagatcatcaccagcgaggaggccgagagaagaggccagatctacgacagacagggcgccacctacctgttcgacctggactacgtggaggacgtgtacaccgtggacgccgcctactacggcaacatcagccacttcgtgaaccacagctgcgaccccaacctgcaggtgtacaacgtgttcatcgacaacctggacgagagactgcccagaatcgccttcttcgccaccagaaccatcagagccggcgaggagctgaccttcgactacaacatgcaggtggaccccgtggacatggagagcaccagaatggacagcaacttcggcctggccggcctgcccggcagccccaagaagagagtgagaatcgagtgcaagtgcggcaccgagagctgcagaaagtacctgttctag

SEQ ID NO: 13082 - DNA, 1239 bp, Artificial Sequence
  Description of Artificial Sequence: Synthetic coding sequence
atggccgagaacctgaagggctgcagcgtgtgctgcaagagcagctggaaccagctgcaggacctgtgcagactggccaagctgagctgccccgccctgggcatcagcaagagaaacctgtacgacttcgaggtggagtacctgtgcgactacaagaagatcagagagcaggagtactacctggtgaagtggagaggctaccccgacagcgagagcacctgggagcccagacagaacctgaagtgcgtgagaatcctgaagcagttccacaaggacctggagagagagctgctgagaagacaccacagaagcaagacccccagacacctggaccccagcctggccaactacctggtgcagaaggccaagcagagaagagccctgagaagatgggagcaggagctgaacgccaagagaagccacctgggcagaatcaccgtggagaacgaggtggacctggacggcccccccagagccttcgtgtacatcaacgagtacagagtgggcgagggcatcaccctgaaccaggtggccgtgggctgcgagtgccaggactgcctgtgggcccccaccggcggctgctgccccggcgccagcctgcacaagttcgcctacaacgaccagggccaggtgagactgagagccggcctgcccatctacgagtgcaacagcagatgcagatgcggctacgactgccccaacagagtggtgcagaagggcatcagatacgacctgtgcatcttcagaaccgacgacggcagaggctggggcgtgagaaccctggagaagatcagaaagaacagcttcgtgatggagtacgtgggcgagatcatcaccagcgaggaggccgagagaagaggccagatctacgacagacagggcgccacctacctgttcgacctggactacgtggaggacgtgtacaccgtggacgccgcctactacggcaacatcagccacttcgtgaaccacagctgcgaccccaacctgcaggtgtacaacgtgttcatcgacaacctggacgagagactgcccagaatcgccttcttcgccaccagaaccatcagagccggcgaggagctgaccttcgactacaacatgcaggtggaccccgtggacatggagagcaccagaatggacagcaacttcggcctggccggcctgcccggcagccccaagaagagagtgagaatcgagtgcaagtgcggcaccgagagctgcagaaagtacctgttctag

SEQ ID NO: 13083 - DNA, 648 bp, Artificial Sequence
  Description of Artificial Sequence: Synthetic coding sequence
atggcctggatcagcagactgagagagcacctggacggcccccccagagccttcgtgtacatcaacgagtacagagtgggcgagggcatcaccctgaaccaggtggccgtgggctgcgagtgccaggactgcctgtgggcccccaccggcggctgctgccccggcgccagcctgcacaagttcgcctacaacgaccagggccaggtgagactgagagccggcctgcccatctacgagtgcaacagcagatgcagatgcggctacgactgccccaacagagtggtgcagaagggcatcagatacgacctgtgcatcttcagaaccgacgacggcagaggctggggcgtgagaaccctggagaagatcagaaagaacagcttcgtgatggaccccgccctgctgaccgtgtgcctgaagctgcccgccttccccatgggcaaggcctgggagaccgacctgagcgtgaccggcaccctgggcagaggctgcggcagaggcgaggacagactgcaggagagccccttccccgtgcccgcccccagcgtgggctgcacctacaagcccccccccaccttcagaaacagcttcagcaccagcagactgagcgtggtgggcatccacggcctgctgagaagaagcaagggctag

SEQ ID NO: 13084 - DNA, 1230 bp, Artificial Sequence
  Description of Artificial Sequence: Synthetic coding sequence
atggccgagaacctgaagggctgcagcgtgtgctgcaagagcagctggaaccagctgcaggacctgtgcagactggccaagctgagctgccccgccctgggcatcagcaagagaaacctgtacgacttcgaggtggagtacgtgagactgcaggaggaccccagaaccggcatcctgcccggcgagatggcctggatcagcagactgagagagcacctgggcgccaccgccgagagccaggtgtgcgcctacccccaggccgtgccccagggcctgagaaagggcgccgcccccgccgccccccccgtgaaggacccccccgcccccggccccaagctgggccagctgcccggcgccgagggccaggccgaggccggcgcccccagcctgggcgccggcgcccagtgccaggcccacctgggcagaatcaccgtggagaacgaggtggacctggacggcccccccagagccttcgtgtacatcaacgagtacagagtgggcgagggcatcaccctgaaccaggtggccgtgggctgcgagtgccaggactgcctgtgggcccccaccggcggctgctgccccagacactgcaccagcctgcccaccatgaccagagccagatgcggcttcgagcccggctgccccagcaccagcgccacccccgccgccgccgccgccatgaccgcccagatcgtgtggtacagaagagtgagcgacatgaccagcgccagcagcgccagaatgatgggcgtggccggcgccagcgccccctggagaagattcgccagaaccgccagcagctggagcacctgggagagaagcctgccccagagaagacagagcggcggccagatctacgacagacagggcgccacctacctgttcgacctggactacgtggaggacgtgtacaccgtggacgccgcctactacggcaacatcagccacttcgtgaaccacagctgcgaccccaacctgcaggtgtacaacgtgttcatcgacaacctggacgagagactgcccagcctgagcctgccccaggagcccagcggccaggccagaagcagccccctgatcaccacctgcaagtggaccccctggacctggagagcccccgcctggacccccaccctggcctggctgggcagcctggcccccctgagaagcggcagcgtgctgaacgccagcgtgggcctgagccccgccgccaacaccagcagcagcccctag

SEQ ID NO: 13085 - DNA, 555 bp, Artificial Sequence
  Description of Artificial Sequence: Synthetic coding sequence
atggcctggatcagcagactgagagagcacctgggcgccaccgccgagagccaggtgtgcgcctacccccaggccgtgccccagggcctgagaaagggcgccgcccccgccgccccccccgtgaaggacccccccgcccccggccccaagctgggccagctgcccggcgccgagggccaggccgagcccggctgccccagcaccagcgccacccccgccgccgccgccgccatgaccgcccagatcgtgtggtacagaagagtgagcgacatgaccagcgccagcagcgccagaatgatgggcgtggccggcgccagcgccccctggagaagattcgccagaaccgccagcagctggagcacctgggagagaagcctgccccagagaagacagagcggcggcgccagaagcaccaccgtgagagccccccccaccagcctgacctggaccacctggagaacctgcaccccctggatgccccccaccatggccaccagccccaccctgagcaccaccgtggtgacccccacctgcagatgcaccaccagcagctag

SEQ ID NO: 13086 - DNA, 285 bp, Artificial Sequence
  Description of Artificial Sequence: Synthetic coding sequence
atgagagccggcttcagcgacttccagctgatcagagaccaggtgctgttcctgcaggaccaggcccagagactgaccgagtggctgcagctgagcggcttcgagaaccccgtgagcgagagcaccaccctgtgcctgagagagagagagaagagaatccccacctgcgtggccgtgtgcgtgcccagccccggcaccgtgcacaccgccctgctgcaccccaccaccctgagccagagcagaagcagcagcgaggccaagatgctgatcatccacaccgcctag

SEQ ID NO: 13087 - DNA, 594 bp, Artificial Sequence
  Description of Artificial Sequence: Synthetic coding sequence
atggacgtgggcagcaaggaggtgctgatggagagcccccccgactacagcgccgcccccagaggcagattcggcatcccctgctgccccgtgcacctgaagagactgctgatcgtggtggtggtggtggtgctgatcgtggtggtgatcgtgggcgccctgctgatgggcctgcacatgagccagaagcacaccgagatggtgctggagatgagcatcggcgcccccgaggcccagcagagactggccctgagcgagcacctggtgaccaccgccaccttcagcatcggcagcaccggcctggtggtgtacgactaccagcagctgctgatcgcctacaagcccgcccccggcacctgctgctacatcatgaagatcgcccccgagagcatccccagcctggaggccctgaccagaaaggtgcacaacttccagatggagtgcagcctgcaggccaagcccgccgtgcccaccagcaagctgggccaggccgagggcagagacgccggcagcgcccccagcggcggcgaccccgccttcctgggcatggccgtgagcaccctgtgcggcgaggtgcccctgtactacatctag

SEQ ID NO: 13088 - DNA, 576 bp, Artificial Sequence
  Description of Artificial Sequence: Synthetic coding sequence
atggacgtgggcagcaaggaggtgctgatggagagcccccccgactacagcgccgcccccagaggcagattcggcatcccctgctgccccgtgcacctgaagagactgctgatcgtggtggtggtggtggtgctgatcgtggtggtgatcgtgggcgccctgctgatgggcctgcacatgagccagaagcacaccgagatggtgctggagatgagcatcggcgcccccgaggcccagcagagactggccctgagcgagcacctggtgaccaccgccaccttcagcatcggcagcaccggcctggtggtgtacgactaccagcagctgctgatcgcctacaagcccgcccccggcacctgctgctacatcatgaagatcgcccccgagagcatccccagcctggaggccctgaccagaaaggtgcacaacttccaggccaagcccgccgtgcccaccagcaagctgggccaggccgagggcagagacgccggcagcgcccccagcggcggcgaccccgccttcctgggcatggccgtgagcaccctgtgcggcgaggtgcccctgtactacatctag

SEQ ID NO: 13089 - DNA, 1158 bp, Artificial Sequence
  Description of Artificial Sequence: Synthetic coding sequence
atgatgatgatggccctgagcaagaccttcggccagaagcccgtgaagttccagctggaggacgacggcgagttctacatgatcggcagcgaggtgggcaactacctgagaatgttcagaggcagcctgtacaagagataccccagcctgtggagaagactggccaccgtggaggagagaaagaagatcgtggccagcagccacggcaagaagaccaagcccaacaccaaggaccacggctacaccaccctggccaccagcgtgaccctgctgaaggccagcgaggtggaggagatcctggacggcaacgacgagaagtacaaggccgtgagcatcagcaccgagccccccacctacctgagagagcagaaggccaagagaaacagccagtgggtgcccaccctgcccaacagcagccaccacctggacgccgtgccctgcagcaccaccatcaacagaaacagaatgggcagagacaagaagagaaccttccccctgtgcttcgacgaccacgaccccgccgtgatccacgagaacgccagccagcccgaggtgctggtgcccatcagactggacatggagatcgacggccagaagctgagagacgccttcacctggaacatgaacgagaagctgatgacccccgagatgttcagcgagatcctgtgcgacgacctggacctgaaccccctgaccttcgtgcccgccatcgccagcgccatcagacagcagatcgagagctaccccaccgacagcatcctggaggaccagagcgaccagagagtgatcatcaagctgaacatccacgtgggcaacatcagcctggtggaccagttcgagtgggacatgagcgagaaggagaacagccccgagaagttcgccctgaagctgtgcagcgagctgggcctgggcggcgagttcgtgaccaccatcgcctacagcatcagaggccagctgagctggcaccagaagacctacgccttcagcgagaaccccctgcccaccgtggagatcgccatcagaaacaccggcgacgccgaccagtggtgccccctgctggagaccctgaccgacgccgagatggagaagaagatcagagaccaggacagaaacaccagaagaatgagaagactggccaacaccgcccccgcctggtag

SEQ ID NO: 13090 - DNA, 1131 bp, Artificial Sequence
  Description of Artificial Sequence: Synthetic coding sequence
atgatgatgatggccctgagcaagaccttcggccagaagcccgtgaagttccagctggaggacgacggcgagttctacatgatcggcagcgaggtgggcaactacctgagaatgttcagaggcagcctgtacaagagataccccagcctgtggagaagactggccaccgtggaggagagaaagaagatcgtggccagcagccacgaccacggctacaccaccctggccaccagcgtgaccctgctgaaggccagcgaggtggaggagatcctggacggcaacgacgagaagtacaaggccgtgagcatcagcaccgagccccccacctacctgagagagcagaaggccaagagaaacagccagtgggtgcccaccctgcccaacagcagccaccacctggacgccgtgccctgcagcaccaccatcaacagaaacagaatgggcagagacaagaagagaaccttccccctgtgcttcgacgaccacgaccccgccgtgatccacgagaacgccagccagcccgaggtgctggtgcccatcagactggacatggagatcgacggccagaagctgagagacgccttcacctggaacatgaacgagaagctgatgacccccgagatgttcagcgagatcctgtgcgacgacctggacctgaaccccctgaccttcgtgcccgccatcgccagcgccatcagacagcagatcgagagctaccccaccgacagcatcctggaggaccagagcgaccagagagtgatcatcaagctgaacatccacgtgggcaacatcagcctggtggaccagttcgagtgggacatgagcgagaaggagaacagccccgagaagttcgccctgaagctgtgcagcgagctgggcctgggcggcgagttcgtgaccaccatcgcctacagcatcagaggccagctgagctggcaccagaagacctacgccttcagcgagaaccccctgcccaccgtggagatcgccatcagaaacaccggcgacgccgaccagtggtgccccctgctggagaccctgaccgacgccgagatggagaagaagatcagagaccaggacagaaacaccagaagaatgagaagactggccaacaccgcccccgcctggtag

SEQ ID NO: 13091 - DNA, 81 bp, Artificial Sequence
  Description of Artificial Sequence: Synthetic coding sequence
tggagaagactggccaccgtggaggagagaaagaagatcgtggccagcagccacgccctgatgaccatgacccagctgtag

SEQ ID NO: 13092 - DNA, 7626 bp, Artificial Sequence
  Description of Artificial Sequence: Synthetic coding sequence
atggtggccctgagcctgaagatcagcatcggcaacgtggtgaagaccatgcagttcgagcccagcaccatggtgtacgacgcctgcagaatcatcagagagagaatccccgaggcccccgccggcccccccagcgacttcggcctgttcctgagcgacgacgaccccaagaagggcatctggctggaggccggcaaggccctggactactacatgctgagaaacggcgacaccatggagtacagaaagaagcagagacccctgaagatcagaatgctggacggcaccgtgaagaccatcatggtggacgacagcaagaccgtgaccgacatgctgatgaccatctgcgccagaatcggcatcaccaaccacgacgagtacagcctggtgagagagctgatggaggagaagaaggaggagatcaccggcaccctgagaaaggacaagaccctgctgagagacgagaagaagatggagaagctgaagcagaagctgcacaccgacgacgagctgaactggctggaccacggcagaaccctgagagagcagggcgtggaggagcacgagaccctgctgctgagaagaaagttcttctacagcgaccagaacgtggacagcagagaccccgtgcagctgaacctgctgtacgtgcaggccagagacgacatcctgaacggcagccaccccgtgagcttcgacaaggcctgcgagttcgccggcttccagtgccagatccagttcggcccccacaacgagcagaagcacaaggccggcttcctggacctgaaggacttcctgcccaaggagtacgtgaagcagaagggcgagagaaagatcttccaggcccacaagaactgcggccagatgagcgagatcgaggccaaggtgagatacgtgaagctggccagaagcctgaagacctacggcgtgagcttcttcctggtgaaggagaagatgaagggcaagaacaagctggtgcccagactgctgggcatcaccaaggagtgcgtgatgagagtggacgagaagaccaaggaggtgatccaggagtggaacctgaccaacatcaagagatgggccgccagccccaagagcttcaccctggacttcggcgactaccaggacggctactacagcgtgcagaccaccgagggcgagcagatcgcccagctgatcgccggctacatcgacatcatcctgaagaagaagaagagcaaggaccacttcggcctggagggcgacgaggagagcaccatgctggaggacagcgtgagccccaagaagagcaccgtgctgcagcagcagtacaacagagtgggcaaggtggagcacggcagcgtggccctgcccgccatcatgagaagcggcgccagcggccccgagaacttccaggtgggcagcatgccccccgcccagcagcagatcaccagcggccagatgcacagaggccacatgccccccctgaccagcgcccagcaggccctgaccggcaccatcaacagcagcatgcaggccgtgcaggccgcccaggccaccctggacgacttcgacaccctgccccccctgggccaggacgccgccagcaaggcctggagaaagaacaagatggacgagagcaagcacgagatccacagccaggtggacgccatcaccgccggcaccgccagcgtggtgaacctgaccgccggcgaccccgccgagaccgactacaccgccgtgggctgcgccgtgaccaccatcagcagcaacctgaccgagatgagcagaggcgtgaagctgctggccgccctgctggaggacgagggcggcagcggcagacccctgctgcaggccgccaagggcctggccggcgccgtgagcgagctgctgagaagcgcccagcccgccagcgccgagcccagacagaacctgctgcaggccgccggcaacgtgggccaggccagcggcgagctgctgcagcagatcggcgagagcgacaccgacccccacttccaggacgccctgatgcagctggccaaggccgtggccagcgccgccgccgccctggtgctgaaggccaagagcgtggcccagagaaccgaggacagcggcctgcagacccaggtgatcgccgccgccacccagtgcgccctgagcaccagccagctggtggcctgcaccaaggtggtggcccccaccatcagcagccccgtgtgccaggagcagctggtggaggccggcagactggtggccaaggccgtggagggctgcgtgagcgccagccaggccgccaccgaggacggccagctgctgagaggcgtgggcgccgccgccaccgccgtgacccaggccctgaacgagctgctgcagcacgtgaaggcccacgccaccggcgccggccccgccggcagatacgaccaggccaccgacaccatcctgaccgtgaccgagaacatcttcagcagcatgggcgacgccggcgagatggtgagacaggccagaatcctggcccaggccaccagcgacctggtgaacgccatcaaggccgacgccgagggcgagagcgacctggagaacagcagaaagctgctgagcgccgccaagatcctggccgacgccaccgccaagatggtggaggccgccaagggcgccgccgcccaccccgacagcgaggagcagcagcagagactgagagaggccgccgagggcctgagaatggccaccaacgccgccgcccagaacgccatcaagaagaagctggtgcagagactggagcacgccgccaagcaggccgccgccagcgccacccagaccatcgccgccgcccagcacgccgccagcacccccaaggccagcgccggcccccagcccctgctggtgcagagctgcaaggccgtggccgagcagatccccctgctggtgcagggcgtgagaggcagccaggcccagcccgacagccccagcgcccagctggccctgatcgccgccagccagagcttcctgcagcccggcggcaagatggtggccgccgccaaggccagcgtgcccaccatccaggaccaggccagcgccatgcagctgagccagtgcgccaagaacctgggcaccgccctggccgagctgagaaccgccgcccagaaggcccaggaggcctgcggccccctggagatggacagcgccctgagcgtggtgcagaacctggagaaggacctgcaggaggtgaaggccgccgccagagacggcaagctgaagcccctgcccggcgagaccatggagaagtgcacccaggacctgggcaacagcaccaaggccgtgagcagcgccatcgcccagctgctgggcgaggtggcccagggcaacgagaactacgccggcatcgccgccagagacgtggccggcggcctgagaagcctggcccaggccgccagaggcgtggccgccctgaccagcgaccccgccgtgcaggccatcgtgctggacaccgccagcgacgtgctggacaaggccagcagcctgatcgaggaggccaagaaggccgccggccaccccggcgaccccgagagccagcagagactggcccaggtggccaaggccgtgacccaggccctgaacagatgcgtgagctgcctgcccggccagagagacgtggacaacgccctgagagccgtgggcgacgccagcaagagactgctgagcgacagcctgccccccagcaccggcaccttccaggaggcccagagcagactgaacgaggccgccgccggcctgaaccaggccgccaccgagctggtgcaggccagcagaggcaccccccaggacctggccagagccagcggcagattcggccaggacttcagcaccttcctggaggccggcgtggagatggccggccaggcccccagccaggaggacagagcccaggtggtgagcaacctgaagggcatcagcatgagcagcagcaagctgctgctggccgccaaggccctgagcaccgaccccgccgcccccaacctgaagagccagctggccgccgccgccagagccgtgaccgacagcatcaaccagctgatcaccatgtgcacccagcaggcccccggccagaaggagtgcgacaacgccctgagagagctggagaccgtgagagagctgctggagaaccccgtgcagcccatcaacgacatgagctacttcggctgcctggacagcgtgatggagaacagcaaggtgctgggcgaggccatgaccggcatcagccagaacgccaagaacggcaacctgcccgagttcggcgacgccatcagcaccgccagcaaggccctgtgcggcttcaccgaggccgccgcccaggccgcctacctggtgggcgtgagcgaccccaacagccaggccggccagcagggcctggtggagcccacccagttcgccagagccaaccaggccatccagatggcctgccagagcctgggcgagcccggctgcacccaggcccaggtgctgagcgccgccaccatcgtggccaagcacaccagcgccctgtgcaacagctgcagactggccagcgccagaaccaccaaccccaccgccaagagacagttcgtgcagagcgccaaggaggtggccaacagcaccgccaacctggtgaagaccatcaaggccctggacggcgccttcaccgaggagaacagagcccagtgcagagccgccaccgcccccctgctggaggccgtggacaacctgagcgccttcgccagcaaccccgagttcagcagcatccccgcccagatcagccccgagggcagagccgccatggagcccatcgtgatcagcgccaagaccatgctggagagcgccggcggcctgatccagaccgccagagccctggccgtgaaccccagagacccccccagctggagcgtgctggccggccacagcagaaccgtgagcgacagcatcaagaagctgatcaccagcatgagagacaaggcccccggccagctggagtgcgagaccgccatcgccgccctgaacagctgcctgagagacctggaccaggccagcctggccgccgtgagccagcagctggcccccagagagggcatcagccaggaggccctgcacacccagatgctgaccgccgtgcaggagatcagccacctgatcgagcccctggccaacgccgccagagccgaggccagccagctgggccacaaggtgagccagatggcccagtacttcgagcccctgaccctggccgccgtgggcgccgccagcaagaccctgagccacccccagcagatggccctgctggaccagaccaagaccctggccgagagcgccctgcagctgctgtacaccgccaaggaggccggcggcaaccccaagcaggccgcccacacccaggaggccctggaggaggccgtgcagatgatgaccgaggccgtggaggacctgaccaccaccctgaacgaggccgccagcgccgccggcgtggtgggcggcatggtggacagcatcacccaggccatcaaccagctggacgagggccccatgggcgagcccgagggcagcttcgtggactaccagaccaccatggtgagaaccgccaaggccatcgccgtgaccgtgcaggagatggtgaccaagagcaacaccagccccgaggagctgggccccctggccaaccagctgaccagcgactacggcagactggccagcgaggccaagcccgccgccgtggccgccgagaacgaggagatcggcagccacatcaagcacagagtgcaggagctgggccacggctgcgccgccctggtgaccaaggccggcgccctgcagtgcagccccagcgacgcctacaccaagaaggagctgatcgagtgcgccagaagagtgagcgagaaggtgagccacgtgctggccgccctgcaggccggcaacagaggcacccaggcctgcatcaccgccgccagcgccgtgagcggcatcatcgccgacctggacaccaccatcatgttcgccaccgccggcaccctgaacagagagggcaccgagaccttcgccgaccacagagagggcatcctgaagaccgccaaggtgctggtggaggacaccaaggtgctggtgcagaacgccgccggcagccaggagaagctggcccaggccgcccagagcagcgtggccaccatcaccagactggccgacgtggtgaagctgggcgccgccagcctgggcgccgaggaccccgagacccaggtggtgctgatcaacgccgtgaaggacgtggccaaggccctgggcgacctgatcagcgccaccaaggccgccgccggcaaggtgggcgacgaccccgccgtgtggcagctgaagaacagcgccaaggtgatggtgaccaacgtgaccagcctgctgaagaccgtgaaggccgtggaggacgaggccaccaagggcaccagagccctggaggccaccaccgagcacatcagacaggagctggccgtgttctgcagccccgagccccccgccaagaccagcacccccgaggacttcatcagaatgaccaagggcatcaccatggccaccgccaaggccgtggccgccggcaacagctgcagacaggaggacgtgatcgccaccgccaacctgagcagaagagccatcgccgacatgctgagagcctgcaaggaggccgcctaccaccccgaggtggcccccgacgtgagactgagagccctgcactacggcagagagtgcgccaacggctacctggagctgctggaccacgtgctgctgaccctgcagaagcccagccccgagctgaagcagcagctgaccggccacagcaagagagtggccggcagcgtgaccgagctgatccaggccgccgaggccatgaagggcaccgagtgggtggaccccgaggaccccaccgtgatcgccgagaacgagctgctgggcgccgccgccgccatcgaggccgccgccaagaagctggagcagctgaagcccagagccaagcccaaggaggccgacgagagcctgaacttcgaggagcagatcctggaggccgccaagagcatcgccgccgccaccagcgccctggtgaaggccgccagcgccgcccagagagagctggtggcccagggcaaggtgggcgccatccccgccaacgccctggacgacggccagtggagccagggcctgatcagcgccgccagaatggtggccgccgccaccaacaacctgtgcgaggccgccaacgccgccgtgcagggccacgccagccaggagaagctgatcagcagcgccaagcaggtggccgccagcaccgcccagctgctggtggcctgcaaggtgaaggccgaccaggacagcgaggccatgaagagactgcaggccgccggcaacgccgtgaagagagccagcgacaacctggtgaaggccgcccagaaggccgccgccttcgaggagcaggagaacgagaccgtggtggtgaaggagaagatggtgggcggcatcgcccagatcatcgccgcccaggaggagatgctgagaaaggagagagagctggaggaggccagaaagaagctggcccagatcagacagcagcagtacaagttcctgcccagcgagctgagagacgagcactag

SEQ ID NO: 13093 - DNA, 7290 bp, Artificial Sequence
  Description of Artificial Sequence: Synthetic coding sequence
atggtggccctgagcctgaagatcagcatcggcaacgtggtgaagaccatgcagttcgagcccagcaccatggtgtacgacgcctgcagaatcatcagagagagaatccccgaggcccccgccggcccccccagcgacttcggcctgttcctgagcgacgacgaccccaagaagggcatctggctggaggccggcaaggccctggactactacatgctgagaaacggcgacaccatggagtacagaaagaagcagagacccctgaagatcagaatgctggacggcaccgtgaagaccatcatggtggacgacagcaagaccgtgaccgacatgctgatgaccatctgcgccagaatcggcatcaccaaccacgacgagtacagcctggtgagagagctgatggaggagaagaaggaggagatcaccggcaccctgagaaaggacaagaccctgctgagagacgagaagaagatggagaagctgaagcagaagctgcacaccgacgacgagctgaactggctggaccacggcagaaccctgagagagcagggcgtggaggagcacgagaccctgctgctgagaagaaagttcttctacagcgaccagaacgtggacagcagagaccccgtgcagctgaacctgctgtacgtgcaggccagagacgacatcctgaacggcagccaccccgtgagcttcgacaaggcctgcgagttcgccggcttccagtgccagatccagttcggcccccacaacgagcagaagcacaaggccggcttcctggacctgaaggacttcctgcccaaggagtacgtgaagcagaagggcgagagaaagatcttccaggcccacaagaactgcggccagatgagcgagatcgaggccaaggtgagatacgtgaagctggccagaagcctgaagacctacggcgtgagcttcttcctggtgaaggagaagatgaagggcaagaacaagctggtgcccagactgctgggcatcaccaaggagtgcgtgatgagagtggacgagaagaccaaggaggtgatccaggagtggaacctgaccaacatcaagagatgggccgccagccccaagagcttcaccctggacttcggcgactaccaggacggctactacagcgtgcagaccaccgagggcgagcagatcgcccagctgatcgccggctacatcgacatcatcctgaagaagaagaagagcaaggaccacttcggcctggagggcgacgaggagagcaccatgctggaggacagcgtgagccccaagaagagcaccgtgctgcagcagcagtacaacagagtgggcaaggtggagcacggcagcgtggccctgcccgccatcatgagaagcggcgccagcggccccgagaacttccaggtgggcagcatgccccccgcccagcagcagatcaccagcggccagatgcacagaggccacatgccccccctgaccagcgcccagcaggccctgaccggcaccatcaacagcagcatgcaggccgtgcaggccgcccaggccaccctggacgacttcgacaccctgccccccctgggccaggacgccgccagcaaggcctggagaaagaacaagatggacgagagcaagcacgagatccacagccaggtggacgccatcaccgccggcaccgccagcgtggtgaacctgaccgccggcgaccccgccgagaccgactacaccgccgtgggctgcgccgtgaccaccatcagcagcaacctgaccgagatgagcagaggcgtgaagctgctggccgccctgctggaggacgagggcggcagcggcagacccctgctgcaggccgccaagggcctggccggcgccgtgagcgagctgctgagaagcgcccagcccgccagcgccgagcccagacagaacctgctgcaggccgccggcaacgtgggccaggccagcggcgagctgctgcagcagatcggcgagagcgacaccgacccccacttccaggacgccctgatgcagctggccaaggccgtggccagcgccgccgccgccctggtgctgaaggccaagagcgtggcccagagaaccgaggacagcggcctgcagacccaggtgatcgccgccgccacccagtgcgccctgagcaccagccagctggtggcctgcaccaaggtggtggcccccaccatcagcagccccgtgtgccaggagcagctggtggaggccggcagactggtggccaaggccgtggagggctgcgtgagcgccagccaggccgccaccgaggacggccagctgctgagaggcgtgggcgccgccgccaccgccgtgacccaggccctgaacgagctgctgcagcacgtgaaggcccacgccaccggcgccggccccgccggcagatacgaccaggccaccgacaccatcctgaccgtgaccgagaacatcttcagcagcatgggcgacgccggcgagatggtgagacaggccagaatcctggcccaggccaccagcgacctggtgaacgccatcaaggccgacgccgagggcgagagcgacctggagaacagcagaaagctgctgagcgccgccaagatcctggccgacgccaccgccaagatggtggaggccgccaagggcgccgccgcccaccccgacagcgaggagcagcagcagagactgagagaggccgccgagggcctgagaatggccaccaacgccgccgcccagaacgccatcaagaagaagctggtgcagagactggagcacgccgccaagcaggccgccgccagcgccacccagaccatcgccgccgcccagcacgccgccagcacccccaaggccagcgccggcccccagcccctgctggtgcagagctgcaaggccgtggccgagcagatccccctgctggtgcagggcgtgagaggcagccaggcccagcccgacagccccagcgcccagctggccctgatcgccgccagccagagcttcctgcagcccggcggcaagatggtggccgccgccaaggccagcgtgcccaccatccaggaccaggccagcgccatgcagctgagccagtgcgccaagaacctgggcaccgccctggccgagctgagaaccgccgcccagaaggcccaggaggcctgcggccccctggagatggacagcgccctgagcgtggtgcagaacctggagaaggacctgcaggaggtgaaggccgccgccagagacggcaagctgaagcccctgcccggcgagaccatggagaagtgcacccaggacctgggcaacagcaccaaggccgtgagcagcgccatcgcccagctgctgggcgaggtggcccagggcaacgagaactacgccggcatcgccgccagagacgtggccggcggcctgagaagcctggcccaggccgccagaggcgtggccgccctgaccagcgaccccgccgtgcaggccatcgtgctggacaccgccagcgacgtgctggacaaggccagcagcctgatcgaggaggccaagaaggccgccggccaccccggcgaccccgagagccagcagagactggcccaggtggccaaggccgtgacccaggccctgaacagatgcgtgagctgcctgcccggccagagagacgtggacaacgccctgagagccgtgggcgacgccagcaagagactgctgagcgacagcctgccccccagcaccggcaccttccaggaggcccagagcagactgaacgaggccgccgccggcctgaaccaggccgccaccgagctggtgcaggccagcagaggcaccccccaggacctggccagagccagcggcagattcggccaggacttcagcaccttcctggaggccggcgtggagatggccggccaggcccccagccaggaggacagagcccaggtggtgagcaacctgaagggcatcagcatgagcagcagcaagctgctgctggccgccaaggccctgagcaccgaccccgccgcccccaacctgaagagccagctggccgccgccgccagagccgtgaccgacagcatcaaccagctgatcaccatgtgcacccagcaggcccccggccagaaggagtgcgacaacgccctgagagagctggagaccgtgagagagctgctggagaaccccgtgcagcccatcaacgacatgagctacttcggctgcctggacagcgtgatggagaacagcaaggtgctgggcgaggccatgaccggcatcagccagaacgccaagaacggcaacctgcccgagttcggcgacgccatcagcaccgccagcaaggccctgtgcggcttcaccgaggccgccgcccaggccgcctacctggtgggcgtgagcgaccccaacagccaggccggccagcagggcctggtggagcccacccagttcgccagagccaaccaggccatccagatggcctgccagagcctgggcgagcccggctgcacccaggcccaggtgctgagcgccgccaccatcgtggccaagcacaccagcgccctgtgcaacagctgcagactggccagcgccagaaccaccaaccccaccgccaagagacagttcgtgcagagcgccaaggaggtggccaacagcaccgccaacctggtgaagaccatcaaggccctggacggcgccttcaccgaggagaacagagcccagtgcagagccgccaccgcccccctgctggaggccgtggacaacctgagcgccttcgccagcaaccccgagttcagcagcatccccgcccagatcagccccgagggcagagccgccatggagcccatcgtgatcagcgccaagaccatgctggagagcgccggcggcctgatccagaccgccagagccctggccgtgaaccccagagacccccccagctggagcgtgctggccggccacagcagaaccgtgagcgacagcatcaagaagctgatcaccagcatgagagacaaggcccccggccagctggagtgcgagaccgccatcgccgccctgaacagctgcctgagagacctggaccaggccagcctggccgccgtgagccagcagctggcccccctgcaggagatcagccacctgatcgagcccctggccaacgccgccagagccgaggccagccagctgggccacaaggtgagccagatggcccagtacttcgagcccctgaccctggccgccgtgggcgccgccagcaagaccctgagccacccccagcagatggccctgctggaccagaccaagaccctggccgagagcgccctgcagctgctgtacaccgccaaggaggccggcggcaaccccaagctggacgagggccccatgggcgagcccgagggcagcttcgtggactaccagaccaccatggtgagaaccgccaaggccatcgccgtgaccgtgcaggagatgatcggcagccacatcaagcacagagtgcaggagctgggccacggctgcgccgccctggtgaccaaggccggcgccctgcagtgcagccccagcgacgcctacaccaagaaggagctgatcgagtgcgccagaagagtgagcgagaaggtgagccacgtgctggccgccctgcaggccggcaacagaggcacccaggcctgcatcaccgccgccagcgccgtgagcggcatcatcgccgacctggacaccaccatcatgttcgccaccgccggcaccctgaacagagagggcaccgagaccttcgccgaccacagagagggcatcctgaagaccgccaaggtgctggtggaggacaccaaggtgctggtgcagaacgccgccggcagccaggagaagctggcccaggccgcccagagcagcgtggccaccatcaccagactggccgacgtggtgaagctgggcgccgccagcctgggcgccgaggaccccgagacccaggtggtgctgatcaacgccgtgaaggacgtggccaaggccctgggcgacctgatcagcgccaccaaggccgccgccggcaaggtgggcgacgaccccgccgtgtggcagctgaagaacagcgccaaggtgatggtgaccaacgtgaccagcctgctgaagaccgtgaaggccgtggaggacgaggccaccaagggcaccagagccctggaggccaccaccgagcacatcagacaggagctggccccccccgccaagaccagcacccccgaggacttcatcagaatgaccaagggcatcaccatggccaccgccaaggccgtggccgccggcaacagctgcagacaggaggacgtgatcgccaccgccaacctgagcagaagagccatcgccgacatgctgagagcctgcaaggaggccgcctaccaccccgaggtggcccccgacgtgagactgagagccctgcactacggcagagagtgcgccaacggctacctggagctgctggaccacgtgctgctgaccctgcagaagcccagccccgagctgaagcagcagctgaccggccacagcaagagagtggccggcagcgtgaccgagctgatccaggccgccgaggccatgaagggcaccgagtgggtggaccccgaggaccccaccgtgatcgccgagaacgagctgctgggcgccgccgccgccatcgaggccgccgccaagaagctggagcagctgaagcccagagccaagcccaaggaggccgacgagagcctgaacttcgaggagcagatcctggaggccgccaagagcatcgccgccgccaccagcgccctggtgaaggccgccagcgccgcccagagagagctggtggcccagggcaaggtgggcgccatccccgccaacgccctggacgacggccagtggagccagggcctgatcagcgccgccagaatggtggccgccgccaccaacaacctgtgcgaggccgccaacgccgccgtgcagggccacgccagccaggagaagctgatcagcagcgccaagcaggtggccgccagcaccgcccagctgctggtggcctgcaaggtgaaggccgaccaggacagcgaggccatgaagagactgcaggccgccggcaacgccgtgaagagagccagcgacaacctggtgaaggccgcccagaaggccgccgccttcgaggagcaggagaacgagaccgtggtggtgaaggagaagatggtgggcggcatcgcccagatcatcgccgcccaggaggagatgctgagaaaggagagagagctggaggaggccagaaagaagctggcccagatcagacagcagcagtacaagttcctgcccagcgagctgagagacgagcactag

SEQ ID NO: 13094 - DNA, 3984 bp, Artificial Sequence
  Description of Artificial Sequence: Synthetic coding sequence
atggccgccagcagaagaagccagcaccaccaccaccaccaccagcagcagctgcagcccgcccccggcgccagcgccccccccccccccccccccccccccctgagccccggcctggcccccggcaccacccccgccagccccaccgccagcggcctggcccccttcgccagccccagacacggcctggccctgcccgagggcgacggcagcagagacccccccgacagacccagaagccccgaccccgtggacggcaccagctgctgcagcaccaccagcaccatctgcaccgtggccgccgcccccgtggtgcccgccgtgagcaccagcagcgccgccggcgtggcccccaaccccgccggcagcggcagcaacaacagccccagcagcagcagcagccccaccagcagcagcagcagcagccccagcagccccggcagcagcctggccgagagccccgaggccgccggcgtgagcagcaccgcccccctgggccccggcgccgccggccccggcaccggcgtgcccgccgtgagcggcgccctgagagagctgctggaggcctgcagaaacggcgacgtgagcagagtgaagagactggtggacgccgccaacgtgaacgccaaggacatggccggcagaaagagcagccccctgcacttcgccgccggcttcggcagaaaggacgtggtggagcacctgctgcagatgggcgccaacgtgcacgccagagacgacggcggcctgatccccctgcacaacgcctgcagcttcggccacgccgaggtggtgagcctgctgctgtgccagggcgccgaccccaacgccagagacaactggaactacacccccctgcacgaggccgccatcaagggcaagatcgacgtgtgcatcgtgctgctgcagcacggcgccgaccccaacatcagaaacaccgacggcaagagcgccctggacctggccgaccccagcgccaaggccgtgctgaccggcgagtacaagaaggacgagctgctggaggccgccagaagcggcaacgaggagaagctgatggccctgctgacccccctgaacgtgaactgccacgccagcgacggcagaaagagcacccccctgcacctggccgccggctacaacagagtgagaatcgtgcagctgctgctgcagcacggcgccgacgtgcacgccaaggacaagggcggcctggtgcccctgcacaacgcctgcagctacggccactacgaggtgaccgagctgctgctgaagcacggcgcctgcgtgaacgccatggacctgtggcagttcacccccctgcacgaggccgccagcaagaacagagtggaggtgtgcagcctgctgctgagccacggcgccgaccccaccctggtgaactgccacggcaagagcgccgtggacatggcccccacccccgagctgagagagagactgacctacgagttcaagggccacagcctgctgcaggccgccagagaggccgacctggccaaggtgaagaagaccctggccctggagatcatcaacttcaagcagccccagagccacgagaccgccctgcactgcgccgtggccagcctgcaccccaagagaaagcaggtgaccgagctgctgctgagaaagggcgccaacgtgaacgagaagaacaaggacttcatgacccccctgcacgtggccgccgagagagcccacaacgacgtgatggaggtgctgcacaagcacggcgccaagatgaacgccctggacaccctgggccagaccgccctgcacagagccgccctggccggccacctgcagacctgcagactgctgctgagctacggcagcgaccccagcatcatcagcctgcagggcttcaccgccgcccagatgggcaacgaggccgtgcagcagatcctgagcgagagcacccccatcagaaccagcgacgtggactacagactgctggaggccagcaaggccggcgacctggagaccgtgaagcagctgtgcagcagccagaacgtgaactgcagagacctggagggcagacacagcacccccctgcacttcgccgccggctacaacagagtgagcgtggtggagtacctgctgcaccacggcgccgacgtgcacgccaaggacaagggcggcctggtgcccctgcacaacgcctgcagctacggccactacgaggtggccgagctgctggtgagacacggcgccagcgtgaacgtggccgacctgtggaagttcacccccctgcacgaggccgccgccaagggcaagtacgagatctgcaagctgctgctgaagcacggcgccgaccccaccaagaagaacagagacggcaacacccccctggacctggtgaaggagggcgacaccgacatccaggacctgctgagaggcgacgccgccctgctggacgccgccaagaagggctgcctggccagagtgcagaagctgtgcacccccgagaacatcaactgcagagacacccagggcagaaacagcacccccctgcacctggccgccggctacaacaacctggaggtggccgagtacctgctggagcacggcgccgacgtgaacgcccaggacaagggcggcctgatccccctgcacaacgccgccagctacggccacgtggacatcgccgccctgctgatcaagtacaacacctgcgtgaacgccaccgacaagtgggccttcacccccctgcacgaggccgcccagaagggcagaacccagctgtgcgccctgctgctggcccacggcgccgaccccaccatgaagaaccaggagggccagacccccctggacctggccaccgccgacgacatcagagccctgctgatcgacgccatgccccccgaggccctgcccacctgcttcaagccccaggccaccgtggtgagcgccagcctgatcagccccgccagcacccccagctgcctgagcgccgccagcagcatcgacaacctgaccggccccctggccgagctggccgtgggcggcgccagcaacgccggcgacggcgccgccggcaccgagagaaaggagggcgaggtggccggcctggacatgaacatcagccagttcctgaagagcctgggcctggagcacctgagagacatcttcgagaccgagcagatcaccctggacgtgctggccgacatgggccacgaggagctgaaggagatcggcatcaacgcctacggccacagacacaagctgatcaagggcgtggagagactgctgggcggccagcagggcaccaacccctacctgaccttccactgcgtgaaccagggcaccatcctgctggacctggcccccgaggacaaggagtaccagagcgtggaggaggagatgcagagcaccatcagagagcacagagacggcggcaacgccggcggcatcttcaacagatacaacgtgatcagaatccagaaggtggtgaacaagaagctgagagagagattctgccacagacagaaggaggtgagcgaggagaaccacaaccaccacaacgagagaatgctgttccacggcagccccttcatcaacgccatcatccacaagggcttcgacgagagacacgcctacatcggcggcatgttcggcgccggcatctacttcgccgagaacagcagcaagagcaaccagtacgtgtacggcatcggcggcggcaccggctgccccacccacaaggacagaagctgctacatctgccacagacagatgctgttctgcagagtgaccctgggcaagagcttcctgcagttcagcaccatgaagatggcccacgccccccccggccaccacagcgtgatcggcagacccagcgtgaacggcctggcctacgccgagtacgtgatctacagaggcgagcaggcctaccccgagtacctgatcacctaccagatcatgaagcccgaggcccccagccagaccgccaccgccgccgagcagaagacctag

SEQ ID NO: 13095 - DNA, 3501 bp, Artificial Sequence
  Description of Artificial Sequence: Synthetic coding sequence
atgagcggcagaagatgcgccggcggcggcgccgcctgcgccagcgccgccgccgaggccgtggagcccgccgccagagagctgttcgaggcctgcagaaacggcgacgtggagagagtgaagagactggtgacccccgagaaggtgaacagcagagacaccgccggcagaaagagcacccccctgcacttcgccgccggcttcggcagaaaggacgtggtggagtacctgctgcagaacggcgccaacgtgcaggccagagacgacggcggcctgatccccctgcacaacgcctgcagcttcggccacgccgaggtggtgaacctgctgctgagacacggcgccgaccccaacgccagagacaactggaactacacccccctgcacgaggccgccatcaagggcaagatcgacgtgtgcatcgtgctgctgcagcacggcgccgagcccaccatcagaaacaccgacggcagaaccgccctggacctggccgaccccagcgccaaggccgtgctgaccggcgagtacaagaaggacgagctgctggagagcgccagaagcggcaacgaggagaagatgatggccctgctgacccccctgaacgtgaactgccacgccagcgacggcagaaagagcacccccctgcacctggccgccggctacaacagagtgaagatcgtgcagctgctgctgcagcacggcgccgacgtgcacgccaaggacaagggcgacctggtgcccctgcacaacgcctgcagctacggccactacgaggtgaccgagctgctggtgaagcacggcgcctgcgtgaacgccatggacctgtggcagttcacccccctgcacgaggccgccagcaagaacagagtggaggtgtgcagcctgctgctgagctacggcgccgaccccaccctgctgaactgccacaacaagagcgccatcgacctggcccccaccccccagctgaaggagagactggcctacgagttcaagggccacagcctgctgcaggccgccagagaggccgacgtgaccagaatcaagaagcacctgagcctggagatggtgaacttcaagcacccccagacccacgagaccgccctgcactgcgccgccgccagcccctaccccaagagaaagcagatctgcgagctgctgctgagaaagggcgccaacatcaacgagaagaccaaggagttcctgacccccctgcacgtggccagcgagaaggcccacaacgacgtggtggaggtggtggtgaagcacgaggccaaggtgaacgccctggacaacctgggccagaccagcctgcacagagccgcctactgcggccacctgcagacctgcagactgctgctgagctacggctgcgaccccaacatcatcagcctgcagggcttcaccgccctgcagatgggcaacgagaacgtgcagcagctgctgcaggagggcatcagcctgggcaacagcgaggccgacagacagctgctggaggccgccaaggccggcgacgtggagaccgtgaagaagctgtgcaccgtgcagagcgtgaactgcagagacatcgagggcagacagagcacccccctgcacttcgccgccggctacaacagagtgagcgtggtggagtacctgctgcagcacggcgccgacgtgcacgccaaggacaagggcggcctggtgcccctgcacaacgcctgcagctacggccactacgaggtggccgagctgctggtgaagcacggcgccgtggtgaacgtggccgacctgtggaagttcacccccctgcacgaggccgccgccaagggcaagtacgagatctgcaagctgctgctgcagcacggcgccgaccccaccaagaagaacagagacggcaacacccccctggacctggtgaaggacggcgacaccgacatccaggacctgctgagaggcgacgccgccctgctggacgccgccaagaagggctgcctggccagagtgaagaagctgagcagccccgacaacgtgaactgcagagacacccagggcagacacagcacccccctgcacctggccgccggctacaacaacctggaggtggccgagtacctgctgcagcacggcgccgacgtgaacgcccaggacaagggcggcctgatccccctgcacaacgccgccagctacggccacgtggacgtggccgccctgctgatcaagtacaacgcctgcgtgaacgccaccgacaagtgggccttcacccccctgcacgaggccgcccagaagggcagaacccagctgtgcgccctgctgctggcccacggcgccgaccccaccctgaagaaccaggagggccagacccccctggacctggtgagcgccgacgacgtgagcgccctgctgaccgccgccatgccccccagcgccctgcccagctgctacaagccccaggtgctgaacggcgtgagaagccccggcgccaccgccgacgccctgagcagcggccccagcagccccagcagcctgagcgccgccagcagcctggacaacctgagcggcagcttcagcgagctgagcagcgtggtgagcagcagcggcaccgagggcgccagcagcctggagaagaaggaggtgcccggcgtggacttcagcatcacccagttcgtgagaaacctgggcctggagcacctgatggacatcttcgagagagagcagatcaccctggacgtgctggtggagatgggccacaaggagctgaaggagatcggcatcaacgcctacggccacagacacaagctgatcaagggcgtggagagactgatcagcggccagcagggcctgaacccctacctgaccctgaacaccagcggcagcggcaccatcctgatcgacctgagccccgacgacaaggagttccagagcgtggaggaggagatgcagagcaccgtgagagagcacagagacggcggccacgccggcggcatcttcaacagatacaacatcctgaagatccagaaggtgtgcaacaagaagctgtgggagagatacacccacagaagaaaggaggtgagcgaggagaaccacaaccacgccaacgagagaatgctgttccacggcagccccttcgtgaacgccatcatccacaagggcttcgacgagagacacgcctacatcggcggcatgttcggcgccggcatctacttcgccgagaacagcagcaagagcaaccagtacgtgtacggcatcggcggcggcaccggctgccccgtgcacaaggacagaagctgctacatctgccacagacagctgctgttctgcagagtgaccctgggcaagagcttcctgcagttcagcgccatgaagatggcccacagcccccccggccaccacagcgtgaccggcagacccagcgtgaacggcctggccctggccgagtacgtgatctacagaggcgagcaggcctaccccgagtacctgatcacctaccagatcatgagacccgagggcatggtggacggctag

SEQ ID NO: 13096 - DNA, 2139 bp, Artificial Sequence
  Description of Artificial Sequence: Synthetic coding sequence
atgagagagcccgccctggccgccagcgccatggcctaccaccccttccacgcccccagacccgccgacttccccatgagcgccttcctggccgccgcccagcccagcttcttccccgccctggccctgccccccggcgccctggccaagcccctgcccgaccccggcctggccggcgccgccgccgccgccgccgccgccgccgccgccgccgaggccggcctgcacgtgagcgccctgggcccccacccccccgccgcccacctgagaagcctgaagagcctggagcccgaggacgaggtggaggacgaccccaaggtgaccctggaggccaaggagctgtgggaccagttccacaagctgggcaccgagatggtgatcaccaagagcggcagaagaatgttcccccccttcaaggtgagagtgagcggcctggacaagaaggccaagtacatcctgctgatggacatcgtggccgccgacgactgcagatacaagttccacaacagcagatggatggtggccggcaaggccgaccccgagatgcccaagagaatgtacatccaccccgacagccccgccaccggcgagcagtggatggccaagcccgtggccttccacaagctgaagctgaccaacaacatcagcgacaagcacggcttcaccatcctgaacagcatgcacaagtaccagcccagattccacatcgtgagagccaacgacatcctgaagctgccctacagcaccttcagaacctacgtgttccccgagaccgacttcatcgccgtgaccgcctaccagaacgacaagatcacccagctgaagatcgacaacaaccccttcgccaagggcttcagagacaccggcaacggcagaagagagaagagaaagcagctgaccctgcccagcctgagactgtacgaggagcactgcaagcccgagagagacggcgccgagagcgacgccagcagctgcgaccccccccccgccagagagccccccaccagccccggcgccgcccccagccccctgagactgcacagagccagagccgaggagaagagctgcgccgccgacagcgaccccgagcccgagagactgagcgaggagagagccggcgcccccctgggcagaagccccgcccccgacagcgccagccccaccagactgaccgagcccgagagagccagagagagaagaagccccgagagaggcaaggagcccgccgagagcggcggcgacggccccttcggcctgagaagcctggagaaggagagagccgaggccagaagaaaggacgagggcagaaaggaggccgccgagggcaaggagcagggcctggcccccctggtggtgcagaccgacagcgccagccccctgggcgccggccacctgcccggcctggccttcagcagccacctgcacggccagcagttcttcggccccctgggcgccggccagcccctgttcctgcaccccggccagttcaccatgggccccggcgccttcagcgccatgggcatgggccacctgctggccagcgtggccggcggcggcaacggcggcggcggcggccccggcaccgccgccggcctggacgccggcggcctgggccccgccgccagcgccgccagcaccgccgcccccttccccttccacctgagccagcacatgctggccagccagggcatccccatgcccaccttcggcggcctgttcccctacccctacacctacatggccgccgccgccgccgccgccagcgccctgcccgccaccagcgccgccgccgccgccgccgccgccgccggcagcctgagcagaagccccttcctgggcagcgccagacccagactgagattcagcccctaccagatccccgtgaccatcccccccagcaccagcctgctgaccaccggcctggccagcgagggcagcaaggccgccggcggcaacagcagagagcccagccccctgcccgagctggccctgagaaaggtgggcgcccccagcagaggcgccctgagccccagcggcagcgccaaggaggccgccaacgagctgcagagcatccagagactggtgagcggcctggagagccagagagccctgagccccggcagagagagccccaagtag

SEQ ID NO: 13097 - DNA, 981 bp, Artificial Sequence
  Description of Artificial Sequence: Synthetic coding sequence
atgagcgccttcctggccgccgcccagcccagcttcttccccgccctggccctgccccccggcgccctggccaagcccctgcccgaccccggcctggccggcgccgccgccgccgccgccgccgccgccgccgccgccgaggccggcctgcacgtgagcgccctgggcccccacccccccgccgcccacctgagaagcctgaagagcctggagcccgaggacgaggtggaggacgaccccaaggtgaccctggaggccaaggagctgtgggaccagttccacaagctgggcaccgagatggtgatcaccaagagcggcagaagaatgttcccccccttcaaggtgagagtgagcggcctggacaagaaggccaagtacatcctgctgatggacatcgtggccgccgacgactgcagatacaagttccacaacagcagatggatggtggccggcaaggccgaccccgagatgcccaagagaatgtacatccaccccgacagccccgccaccggcgagcagtggatggccaagcccgtggccttccacaagctgaagctgaccaacaacatcagcgacaagcacggcttcaccatcctgaacagcatgcacaagtaccagcccagattccacatcgtgagagccaacgacatcctgaagctgccctacagcaccttcagaacctacgtgttccccgagaccgacttcatcgccgtgaccgcctaccagaacgacaagatcacccagctgaagatcgacaacaaccccttcgccaagggcttcagagacaccggcaacggcagaagagagaagagaaagcagctgaccctgcccagcctgagactgtacgaggagcactgcaagcccgagagagacggcgccgagagcgacgccagcagctgcgaccccccccccgccagagagccccccaccagccccggcgccgcccccagccccctgagactgcacagagccagaggctag

SEQ ID NO: 13098 - DNA, 996 bp, Artificial Sequence
  Description of Artificial Sequence: Synthetic coding sequence
atgaccgagagaccccccagcgaggccgccagaagcgacccccagctggagggcagagacgccgccgaggccagcatggcccccccccacctggtgctgctgaacggcgtggccaaggagaccagcagagccgccgccgccgagccccccgtgatcgagctgggcgccagaggcggccccggcggcggccccgccggcggcggcggcgccgccagagacctgaagggcagagacgccgccaccgccgaggccagacacagagtgcccaccaccgagctgtgcagaccccccggccccgcccccgcccccgcccccgccagcgtgaccgccgagctgcccggcgacggcagaatggtgcagctgagcccccccgccctggccgcccccgccgcccccggcagagccctgctgtacagcctgagccagcccctggccagcctgggcagcggcttcttcggcgagcccgacgccttccccatgttcaccaccaacaacagagtgaagagaagacccagcccctacgagatggagatcaccgacggcccccacaccaaggtggtgagaagaatcttcaccaacagcagagagagatggagacagcagaacgtgaacggcgccttcgccgagctgagaaagctgatccccacccacccccccgacaagaagctgagcaagaacgagatcctgagactggccatgaagtacatcaacttcctggccaagctgctgaacgaccaggaggaggagggcacccagagagccaagaccggcaaggaccccgtggtgggcgccggcggcggcggcggcggcggcggcggcggcgccccccccgacgacctgctgcaggacgtgctgagccccaacagcagctgcggcagcagcctggacggcgccgccagccccgacagctacaccgaggagcccgcccccaagcacaccgccagaagcctgcaccccgccatgctgcccgccgccgacggcgccggccccagatag

SEQ ID NO: 13099 - DNA, 1002 bp, Artificial Sequence
  Description of Artificial Sequence: Synthetic coding sequence
atgaccgagagaccccccagcgaggccgccagaagcgacccccagctggagggcagagacgccgccgaggccagcatggcccccccccacctggtgctgctgaacggcgtggccaaggagaccagcagagccgccgccgccgagccccccgtgatcgagctgggcgccagaggcggccccggcggcggccccgccggcggcggcggcgccgccagagacctgaagggcagagacgccgccaccgccgaggccagacacagagtgcccaccaccgagctgtgcagaccccccggccccgcccccgcccccgcccccgccagcgtgaccgccgagctgcccggcgacggcagaatggtgcagctgagcccccccgccctggccgcccccgccgcccccggcagagccctgctgtacagcctgagccagcccctggccagcctgggcagccacagcggcttcttcggcgagcccgacgccttccccatgttcaccaccaacaacagagtgaagagaagacccagcccctacgagatggagatcaccgacggcccccacaccaaggtggtgagaagaatcttcaccaacagcagagagagatggagacagcagaacgtgaacggcgccttcgccgagctgagaaagctgatccccacccacccccccgacaagaagctgagcaagaacgagatcctgagactggccatgaagtacatcaacttcctggccaagctgctgaacgaccaggaggaggagggcacccagagagccaagaccggcaaggaccccgtggtgggcgccggcggcggcggcggcggcggcggcggcggcgccccccccgacgacctgctgcaggacgtgctgagccccaacagcagctgcggcagcagcctggacggcgccgccagccccgacagctacaccgaggagcccgcccccaagcacaccgccagaagcctgcaccccgccatgctgcccgccgccgacggcgccggccccagatag

SEQ ID NO: 13100 - DNA, 996 bp, Artificial Sequence; identical to SEQ ID NO: 13098
  Description of Artificial Sequence: Synthetic coding sequence

SEQ ID NO: 13101 - DNA, 993 bp, Artificial Sequence
  Description of Artificial Sequence: Synthetic coding sequence
atggagcacctgggcccccaccacctgcaccccggccacgccgagcccatcagcttcggcatcgaccagatcctgaacagccccgaccagggcggctgcatgggccccgccagcagactgcaggacggcgagtacggcctgggctgcctggtgggcggcgcctacacctacggcggcggcggcagcgccgccgccaccggcgccggcggcgccggcgcctacggcaccggcggccccggcggccccggcggccccgccggcggcggcggcgcctgcagcatgggccccctgaccggcagctacaacgtgaacatggccctggccggcggccccggccccggcggcggcggcggcagcagcggcggcgccggcgccctgagcgccgccggcgtgatcagagtgcccgcccacagacccctggccggcgccgtggcccacccccagcccctggccaccggcctgcccaccgtgcccagcgtgcccgccatgcccggcgtgaacaacctgaccggcctgaccttcccctggatggagagcaacagaagatacaccaaggacagattcaccggccacccctaccagaacagaaccccccccaagaagaagaagcccagaaccagcttcaccagactgcagatctgcgagctggagaagagattccacagacagaagtacctggccagcgccgagagagccgccctggccaaggccctgaagatgaccgacgcccaggtgaagacctggttccagaacagaagaaccaagtggagaagacagaccgccgaggagagagaggccgagagacagcaggccaacagaatcctgctgcagctgcagcaggaggccttccagaagagcctggcccagcccctgcccgccgaccccctgtgcgtgcacaacagcagcctgttcgccctgcagaacctgcagccctggagcgacgacagcaccaagatcaccagcgtgaccagcgtggccagcgcctgcgagtag

SEQ ID NO: 13102 - DNA, 774 bp, Artificial Sequence
  Description of Artificial Sequence: Synthetic coding sequence
atggagcacctgggcccccaccacctgcaccccggccacgccgagcccatcagcttcggcatcgaccagatcctgaacagccccgaccagggcggctgcatgggccccgccagcagactgcaggacggcgagtacggcctgggctgcctggtgggcggcgcctacacctacggcggcggcggcagcgccgccgccaccggcgccggcggcgccggcgcctacggcaccggcggccccggcggccccggcggccccgccggcggcggcggcgcctgcagcatgggccccctgaccggcagctacaacgtgaacatggccctggccggcggccccggccccggcggcggcggcggcagcagcggcggcgccggcgccctgagcgccgccggcgtgatcagagtgcccgcccacagacccctggccggcgccgtggcccacccccagcccctggccaccggcctgcccaccgtgcccagcgtgcccgccatgcccggcgtgaacaacctgaccggcctgaccttcccctggatggagagcaacagaagatacaccaaggacagattcaccggccacccctaccagaacagaaccccccccaagaagaagaagcccagaaccagcttcaccagactgcagatctgcgagctggagaagagattccacagacagaagtacctggccagcgccgagagagccgccctggccaaggccctgaagatgaccgacgcccaggtgaagacctggttccagaacagaagaaccaagtggagatag

SEQ ID NO: 13103 - DNA, 345 bp, Artificial Sequence
  Description of Artificial Sequence: Synthetic coding sequence
atggccgagtgccccaccctgggcgaggccgtgaccgaccaccccgacagactgtgggcctgggagaagttcgtgtacctggacgagaagcagcacgcctggctgcccctgaccatcgagatcaaggacagactgcagctgagagtgctgctgagaagagaggacgtggtgctgggcagacccatgacccccacccagatcggccccagcctgctgcccatcatgtggcagctgtaccccgacggcagatacagaagcagcgacagcagcttctggagactggtgtaccacatcaagatcgacggcgtggaggacatgctgctggagctgctgcccgacgactag

SEQ ID NO: 13104 - DNA, 345 bp, Artificial Sequence; identical to SEQ ID NO: 13103
  Description of Artificial Sequence: Synthetic coding sequence

SEQ ID NO: 13105 - DNA, 345 bp, Artificial Sequence; identical to SEQ ID NO: 13103
  Description of Artificial Sequence: Synthetic coding sequence

SEQ ID NO: 13106 - DNA, 345 bp, Artificial Sequence; identical to SEQ ID NO: 13103
  Description of Artificial Sequence: Synthetic coding sequence

SEQ ID NO: 13107 - DNA, 1407 bp, Artificial Sequence
  Description of Artificial Sequence: Synthetic coding sequence
atggacagcctggccagcctggtgctgtgcggcgtgagcctgctgctgagcggcaccgtggagggcgccatggacctgatcctgatcaacagcctgcccctggtgagcgacgccgagaccagcctgacctgcatcgccagcggctggagaccccacgagcccatcaccatcggcagagacttcgaggccctgatgaaccagcaccaggaccccctggaggtgacccaggacgtgaccagagagtgggccaagaaggtggtgtggaagagagagaaggccagcaagatcaacggcgcctacttctgcgagggcagagtgagaggcgaggccatcagaatcagaaccatgaagatgagacagcaggccagcttcctgcccgccaccctgaccatgaccgtggacaagggcgacaacgtgaacatcagcttcaagaaggtgctgatcaaggaggaggacgccgtgatctacaagaacggcagcttcatccacagcgtgcccagacacgaggtgcccgacatcctggaggtgcacctgccccacgcccagccccaggacgccggcgtgtacagcgccagatacatcggcggcaacctgttcaccagcgccttcaccagactgatcgtgagaagatgcgaggcccagaagtggggccccgagtgcaaccacctgtgcaccgcctgcatgaacaacggcgtgtgccacgaggacaccggcgagtgcatctgcccccccggcttcatgggcagaacctgcgagaaggcctgcgagctgcacaccttcggcagaacctgcaaggagagatgcagcggccaggagggctgcaagagctacgtgttctgcctgcccgacccctacggctgcagctgcgccaccggctggaagggcctgcagtgcaacgagggcatccagagaatgacccccaagatcgtggacctgcccgaccacatcgaggtgaacagcggcaagttcaaccccatctgcaaggccagcggctggcccctgcccaccaacgaggagatgaccctggtgaagcccgacggcaccgtgctgcaccccaaggacttcaaccacaccgaccacttcagcgtggccatcttcaccatccacagaatcctgccccccgacagcggcgtgtgggtgtgcagcgtgaacaccgtggccggcatggtggagaagcccttcaacatcagcgtgaaggtgctgcccaagcccctgaacgcccccaacgtgatcgacaccggccacaacttcgccgtgatcaacatcagcagcgagccctacttcggcgacggccccatcaagagcaagaagctgctgtacaagcccgtgaaccactacgaggcctggcagcacatccaggtgagcatggagaagcagagactgaccaaggccaacagcgacatctag

SEQ ID NO: 13108 - DNA, 3375 bp, Artificial Sequence
  Description of Artificial Sequence: Synthetic coding sequence
atggacagcctggccagcctggtgctgtgcggcgtgagcctgctgctgagcggcaccgtggagggcgccatggacctgatcctgatcaacagcctgcccctggtgagcgacgccgagaccagcctgacctgcatcgccagcggctggagaccccacgagcccatcaccatcggcagagacttcgaggccctgatgaaccagcaccaggaccccctggaggtgacccaggacgtgaccagagagtgggccaagaaggtggtgtggaagagagagaaggccagcaagatcaacggcgcctacttctgcgagggcagagtgagaggcgaggccatcagaatcagaaccatgaagatgagacagcaggccagcttcctgcccgccaccctgaccatgaccgtggacaagggcgacaacgtgaacatcagcttcaagaaggtgctgatcaaggaggaggacgccgtgatctacaagaacggcagcttcatccacagcgtgcccagacacgaggtgcccgacatcctggaggtgcacctgccccacgcccagccccaggacgccggcgtgtacagcgccagatacatcggcggcaacctgttcaccagcgccttcaccagactgatcgtgagaagatgcgaggcccagaagtggggccccgagtgcaaccacctgtgcaccgcctgcatgaacaacggcgtgtgccacgaggacaccggcgagtgcatctgcccccccggcttcatgggcagaacctgcgagaaggcctgcgagctgcacaccttcggcagaacctgcaaggagagatgcagcggccaggagggctgcaagagctacgtgttctgcctgcccgacccctacggctgcagctgcgccaccggctggaagggcctgcagtgcaacgaggcctgccaccccggcttctacggccccgactgcaagctgagatgcagctgcaacaacggcgagatgtgcgacagattccagggctgcctgtgcagccccggctggcagggcctgcagtgcgagagagagggcatccagagaatgacccccaagatcgtggacctgcccgaccacatcgaggtgaacagcggcaagttcaaccccatctgcaaggccagcggctggcccctgcccaccaacgaggagatgaccctggtgaagcccgacggcaccgtgctgcaccccaaggacttcaaccacaccgaccacttcagcgtggccatcttcaccatccacagaatcctgccccccgacagcggcgtgtgggtgtgcagcgtgaacaccgtggccggcatggtggagaagcccttcaacatcagcgtgaaggtgctgcccaagcccctgaacgcccccaacgtgatcgacaccggccacaacttcgccgtgatcaacatcagcagcgagccctacttcggcgacggccccatcaagagcaagaagctgctgtacaagcccgtgaaccactacgaggcctggcagcacatccaggtgaccaacgagatcgtgaccctgaactacctggagcccagaaccgagtacgagctgtgcgtgcagctggtgagaagaggcgagggcggcgagggccaccccggccccgtgagaagattcaccaccgccagcatcggcctgcccccccccagaggcctgaacctgctgcccaagagccagaccaccctgaacctgacctggcagcccatcttccccagcagcgaggacgacttctacgtggaggtggagagaagaagcgtgcagaagagcgaccagcagaacatcaaggtgcccggcaacctgaccagcgtgctgctgaacaacctgcaccccagagagcagtacgtggtgagagccagagtgaacaccaaggcccagggcgagtggagcgaggacctgaccgcctggaccctgagcgacatcctgcccccccagcccgagaacatcaagatcagcaacatcacccacagcagcgccgtgatcagctggaccatcctggacggctacagcatcagcagcatcaccatcagatacaaggtgcagggcaagaacgaggaccagcacgtggacgtgaagatcaagaacgccaccatcacccagtaccagctgaagggcctggagcccgagaccgcctaccaggtggacatcttcgccgagaacaacatcggcagcagcaaccccgccttcagccacgagctggtgaccctgcccgagagccaggcccccgccgacctgggcggcggcaagatgctgctgatcgccatcctgggcagcgccggcatgacctgcctgaccgtgctgctggccttcctgatcatcctgcagctgaagagagccaacgtgcagagaagaatggcccaggccttccagaacgtgagagaggagcccgccgtgcagttcaacagcggcaccctggccctgaacagaaaggtgaagaacaaccccgaccccaccatctaccccgtgctggactggaacgacatcaagttccaggacgtgatcggcgagggcaacttcggccaggtgctgaaggccagaatcaagaaggacggcctgagaatggacgccgccatcaagagaatgaaggagtacgccagcaaggacgaccacagagacttcgccggcgagctggaggtgctgtgcaagctgggccaccaccccaacatcatcaacctgctgggcgcctgcgagcacagaggctacctgtacctggccatcgagtacgccccccacggcaacctgctggacttcctgagaaagagcagagtgctggagaccgaccccgccttcgccatcgccaacagcaccgccagcaccctgagcagccagcagctgctgcacttcgccgccgacgtggccagaggcatggactacctgagccagaagcagttcatccacagagacctggccgccagaaacatcctggtgggcgagaactacgtggccaagatcgccgacttcggcctgagcagaggccaggaggtgtacgtgaagaagaccatgggcagactgcccgtgagatggatggccatcgagagcctgaactacagcgtgtacaccaccaacagcgacgtgtggagctacggcgtgctgctgtgggagatcgtgagcctgggcggcaccccctactgcggcatgacctgcgccgagctgtacgagaagctgccccagggctacagactggagaagcccctgaactgcgacgacgaggtgtacgacctgatgagacagtgctggagagagaagccctacgagagacccagcttcgcccagatcctggtgagcctgaacagaatgctggaggagagaaagacctacgtgaacaccaccctgtacgagaagttcacctacgccggcatcgactgcagcgccgaggaggccgcctag

SEQ ID NO: 13109 - DNA, 3246 bp, Artificial Sequence
  Description of Artificial Sequence: Synthetic coding sequence
atggacagcctggccagcctggtgctgtgcggcgtgagcctgctgctgagcggcaccgtggagggcgccatggacctgatcctgatcaacagcctgcccctggtgagcgacgccgagaccagcctgacctgcatcgccagcggctggagaccccacgagcccatcaccatcggcagagacttcgaggccctgatgaaccagcaccaggaccccctggaggtgacccaggacgtgaccagagagtgggccaagaaggtggtgtggaagagagagaaggccagcaagatcaacggcgcctacttctgcgagggcagagtgagaggcgaggccatcagaatcagaaccatgaagatgagacagcaggccagcttcctgcccgccaccctgaccatgaccgtggacaagggcgacaacgtgaacatcagcttcaagaaggtgctgatcaaggaggaggacgccgtgatctacaagaacggcagcttcatccacagcgtgcccagacacgaggtgcccgacatcctggaggtgcacctgccccacgcccagccccaggacgccggcgtgtacagcgccagatacatcggcggcaacctgttcaccagcgccttcaccagactgatcgtgagaagatgcgaggcccagaagtggggccccgagtgcaaccacctgtgcaccgcctgcatgaacaacggcgtgtgccacgaggacaccggcgagtgcatctgcccccccggcttcatgggcagaacctgcgagaaggcctgcgagctgcacaccttcggcagaacctgcaaggagagatgcagcggccaggagggctgcaagagctacgtgttctgcctgcccgacccctacggctgcagctgcgccaccggctggaagggcctgcagtgcaacgagggcatccagagaatgacccccaagatcgtggacctgcccgaccacatcgaggtgaacagcggcaagttcaaccccatctgcaaggccagcggctggcccctgcccaccaacgaggagatgaccctggtgaagcccgacggcaccgtgctgcaccccaaggacttcaaccacaccgaccacttcagcgtggccatcttcaccatccacagaatcctgccccccgacagcggcgtgtgggtgtgcagcgtgaacaccgtggccggcatggtggagaagcccttcaacatcagcgtgaaggtgctgcccaagcccctgaacgcccccaacgtgatcgacaccggccacaacttcgccgtgatcaacatcagcagcgagccctacttcggcgacggccccatcaagagcaagaagctgctgtacaagcccgtgaaccactacgaggcctggcagcacatccaggtgaccaacgagatcgtgaccctgaactacctggagcccagaaccgagtacgagctgtgcgtgcagctggtgagaagaggcgagggcggcgagggccaccccggccccgtgagaagattcaccaccgccagcatcggcctgcccccccccagaggcctgaacctgctgcccaagagccagaccaccctgaacctgacctggcagcccatcttccccagcagcgaggacgacttctacgtggaggtggagagaagaagcgtgcagaagagcgaccagcagaacatcaaggtgcccggcaacctgaccagcgtgctgctgaacaacctgcaccccagagagcagtacgtggtgagagccagagtgaacaccaaggcccagggcgagtggagcgaggacctgaccgcctggaccctgagcgacatcctgcccccccagcccgagaacatcaagatcagcaacatcacccacagcagcgccgtgatcagctggaccatcctggacggctacagcatcagcagcatcaccatcagatacaaggtgcagggcaagaacgaggaccagcacgtggacgtgaagatcaagaacgccaccatcacccagtaccagctgaagggcctggagcccgagaccgcctaccaggtggacatcttcgccgagaacaacatcggcagcagcaaccccgccttcagccacgagctggtgaccctgcccgagagccaggcccccgccgacctgggcggcggcaagatgctgctgatcgccatcctgggcagcgccggcatgacctgcctgaccgtgctgctggccttcctgatcatcctgcagctgaagagagccaacgtgcagagaagaatggcccaggccttccagaacgtgagagaggagcccgccgtgcagttcaacagcggcaccctggccctgaacagaaaggtgaagaacaaccccgaccccaccatctaccccgtgctggactggaacgacatcaagttccaggacgtgatcggcgagggcaacttcggccaggtgctgaaggccagaatcaagaaggacggcctgagaatggacgccgccatcaagagaatgaaggagtacgccagcaaggacgaccacagagacttcgccggcgagctggaggtgctgtgcaagctgggccaccaccccaacatcatcaacctgctgggcgcctgcgagcacagaggctacctgtacctggccatcgagtacgccccccacggcaacctgctggacttcctgagaaagagcagagtgctggagaccgaccccgccttcgccatcgccaacagcaccgccagcaccctgagcagccagcagctgctgcacttcgccgccgacgtggccagaggcatggactacctgagccagaagcagttcatccacagagacctggccgccagaaacatcctggtgggcgagaactacgtggccaagatcgccgacttcggcctgagcagaggccaggaggtgtacgtgaagaagaccatgggcagactgcccgtgagatggatggccatcgagagcctgaactacagcgtgtacaccaccaacagcgacgtgtggagctacggcgtgctgctgtgggagatcgtgagcctgggcggcaccccctactgcggcatgacctgcgccgagctgtacgagaagctgccccagggctacagactggagaagcccctgaactgcgacgacgaggtgtacgacctgatgagacagtgctggagagagaagccctacgagagacccagcttcgcccagatcctggtgagcctgaacagaatgctggaggagagaaagacctacgtgaacaccaccctgtacgagaagttcacctacgccggcatcgactgcagcgccgaggaggccgcctag

SEQ ID NO: 13110 - DNA, 3375 bp, Artificial Sequence; identical to SEQ ID NO: 13108
  Description of Artificial Sequence: Synthetic coding sequence

SEQ ID NO: 13111 - DNA, 2931 bp, Artificial Sequence
  Description of Artificial Sequence: Synthetic coding sequence
atggacagcctggccagcctggtgctgtgcggcgtgagcctgctgctgagcgccagcttcctgcccgccaccctgaccatgaccgtggacaagggcgacaacgtgaacatcagcttcaagaaggtgctgatcaaggaggaggacgccgtgatctacaagaacggcagcttcatccacagcgtgcccagacacgaggtgcccgacatcctggaggtgcacctgccccacgcccagccccaggacgccggcgtgtacagcgccagatacatcggcggcaacctgttcaccagcgccttcaccagactgatcgtgagaagatgcgaggcccagaagtggggccccgagtgcaaccacctgtgcaccgcctgcatgaacaacggcgtgtgccacgaggacaccggcgagtgcatctgcccccccggcttcatgggcagaacctgcgagaaggcctgcgagctgcacaccttcggcagaacctgcaaggagagatgcagcggccaggagggctgcaagagctacgtgttctgcctgcccgacccctacggctgcagctgcgccaccggctggaagggcctgcagtgcaacgagggcatccagagaatgacccccaagatcgtggacctgcccgaccacatcgaggtgaacagcggcaagttcaaccccatctgcaaggccagcggctggcccctgcccaccaacgaggagatgaccctggtgaagcccgacggcaccgtgctgcaccccaaggacttcaaccacaccgaccacttcagcgtggccatcttcaccatccacagaatcctgccccccgacagcggcgtgtgggtgtgcagcgtgaacaccgtggccggcatggtggagaagcccttcaacatcagcgtgaaggtgctgcccaagcccctgaacgcccccaacgtgatcgacaccggccacaacttcgccgtgatcaacatcagcagcgagccctacttcggcgacggccccatcaagagcaagaagctgctgtacaagcccgtgaaccactacgaggcctggcagcacatccaggtgaccaacgagatcgtgaccctgaactacctggagcccagaaccgagtacgagctgtgcgtgcagctggtgagaagaggcgagggcggcgagggccaccccggccccgtgagaagattcaccaccgccagcatcggcctgcccccccccagaggcctgaacctgctgcccaagagccagaccaccctgaacctgacctggcagcccatcttccccagcagcgaggacgacttctacgtggaggtggagagaagaagcgtgcagaagagcgaccagcagaacatcaaggtgcccggcaacctgaccagcgtgctgctgaacaacctgcaccccagagagcagtacgtggtgagagccagagtgaacaccaaggcccagggcgagtggagcgaggacctgaccgcctggaccctgagcgacatcctgcccccccagcccgagaacatcaagatcagcaacatcacccacagcagcgccgtgatcagctggaccatcctggacggctacagcatcagcagcatcaccatcagatacaaggtgcagggcaagaacgaggaccagcacgtggacgtgaagatcaagaacgccaccatcacccagtaccagctgaagggcctggagcccgagaccgcctaccaggtggacatcttcgccgagaacaacatcggcagcagcaaccccgccttcagccacgagctggtgaccctgcccgagagccaggcccccgccgacctgggcggcggcaagatgctgctgatcgccatcctgggcagcgccggcatgacctgcctgaccgtgctgctggccttcctgatcatcctgcagctgaagagagccaacgtgcagagaagaatggcccaggccttccagaacagagaggagcccgccgtgcagttcaacagcggcaccctggccctgaacagaaaggtgaagaacaaccccgaccccaccatctaccccgtgctggactggaacgacatcaagttccaggacgtgatcggcgagggcaacttcggccaggtgctgaaggccagaatcaagaaggacggcctgagaatggacgccgccatcaagagaatgaaggagtacgccagcaaggacgaccacagagacttcgccggcgagctggaggtgctgtgcaagctgggccaccaccccaacatcatcaacctgctgggcgcctgcgagcacagaggctacctgtacctggccatcgagtacgccccccacggcaacctgctggacttcctgagaaagagcagagtgctggagaccgaccccgccttcgccatcgccaacagcaccgccagcaccctgagcagccagcagctgctgcacttcgccgccgacgtggccagaggcatggactacctgagccagaagcagttcatccacagagacctggccgccagaaacatcctggtgggcgagaactacgtggccaagatcgccgacttcggcctgagcagaggccaggaggtgtacgtgaagaagaccatgggcagactgcccgtgagatggatggccatcgagagcctgaactacagcgtgtacaccaccaacagcgacgtgtggagctacggcgtgctgctgtgggagatcgtgagcctgggcggcaccccctactgcggcatgacctgcgccgagctgtacgagaagctgccccagggctacagactggagaagcccctgaactgcgacgacgaggtgtacgacctgatgagacagtgctggagagagaagccctacgagagacccagcttcgcccagatcctggtgagcctgaacagaatgctggaggagagaaagacctacgtgaacaccaccctgtacgagaagttcacctacgccggcatcgactgcagcgccgaggaggccgcctag

SEQ ID NO: 13112 - DNA, 7884 bp, Artificial Sequence
  Description of Artificial Sequence: Synthetic coding sequence
atggagaagctgcacggccacgtgagcgcccaccccgacatcctgagcctggagaacagatgcctggccatgctgcccgacctgcagcccctggagaagctgcaccagcacgtgagcacccacagcgacatcctgagcctgaagaaccagtgcctggccaccctgcccgacctgaagaccatggagaagccccacggctacgtgagcgcccaccccgacatcctgagcctggagaaccagtgcctggccaccctgagcgacctgaagaccatggagaagccccacggccacgtgagcgcccaccccgacatcctgagcctggagaacagatgcctggccaccctgagcagcctgaagagcaccgtgagcgccagccccctgttccagagcctgcagatcagccacatgacccaggccgacctgtacagagtgaacaacagcaactgcctgctgagcgagccccccagctggagagcccagcacttcagcaagggcctggacctgagcacctgccccatcgccctgaagagcatcagcgccaccgagaccgcccaggaggccaccctgggcagatggttcgacagcgaggagaagaagggcgccgagacccagatgcccagctacagcctgagcctgggcgaggaggaggaggtggaggacctggccgtgaagctgaccagcggcgacagcgagagccaccccgagcccaccgaccacgtgctgcaggagaagaagatggccctgctgagcctgctgtgcagcaccctggtgagcgaggtgaacatgaacaacaccagcgaccccaccctggccgccatcttcgagatctgcagagagctggccctgctggagcccgagttcatcctgaaggccagcctgtacgccagacagcagctgaacgtgagaaacgtggccaacaacatcctggccatcgccgccttcctgcccgcctgcagaccccacctgagaagatacttctgcgccatcgtgcagctgcccagcgactggatccaggtggccgagctgtaccagagcctggccgagggcgacaagaacaagctggtgcccctgcccgcctgcctgagaaccgccatgaccgacaagttcgcccagttcgacgagtaccagctggccaagtacaaccccagaaagcacagagccaagagacaccccagaagaccccccagaagccccggcatggagccccccttcagccacagatgcttccccagatacatcggcttcctgagagaggagcagagaaagttcgagaaggccggcgacaccgtgagcgagaagaagaacccccccagattcaccctgaagaagctggtgcagagactgcacatccacaagcccgcccagcacgtgcaggccctgctgggctacagataccccagcaacctgcagctgttcagcagaagcagactgcccggcccctgggacagcagcagagccggcaagagaatgaagctgagcagacccgagacctgggagagagagctgagcctgagaggcaacaaggccagcgtgtgggaggagctgatcgagaacggcaagctgcccttcatggccatgctgagaaacctgtgcaacctgctgagagtgggcatcagcagcagacaccacgagctgatcctgcagagactgcagcacgccaagagcgtgatccacagcagacagttccccttcagattcctgaacgcccacgacgccatcgacgccctggaggcccagctgagaaaccaggccctgcccttccccagcaacatcaccctgatgagaagaatcctgaccagaaacgagaagaacagacccagaagaagattcctgtgccacctgagcagacagcagctgagaatggccatgagaatccccgtgctgtacgagcagctgaagagagagaagctgagagtgcacaaggccagacagtggaagtacgacggcgagatgctgaacagatacagacaggccctggagaccgccgtgaacctgagcgtgaagcacagcctgcccctgctgcccggcagaaccgtgctggtgtacctgaccgacgccaacgccgacagactgtgccccaagagcaacccccagggcccccccctgaactacgccctgctgctgatcggcatgatgatcaccagagccgagcaggtggacgtggtgctgtgcggcggcgacaccctgaagaccgccgtgctgaaggccgaggagggcatcctgaagaccgccatcaagctgcaggcccaggtgcaggagttcgacgagaacgacggctggagcctgaacaccttcggcaagtacctgctgagcctggccggccagagagtgcccgtggacagagtgatcctgctgggccagagcatggacgacggcatgatcaacgtggccaagcagctgtactggcagagagtgaacagcaagtgcctgttcgtgggcatcctgctgagaagagtgcagtacctgagcaccgacctgaaccccaacgacgtgaccctgagcggctgcaccgacgccatcctgaagttcatcgccgagcacggcgccagccacctgctggagcacgtgggccagatggacaagatcttcaagatcccccccccccccggcaagaccggcgtgcagagcctgagacccctggaggaggacacccccagccccctggcccccgtgagccagcagggctggagaagcatcagactgttcatcagcagcaccttcagagacatgcacggcgagagagacctgctgctgagaagcgtgctgcccgccctgcaggccagagccgccccccacagaatcagcctgcacggcatcgacctgagatggggcgtgaccgaggaggagaccagaagaaacagacagctggaggtgtgcctgggcgaggtggagaacgcccagctgttcgtgggcatcctgggcagcagatacggctacatcccccccagctacaacctgcccgaccacccccacttccactgggcccagcagtaccccagcggcagaagcgtgaccgagatggaggtgatgcagttcctgaacagaaaccagagactgcagcccagcgcccaggccctgatctacttcagagacagcagcttcctgagcagcgtgcccgacgcctggaagagcgacttcgtgagcgagagcgaggaggccgccagaagaatcagcgagctgaagagctacctgagcagacagaagggcatcacctgcagaagatacccctgcgagtggggcggcgtggccgccggcagaccctacgtgggcggcctggaggagttcggccagctggtgctgcaggacgtgtggaacatgatccagaagctgtacctgcagcccggcgccctgctggagcagcccgtgagcatccccgacgacgacctggtgcaggccaccttccagcagctgcagaagccccccagccccgccagacccagactgctgcaggacaccgtgcagagactgatgctgccccacggcagactgagcctggtgaccggccagagcggccagggcaagaccgccttcctggccagcctggtgagcgccctgcaggcccccgacggcgccaaggtggccagcctggtgttcttccacttcagcggcgccagacccgaccagggcctggccctgaccctgctgagaagactgtgcacctacctgagaggccagctgaaggagcccggcgccctgcccagcacctacagaagcctggtgtgggagctgcagcagagactgctgcccaagagcgccgagagcctgcaccccggccagacccaggtgctgatcatcgacggcgccgacagactggtggaccagaacggccagctgatcagcgactggatccccaagaagctgcccagatgcgtgcacctggtgctgagcgtgagcagcgacgccggcctgggcgagaccctggagcagagccagggcgcccacgtgctggccctgggccccctggaggccagcgccagagccagactggtgagagaggagctggccctgtacggcaagagactggaggagagccccttcaacaaccagatgagactgctgctggtgaagagagagagcggcagacccctgtacctgagactggtgaccgaccacctgagactgttcaccctgtacgagcaggtgagcgagagactgagaaccctgcccgccaccgtgcccctgctgctgcagcacatcctgagcaccctggagaaggagcacggccccgacgtgctgccccaggccctgaccgccctggaggtgaccagaagcggcctgaccgtggaccagctgcacggcgtgctgagcgtgtggagaaccctgcccaagggcaccaagagctgggaggaggccgtggccgccggcaacagcggcgacccctaccccatgggccccttcgcctgcctggtgcagagcctgagaagcctgctgggcgagggccccctggagagacccggcgccagactgtgcctgcccgacggccccctgagaaccgccgccaagagatgctacggcaagagacccggcctggaggacaccgcccacatcctgatcgccgcccagctgtggaagacctgcgacgccgacgccagcggcaccttcagaagctgcccccccgaggccctgggcgacctgccctaccacctgctgcagagcggcaacagaggcctgctgagcaagttcctgaccaacctgcacgtggtggccgcccacctggagctgggcctggtgagcagactgctggaggcccacgccctgtacgccagcagcgtgcccaaggaggagcagaagctgcccgaggccgacgtggccgtgttcagaaccttcctgagacagcaggccagcatcctgagccagtaccccagactgctgccccagcaggccgccaaccagcccctggacagccccctgtgccaccaggccagcctgctgagcagaagatggcacctgcagcacaccctgagatggctgaacaagcccagaaccatgaagaaccagcagagcagcagcctgagcctggccgtgagcagcagccccaccgccgtggccttcagcaccaacggccagagagccgccgtgggcaccgccaacggcaccgtgtacctgctggacctgagaacctggcaggaggagaagagcgtggtgagcggctgcgacggcatcagcgcctgcctgttcctgagcgacgacaccctgttcctgaccgccttcgacggcctgctggagctgtgggacctgcagcacggctgcagagtgctgcagaccaaggcccaccagtaccagatcaccggctgctgcctgagccccgactgcagactgctggccaccgtgtgcctgggcggctgcctgaagctgtgggacaccgtgagaggccagctggccttccagcacacctaccccaagagcctgaactgcgtggccttccaccccgagggccaggtgatcgccaccggcagctgggccggcagcatcagcttcttccaggtggacggcctgaaggtgaccaaggacctgggcgcccccggcgccagcatcagaaccctggccttcaacgtgcccggcggcgtggtggccgtgggcagactggacagcatggtggagctgtgggcctggagagagggcgccagactggccgccttccccgcccaccacggcttcgtggccgccgccctgttcctgcacgccggctgccagctgctgaccgccggcgaggacggcaaggtgcaggtgtggagcggcagcctgggcagacccagaggccacctgggcagcctgagcctgagccccgccctgagcgtggccctgagccccgacggcgacagagtggccgtgggctacagagccgacggcatcagaatctacaagatcagcagcggcagccagggcgcccagggccaggccctggacgtggccgtgagcgccctggcctggctgagccccaaggtgctggtgagcggcgccgaggacggcagcctgcagggctgggccctgaaggagtgcagcctgcagagcctgtggctgctgagcagattccagaagcccgtgctgggcctggccaccagccaggagctgctggccagcgccagcgaggacttcaccgtgcagctgtggcccagacagctgctgaccagaccccacaaggccgaggacttcccctgcggcaccgagctgagaggccacgagggccccgtgagctgctgcagcttcagcaccgacggcggcagcctggccaccggcggcagagacagaagcctgctgtgctgggacgtgagaacccccaagacccccgtgctgatccacagcttccccgcctgccacagagactgggtgaccggctgcgcctggaccaaggacaacctgctgatcagctgcagcagcgacggcagcgtgggcctgtgggaccccgagagcggccagagactgggccagttcctgggccaccagagcgccgtgagcgccgtggccgccgtggaggagcacgtggtgagcgtgagcagagacggcaccctgaaggtgtgggaccaccagggcgtggagctgaccagcatccccgcccacagcggccccatcagccactgcgccgccgccatggagcccagagccgccggccagcccggcagcgagctgctggtggtgaccgtgggcctggacggcgccaccagactgtggcaccccctgctggtgtgccagacccacaccctgctgggccacagcggccccgtgagagccgccgccgtgagcgagaccagcggcctgatgctgaccgccagcgaggacggcagcgtgagactgtggcaggtgcccaaggaggccgacgacacctgcatccccagaagcagcgccgccgtgaccgccgtggcctgggcccccgacggcagcatggccgtgagcggcaaccaggccggcgagctgatcctgtggcaggaggccaaggccgtggccaccgcccaggcccccggccacatcggcgccctgatctggagcagcgcccacaccttcttcgtgctgagcgccgacgagaagatcagcgagtggcaggtgaagctgagaaagggcagcgcccccggcaacctgagcctgcacctgaacagaatcctgcaggaggacctgggcgtgctgaccagcctggactgggcccccgacggccacttcctgatcctggccaaggccgacctgaagctgctgtgcatgaagcccggcgacgcccccagcgagatctggagcagctacaccgagaaccccatgatcctgagcacccacaaggagtacggcatcttcgtgctgcagcccaaggaccccggcgtgctgagcttcctgagacagaaggagagcggcgagttcgaggagagactgaacttcgacatcaacctggagaaccccagcagaaccctgatcagcatcacccaggccaagcccgagagcgagagcagcttcctgtgcgccagcagcgacggcatcctgtggaacctggccaagtgcagccccgagggcgagtggaccaccggcaacatgtggcagaagaaggccaacacccccgagacccagacccccggcaccgaccccagcacctgcagagagagcgacgccagcatggacagcgacgccagcatggacagcgagcccaccccccacctgaagaccagacagagaagaaagatccacagcggcagcgtgaccgccctgcacgtgctgcccgagctgctggtgaccgccagcaaggacagagacgtgaagctgtgggagagacccagcatgcagctgctgggcctgttcagatgcgagggcagcgtgagctgcctggagccctggctgggcgccaacagcaccctgcagctggccgtgggcgacgtgcagggcaacgtgtacttcctgaactgggagtag

SEQ ID NO: 13113 - DNA, 7860 bp, Artificial Sequence
  Description of Artificial Sequence: Synthetic coding sequence
atggagaagctgcacggccacgtgagcgcccaccccgacatcctgagcctggagaacagatgcctggccatgctgcccgacctgcagcccctggagaagctgcaccagcacgtgagcacccacagcgacatcctgagcctgaagaaccagtgcctggccaccctgcccgacctgaagaccatggagaagccccacggctacgtgagcgcccaccccgacatcctgagcctggagaaccagtgcctggccaccctgagcgacctgaagaccatggagaagccccacggccacgtgagcgcccaccccgacatcctgagcctggagaacagatgcctggccaccctgagcagcctgaagagcaccgtgagcgccagccccctgttccagagcctgcagatcagccacatgacccaggccgacctgtacagagtgaacaacagcaactgcctgctgagcgagccccccagctggagagcccagcacttcagcaagggcctggacctgagcacctgccccatcgccctgaagagcatcagcgccaccgagaccgcccaggaggccaccctgggcagatggttcgacagcgaggagaagaagggcgccgagacccagatgcccagctacagcctgagcctgggcgaggaggaggaggtggaggacctggccgtgaagctgaccagcggcgacagcgagagccaccccgagcccaccgaccacgtgctgcaggagaagaagatggccctgctgagcctgctgtgcagcaccctggtgagcgaggtgaacatgaacaacaccagcgaccccaccctggccgccatcttcgagatctgcagagagctggccctgctggagcccgagttcatcctgaaggccagcctgtacgccagacagcagctgaacgtgagaaacgtggccaacaacatcctggccatcgccgccttcctgcccgcctgcagaccccacctgagaagatacttctgcgccatcgtgcagctgcccagcgactggatccaggtggccgagctgtaccagagcctggccgagggcgacaagaacaagctggtgcccctgcccgcctgcctgagaaccgccatgaccgacaagttcgcccagttcgacgagtaccagctggccaagtacaaccccagaaagcacagagccaagagacaccccagaagaccccccagaagccccggcatggagccccccttcagccacagatgcttccccagatacatcggcttcctgagagaggagcagagaaagttcgagaaggccggcgacaccgtgagcgagaagaagaacccccccagattcaccctgaagaagctggtgcagagactgcacatccacaagcccgcccagcacgtgcaggccctgctgggctacagataccccagcaacctgcagctgttcagcagaagcagactgcccggcccctgggacagcagcagagccggcaagagaatgaagctgagcagacccgagacctgggagagagagctgagcctgagaggcaacaaggccagcgtgtgggaggagctgatcgagaacggcaagctgcccttcatggccatgctgagaaacctgtgcaacctgctgagagtgggcatcagcagcagacaccacgagctgatcctgcagagactgcagcacgccaagagcgtgatccacagcagacagttccccttcagattcctgaacgcccacgacgccatcgacgccctggaggcccagctgagaaaccaggccctgcccttccccagcaacatcaccctgatgagaagaatcctgaccagaaacgagaagaacagacccagaagaagattcctgtgccacctgagcagacagcagctgagaatggccatgagaatccccgtgctgtacgagcagctgaagagagagaagctgagagtgcacaaggccagacagtggaagtacgacggcgagatgctgaacagatacagacaggccctggagaccgccgtgaacctgagcgtgaagcacagcctgcccctgctgcccggcagaaccgtgctggtgtacctgaccgacgccaacgccgacagactgtgccccaagagcaacccccagggcccccccctgaactacgccctgctgctgatcggcatgatgatcaccagagccgagcaggtggacgtggtgctgtgcggcggcgacaccctgaagaccgccgtgctgaaggccgaggagggcatcctgaagaccgccatcaagctgcaggcccaggtgcaggagttcgacgagaacgacggctggagcctgaacaccttcggcaagtacctgctgagcctggccggccagagagtgcccgtggacagagtgatcctgctgggccagagcatggacgacggcatgatcaacgtggccaagcagctgtactggcagagagtgaacagcaagtgcctgttcgtgggcatcctgctgagaagagtgcagtacctgagcaccgacctgaaccccaacgacgtgaccctgagcggctgcaccgacgccatcctgaagttcatcgccgagcacggcgccagccacctgctggagcacgtgggccagatggacaagatcttcaagatcccccccccccccggcaagaccggcgtgcagagcctgagacccctggaggaggacacccccagccccctggcccccgtgagccagcagggctggagaagcatcagactgttcatcagcagcaccttcagagacatgcacggcgagagagacctgctgctgagaagcgtgctgcccgccctgcaggccagagccgccccccacagaatcagcctgcacggcatcgacctgagatggggcgtgaccgaggaggagaccagaagaaacagacagctggaggtgtgcctgggcgaggtggagaacgcccagctgttcgtgggcatcctgggcagcagatacggctacatcccccccagctacaacctgcccgaccacccccacttccactgggcccagcagtaccccagcggcagaagcgtgaccgagatggaggtgatgcagttcctgaacagaaaccagagactgcagcccagcgcccaggccctgatctacttcagagacagcagcttcctgagcagcgtgcccgacgcctggaagagcgacttcgtgagcgagagcgaggaggccgccagaagaatcagcgagctgaagagctacctgagcagacagaagggcatcacctgcagaagatacccctgcgagtggggcggcgtggccgccggcagaccctacgtgggcggcctggaggagttcggccagctggtgctgcaggacgtgtggaacatgatccagaagctgtacctgcagcccggcgccctgctggagcagcccgtgagcatccccgacgacgacctggtgcaggccaccttccagcagctgcagaagccccccagccccgccagacccagactgctgcaggacaccgtgcagagactgatgctgccccacggcagactgagcctggtgaccggccagagcggccagggcaagaccgccttcctggccagcctggtgagcgccctgcaggcccccgacggcgccaaggtggccagcctggtgttcttccacttcagcggcgccagacccgaccagggcctggccctgaccctgctgagaagactgtgcacctacctgagaggccagctgaaggagcccggcgccctgcccagcacctacagaagcctggtgtgggagctgcagcagagactgctgcccaagagcgccgagagcctgcaccccggccagacccaggtgctgatcatcgacggcgccgacagactggtggaccagaacggccagctgatcagcgactggatccccaagaagctgcccagatgcgtgcacctggtgctgagcgtgagcagcgacgccggcctgggcgagaccctggagcagagccagggcgcccacgtgctggccctgggccccctggaggccagcgccagagccagactggtgagagaggagctggccctgtacggcaagagactggaggagagccccttcaacaaccagatgagactgctgctggtgaagagagagagcggcagacccctgtacctgagactggtgaccgaccacctgagactgttcaccctgtacgagcaggtgagcgagagactgagaaccctgcccgccaccgtgcccctgctgctgcagcacatcctgagcaccctggagaaggagcacggccccgacgtgctgccccaggccctgaccgccctggaggtgaccagaagcggcctgaccgtggaccagctgcacggcgtgctgagcgtgtggagaaccctgcccaagggcaccaagagctgggaggaggccgtggccgccggcaacagcggcgacccctaccccatgggccccttcgcctgcctggtgcagagcctgagaagcctgctgggcgagggccccctggagagacccggcgccagactgtgcctgcccgacggccccctgagaaccgccgccaagagatgctacggcaagagacccggcctggaggacaccgcccacatcctgatcgccgcccagctgtggaagacctgcgacgccgacgccagcggcaccttcagaagctgcccccccgaggccctgggcgacctgccctaccacctgctgcagagcggcaacagaggcctgctgagcaagttcctgaccaacctgcacgtggtggccgcccacctggagctgggcctggtgagcagactgctggaggcccacgccctgtacgccagcagcgtgcccaaggaggagcagaagctgcccgaggccgacgtggccgtgttcagaaccttcctgagacagcaggccagcatcctgagccagtaccccagactgctgccccagcaggccgccaaccagcccctggacagccccctgtgccaccaggccagcctgctgagcagaagatggcacctgcagcacaccctgagatggctgaacaagcccagaaccatgaagaaccagcagagcagcagcctgagcctggccgtgagcagcagccccaccgccgtggccttcagcaccaacggccagagagccgccgtgggcaccgccaacggcaccgtgtacctgctggacctgagaacctggcaggaggagaagagcgtggtgagcggctgcgacggcatcagcgcctgcctgttcctgagcgacgacaccctgttcctgaccgccttcgacggcctgctggagctgtgggacctgcagcacggctgcagagtgctgcagaccaaggcccaccagtaccagatcaccggctgctgcctgagccccgactgcagactgctggccaccgtgtgcctgggcggctgcctgaagctgtgggacaccgtgagaggccagctggccttccagcacacctaccccaagagcctgaactgcgtggccttccaccccgagggccaggtgatcgccaccggcagctgggccggcagcatcagcttcttccaggtggacggcctgaaggtgaccaaggacctgggcgcccccggcgccagcatcagaaccctggccttcaacgtgcccggcggcgtggtggccgtgggcagactggacagcatggtggagctgtgggcctggagagagggcgccagactggccgccttccccgcccaccacggcttcgtggccgccgccctgttcctgcacgccggctgccagctgctgaccgccggcgaggacggcaaggtgcaggtgtggagcggcagcctgggcagacccagaggccacctgggcagcctgagcctgagccccgccctgagcgtggccctgagccccgacggcgacagagtggccgtgggctacagagccgacggcatcagaatctacaagatcagcagcggcagccagggcgcccagggccaggccctggacgtggccgtgagcgccctggcctggctgagccccaaggtgctggtgagcggcgccgaggacggcagcctgcagggctgggccctgaaggagtgcagcctgcagagcctgtggctgctgagcagattccagaagcccgtgctgggcctggccaccagccaggagctgctggccagcgccagcgaggacttcaccgtgcagctgtggcccagacagctgctgaccagaccccacaaggccgaggacttcccctgcggcaccgagctgagaggccacgagggccccgtgagctgctgcagcttcagcaccgacggcggcagcctggccaccggcggcagagacagaagcctgctgtgctgggacgtgagaacccccaagacccccgtgctgatccacagcttccccgcctgccacagagactgggtgaccggctgcgcctggaccaaggacaacctgctgatcagctgcagcagcgacggcagcgtgggcctgtgggaccccgagagcggccagagactgggccagttcctgggccaccagagcgccgtgagcgccgtggccgccgtggaggagcacgtggtgagcgtgagcagagacggcaccctgaaggtgtgggaccaccagggcgtggagctgaccagcatccccgcccacagcggccccatcagccactgcgccgccgccatggagcccagagccgccggccagcccggcagcgagctgctggtggtgaccgtgggcctggacggcgccaccagactgtggcaccccctgctggtgtgccagacccacaccctgctgggccacagcggccccgtgagagccgccgccgtgagcgagaccagcggcctgatgctgaccgccagcgaggacggcagcgtgagactgtggcaggtgcccaaggaggccgacgacacctgcatccccagaagcagcgccgccgtgaccgccgtggcctgggcccccgacggcagcatggccgtgagcggcaaccaggccggcgagctgatcctgtggcaggaggccaaggccgtggccaccgcccaggcccccggccacatcggcgccctgatctggagcagcgcccacaccttcttcgtgctgagcgccgacgagaagatcagcgagtggcaggtgaagctgagaaagggcagcgcccccggcaacctgagcctgcacctgaacagaatcctgcaggaggacctgggcgtgctgaccagcctggactgggcccccgacggccacttcctgatcctggccaaggccgacctgaagctgctgtgcatgaagcccggcgacgcccccagcgagatctggagcagctacaccgagaaccccatgatcctgagcacccacaaggagtacggcatcttcgtgctgcagcccaaggaccccggcgtgctgagcttcctgagacagaaggagagcggcgagttcgaggagagactgaacttcgacatcaacctggagaaccccagcagaaccctgatcagcatcacccaggccaagcccgagagcgccctgatgggcagctacggcacctggcccaacgccgcccagaaggagaacggcccccaggtgacctgcggcagaaagaagaacacccccgagacccagacccccggcaccgaccccagcacctgcagagagagcgacgccagcatggacagcgacgccagcatggacagcgagcccaccccccacctgaagaccagacagagaagaaagatccacagcggcagcgtgaccgccctgcacgtgctgcccgagctgctggtgaccgccagcaaggacagagacgtgaagctgtgggagagacccagcatgcagctgctgggcctgttcagatgcgagggcagcgtgagctgcctggagccctggctgggcgccaacagcaccctgcagctggccgtgggcgacgtgcagggcaacgtgtacttcctgaactgggagtag

SEQ ID NO: 13114 - DNA, 2031 bp, Artificial Sequence
  Description of Artificial Sequence: Synthetic coding sequence
atgaagaaccagcagagcagcagcctgagcctggccgtgagcagcagccccaccgccgtggccttcagcaccaacggccagagagccgccgtgggcaccgccaacggcaccgtgtacctgctggacctgagaacctggcaggaggagaagagcgtggtgagcggctgcgacggcatcagcgcctgcctgttcctgagcgacgacaccctgttcctgaccgccttcgacggcctgctggagctgtgggacctgcagcacggctgcagagtgctgcagaccaaggcccaccagtaccagatcaccggctgctgcctgagccccgactgcagactgctggccaccgtgtgcctgggcggctgcctgaagctgtgggacaccgtgagaggccagctggccttccagcacacctaccccaagagcctgaactgcgtggccttccaccccgagggccaggtgatcgccaccggcagctgggccggcagcatcagcttcttccaggtggacggcctgaaggtgaccaaggacctgggcgcccccggcgccagcatcagaaccctggccttcaacgtgcccggcggcgtggtggccgtgggcagactggacagcatggtggagctgtgggcctggagagagggcgccagactggccgccttccccgcccaccacggcttcgtggccgccgccctgttcctgcacgccggctgccagctgctgaccgccggcgaggacggcaaggtgcaggtgtggagcggcagcctgggcagacccagaggccacctgggcagcctgagcctgagccccgccctgagcgtggccctgagccccgacggcgacagagtggccgtgggctacagagccgacggcatcagaatctacaagatcagcagcggcagccagggcgcccagggccaggccctggacgtggccgtgagcgccctggcctggctgagccccaaggtgctggtgagcggcgccgaggacggcagcctgcagggctgggccctgaaggagtgcagcctgcagagcctgtggctgctgagcagattccagaagcccgtgctgggcctggccaccagccaggagctgctggccagcgccagcgaggacttcaccgtgcagctgtggcccagacagctgctgaccagaccccacaaggccgaggacttcccctgcggcaccgagctgagaggccacgagggccccgtgagctgctgcagcttcagcaccgacggcggcagcctggccaccggcggcagagacagaagcctgctgtgctgggacgtgagaacccccaagacccccgtgctgatccacagcttccccgcctgccacagagactgggtgaccggctgcgcctggaccaaggacaacctgctgatcagctgcagcagcgacggcagcgtgggcctgtgggaccccgagagcggccagagactgggccagttcctgggccaccagagcgccgtgagcgccgtggccgccgtggaggagcacgtggtgagcgtgagcagagacggcaccctgaaggtgtgggaccaccagggcgtggagctgaccagcatccccgcccacagcggccccatcagccactgcgccgccgccatggagcccagagccgccggccagcccggcagcgagctgctggtggtgaccgtgggcctggacggcgccaccagactgtggcaccccctgctggtgtgccagacccacaccctgctgggccacagcggccccgtgagagccgccgccgtgagcgagaccagcggcctgatgctgaccgccagcgaggacggcagcgtgagactgtggcaggtgcccaaggaggccgacgacacctgcatccccagaagcagcgccgccgtgaccgccgtggcctgggcccccgacggcagcatggccgtgagcggcaaccaggccggcgagctgatcctgtggcaggaggccaaggccgtggccaccgcccagagcagccccgagcccaacagcaccggcggcctgagaggcgccgacaagagcggcctgggcagctag

SEQ ID NO: 13115 - DNA, 501 bp, Artificial Sequence
  Description of Artificial Sequence: Synthetic coding sequence
atggagaagctgcacggccacgtgagcgcccaccccgacatcctgagcctggagaacagatgcctggccatgctgcccgacctgcagcccctggagaagctgcaccagcacgtgagcacccacagcgacatcctgagcctgaagaaccagtgcctggccaccctgcccgacctgaagaccatggagaagccccacggctacgtgagcgcccaccccgacatcctgagcctggagaaccagtgcctggccaccctgagcgacctgaagaccatggagaagccccacggccacgtgagcgcccaccccgacatcctgagcctggagaacagatgcctggccaccctgagcagcctgaagagcaccgtgagcgccagccccctgttccagagcctgcagatcagccacatgacccaggccgacctgtacagagtgaacaacagcaactgcctgctgagcgagccccccagctggagagcccagcacttcagcaagggcctgtag

SEQ ID NO: 13116 - DNA, 1260 bp, Artificial Sequence
  Description of Artificial Sequence: Synthetic coding sequence
atggccgaggacgtgagcagcgccgcccccagccccagaggctgcgccgacggcagagacgccgaccccaccgaggagcagatggccgagaccgagagaaacgacgaggagcagttcgagtgccaggagctgctggagtgccaggtgcaggtgggcgcccccgaggaggaggaggaggaggaggaggacgccggcctggtggccgaggccgaggccgtggccgccggctggatgctggacttcctgtgcctgagcctgtgcagagccttcagagacggcagaagcgaggacttcagaagaaccagaaacagcgccgaggccatcatccacggcctgagcagcctgaccgcctgccagctgagaaccatctacatctgccagttcctgaccagaatcgccgccggcaagaccctggacgcccagttcgagaacgacgagagaatcacccccctggagagcgccctgatgatctggggcagcatcgagaaggagcacgacaagctgcacgaggagatccagaacctgatcaagatccaggccatcgccgtgtgcatggagaacggcaacttcaaggaggccgaggaggtgttcgagagaatcttcggcgaccccaacagccacatgcccttcaagagcaagctgctgatgatcatcagccagaaggacaccttccacagcttcttccagcacttcagctacaaccacatgatggagaagatcaagagctacgtgaactacgtgctgagcgagaagagcagcaccttcctgatgaaggccgccgccaaggtggtggagagcaagagaaccagaaccatcaccagccaggacaagcccagcggcaacgacgtggagatggagaccgaggccaacctggacaccagaaagagaagccacaagaacctgttcctgagcaagctgcagcacggcacccagcagcaggacctgaacaagaaggagagaagagtgggcaccccccagagcaccaagaagaagaaggagagcagaagagccaccgagagcagaatccccgtgagcaagagccagcccgtgacccccgagaagcacagagccagaaagagacaggcctggctgtgggaggaggacaagaacctgagaagcggcgtgagaaagtacggcgagggcaactggagcaagatcctgctgcactacaagttcaacaacagaaccagcgtgatgctgaaggacagatggagaaccatgaagaagctgaagctgatcagcagcgacagcgaggactag

SEQ ID NO: 13117 - DNA, 1320 bp, Artificial Sequence
  Description of Artificial Sequence: Synthetic coding sequence
atggccgaggacgtgagcagcgccgcccccagccccagaggctgcgccgacggcagagacgccgaccccaccgaggagcagatggccgagaccgagagaaacgacgaggagcagttcgagtgccaggagctgctggagtgccaggtgcaggtgggcgcccccgaggaggaggaggaggaggaggaggacgccggcctggtggccgaggccgaggccgtggccgccggctggatgctggacttcctgtgcctgagcctgtgcagagccttcagagacggcagaagcgaggacttcagaagaaccagaaacagcgccgaggccatcatccacggcctgagcagcctgaccgcctgccagctgagaaccatctacatctgccagttcctgaccagaatcgccgccggcaagaccctggacgcccagttcgagaacgacgagagaatcacccccctggagagcgccctgatgatctggggcagcatcgagaaggagcacgacaagctgcacgaggagatccagaacctgatcaagatccaggccatcgccgtgtgcatggagaacggcaacttcaaggaggccgaggaggtgttcgagagaatcttcggcgaccccaacagccacatgcccttcaagagcaagctgctgatgatcatcagccagaaggacaccttccacagcttcttccagcacttcagctacaaccacatgatggagaagatcaagagctacgtgaactacgtgctgagcgagaagagcagcaccttcctgatgaaggccgccgccaaggtggtggagagcaagagaaccagaaccatcaccagccaggacaagcccagcggcaacgacgtggagatggagaccgaggccaacctggacaccagaaagagcgtgagcgacaagcagagcgccgtgaccgagagcagcgagggcaccgtgagcctgctgagaagccacaagaacctgttcctgagcaagctgcagcacggcacccagcagcaggacctgaacaagaaggagagaagagtgggcaccccccagagcaccaagaagaagaaggagagcagaagagccaccgagagcagaatccccgtgagcaagagccagcccgtgacccccgagaagcacagagccagaaagagacaggcctggctgtgggaggaggacaagaacctgagaagcggcgtgagaaagtacggcgagggcaactggagcaagatcctgctgcactacaagttcaacaacagaaccagcgtgatgctgaaggacagatggagaaccatgaagaagctgaagctgatcagcagcgacagcgaggactag

SEQ ID NO: 13118 - DNA, 153 bp, Artificial Sequence
  Description of Artificial Sequence: Synthetic coding sequence
atcttcagcatcatccacggcctgagcagcctgaccgcctgccagctgagaaccatctacatctgccagttcctgaccagaatcgccgccggcaagaccctggacgcccagttcgagaacgacgagagaatcacccccctggagagcgcctag

SEQ ID NO: 13119 - DNA, 1503 bp, Artificial Sequence
  Description of Artificial Sequence: Synthetic coding sequence
atggccggcggcggcggcagcagcgacggcagcggcagagccgccggcagaagagccagcagaagcagcggcagagccagaagaggcagacacgagcccggcctgggcggccccgccgagagaggcgccggcgaggccagactggaggaggccgtgaacagatgggtgctgaagttctacttccacgaggccctgagagccttcagaggcagcagatacggcgacttcagacagatcagagacatcatgcaggccctgctggtgagacccctgggcaaggagcacaccgtgagcagactgctgagagtgatgcagtgcctgagcagaatcgaggagggcgagaacctggactgcagcttcgacatggaggccgagctgacccccctggagagcgccatcaacgtgctggagatgatcaagaccgagttcaccctgaccgaggccgtggtggagagcagcagaaagctggtgaaggaggccgccgtgatcatctgcatcaagaacaaggagttcgagaaggccagcaagatcctgaagaagcacatgagcaaggaccccaccacccagaagctgagaaacgacctgctgaacatcatcagagagaagaacctggcccaccccgtgatccagaacttcagctacgagaccttccagcagaagatgctgagattcctggagagccacctggacgacgccgagccctacctgctgaccatggccaagaaggccctgaagagcgagagcgccgccagcagcaccggcaaggaggacaagcagcccgcccccggccccgtggagaagccccccagagagcccgccagacagctgagaaacccccccaccaccatcggcatgatgaccctgaaggccgccttcaagaccctgagcggcgcccaggacagcgaggccgccttcgccaagctggaccagaaggacctggtgctgcccacccaggccctgcccgccagccccgccctgaagaacaagagacccagaaaggacgagaacgagagcagcgcccccgccgacggcgagggcggcagcgagctgcagcccaagaacaagagaatgaccatcagcagactggtgctggaggaggacagccagagcaccgagcccagcgccggcctgaacagcagccaggaggccgccagcgccccccccagcaagcccaccgtgctgaaccagcccctgcccggcgagaagaaccccaaggtgcccaagggcaagtggaacagcagcaacggcgtggaggagaaggagacctgggtggaggaggacgagctgttccaggtgcaggccgcccccgacgaggacagcaccaccaacatcaccaagaagcagaagtggaccgtggaggagagcgagtgggtgaaggccggcgtgcagaagtacggcgagggcaactgggccgccatcagcaagaactaccccttcgtgaacagaaccgccgtgatgatcaaggacagatggagaaccatgaagagactgggcatgaactag

SEQ ID NO: 13120 - DNA, 1200 bp, Artificial Sequence
  Description of Artificial Sequence: Synthetic coding sequence
atggccgaggccatggacctgggcaaggaccccaacggccccacccacagcagcaccctgttcgtgagagacgacggcagcagcatgagcttctacgtgagacccagccccgccaagagaagactgagcaccctgatcctgcacggcggcggcaccgtgtgcagagtgcaggagcccggcgccgtgctgctggcccagcccggcgaggccctggccgaggccagcggcgacttcatcagcacccagtacatcctggactgcgtggagagaaacgagagactggagctggaggcctacagactgggccccgccagcgccgccgacaccggcagcgaggccaagcccggcgccctggccgagggcgccgccgagcccgagccccagagacacgccggcagaatcgccttcaccgacgccgacgacgtggccatcctgacctacgtgaaggagaacgccagaagccccagcagcgtgaccggcaacgccctgtggaaggccatggagaagagcagcctgacccagcacagctggcagagcctgaaggacagatacctgaagcacctgagaggccaggagcacaagtacctgctgggcgacgcccccgtgagccccagcagccagaagctgaagagaaaggccgaggaggaccccgaggccgccgacagcggcgagccccagaacaagagaacccccgacctgcccgaggaggagtacgtgaaggaggagatccaggagaacgaggaggccgtgaagaagatgctggtggaggccaccagagagttcgaggaggtggtggtggacgagagcccccccgacttcgagatccacatcaccatgtgcgacgacgacccccccacccccgaggaggacagcgagacccagcccgacgaggaggaggaggaggaggaggagaaggtgagccagcccgaggtgggcgccgccatcaagatcatcagacagctgatggagaagttcaacctggacctgagcaccgtgacccaggccttcctgaagaacagcggcgagctggaggccaccagcgccttcctggccagcggccagagagccgacggctaccccatctggagcagacaggacgacatcgacctgcagaaggacgacgaggacaccagagaggccctggtgaagaagttcggcgcccagaacgtggccagaagaatcgagttcagaaagaagtag

SEQ ID NO: 13121 - DNA, 12735 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacaccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcacccccccccacctgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccggcccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgcccccgaggacgaggccgagaccacccaggccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgcccccaaggacgaggccgagaccacccaggccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccgtgccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacgtgcaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagaaccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 13122 - DNA, 12729 bp, Artificial Sequence
  Description of Artificial Sequence: Synthetic coding sequence
atgatgcccgcccagtacgccctgaccagcagcctggtgctgctggtgctgctgagcaccgccagagccggccccttcagcagcagaagcaacgtgaccctgcccgcccccagaccccccccccagcccggcggccacaccgtgggcgccggcgtgggcagccccagcagccagctgtacgagcacaccgtggagggcggcgagaagcaggtggtgttcacccacagaatcaacctgccccccagcaccggctgcggctgcccccccggcaccgagccccccgtgctggccagcgaggtgcaggccctgagagtgagactggagatcctggaggagctggtgaagggcctgaaggagcagtgcaccggcggctgctgccccgccagcgcccaggccggcaccggccagaccgacgtgagaaccctgtgcagcctgcacggcgtgttcgacctgagcagatgcacctgcagctgcgagcccggctggggcggccccacctgcagcgaccccaccgacgccgagatcccccccagcagcccccccagcgccagcggcagctgccccgacgactgcaacgaccagggcagatgcgtgagaggcagatgcgtgtgcttccccggctacaccggccccagctgcggctggcccagctgccccggcgactgccagggcagaggcagatgcgtgcagggcgtgtgcgtgtgcagagccggcttcagcggccccgactgcagccagagaagctgccccagaggctgcagccagagaggcagatgcgagggcggcagatgcgtgtgcgaccccggctacaccggcgacgactgcggcatgagaagctgccccagaggctgcagccagagaggcagatgcgagaacggcagatgcgtgtgcaaccccggctacaccggcgaggactgcggcgtgagaagctgccccagaggctgcagccagagaggcagatgcaaggacggcagatgcgtgtgcgaccccggctacaccggcgaggactgcggcaccagaagctgcccctgggactgcggcgagggcggcagatgcgtggacggcagatgcgtgtgctggcccggctacaccggcgaggactgcagcaccagaacctgccccagagactgcagaggcagaggcagatgcgaggacggcgagtgcatctgcgacaccggctacagcggcgacgactgcggcgtgagaagctgccccggcgactgcaaccagagaggcagatgcgaggacggcagatgcgtgtgctggcccggctacaccggcaccgactgcggcagcagagcctgccccagagactgcagaggcagaggcagatgcgagaacggcgtgtgcgtgtgcaacgccggctacagcggcgaggactgcggcgtgagaagctgccccggcgactgcagaggcagaggcagatgcgagagcggcagatgcatgtgctggcccggctacaccggcagagactgcggcaccagagcctgccccggcgactgcagaggcagaggcagatgcgtggacggcagatgcgtgtgcaaccccggcttcaccggcgaggactgcggcagcagaagatgccccggcgactgcagaggccacggcctgtgcgaggacggcgtgtgcgtgtgcgacgccggctacagcggcgaggactgcagcaccagaagctgccccggcggctgcagaggcagaggccagtgcctggacggcagatgcgtgtgcgaggacggctacagcggcgaggactgcggcgtgagacagtgccccaacgactgcagccagcacggcgtgtgccaggacggcgtgtgcatctgctgggagggctacgtgagcgaggactgcagcatcagaacctgccccagcaactgccacggcagaggcagatgcgaggagggcagatgcctgtgcgaccccggctacaccggccccacctgcgccaccagaatgtgccccgccgactgcagaggcagaggcagatgcgtgcagggcgtgtgcctgtgccacgtgggctacggcggcgaggactgcggccaggaggagccccccgccagcgcctgccccggcggctgcggccccagagagctgtgcagagccggccagtgcgtgtgcgtggagggcttcagaggccccgactgcgccatccagacctgccccggcgactgcagaggcagaggcgagtgccacgacggcagctgcgtgtgcaaggacggctacgccggcgaggactgcggcgaggaggtgcccaccatcgagggcatgagaatgcacctgctggaggagaccaccgtgagaaccgagtggacccccgcccccggccccgtggacgcctacgagatccagttcatccccaccaccgagggcgccagcccccccttcaccgccagagtgcccagcagcgccagcgcctacgaccagagaggcctggcccccggccaggagtaccaggtgaccgtgagagccctgagaggcaccagctggggcctgcccgccagcaagaccatcaccaccatgatcgacggcccccaggacctgagagtggtggccgtgacccccaccaccctggagctgggctggctgagaccccaggccgaggtggacagattcgtggtgagctacgtgagcgccggcaaccagagagtgagactggaggtgccccccgaggccgacggcaccctgctgaccgacctgatgcccggcgtggagtacgtggtgaccgtgaccgccgagagaggcagagccgtgagctaccccgccagcgtgagagccaacaccggcagcagccccctgggcctgctgggcaccaccgacgagcccccccccagcggccccagcaccacccagggcgcccaggcccccctgctgcagcagagaccccaggagctgggcgagctgagagtgctgggcagagacgagaccggcagactgagagtggtgtggaccgcccagcccgacaccttcgcctacttccagctgagaatgagagtgcccgagggccccggcgcccacgaggaggtgctgcccggcgacgtgagacaggccctggtgcccccccccccccccggcaccccctacgagctgagcctgcacggcgtgccccccggcggcaagcccagcgaccccatcatctaccagggcatcatggacaaggacgaggagaagcccggcaagagcagcggcccccccagactgggcgagctgaccgtgaccgacagaaccagcgacagcctgctgctgagatggaccgtgcccgagggcgagttcgacagcttcgtgatccagtacaaggacagagacggccagccccaggtggtgcccgtggagggcccccagagaagcgccgtgatcaccagcctggaccccggcagaaagtacaagttcgtgctgtacggcttcgtgggcaagaagagacacggccccctggtggccgaggccaagatcctgccccagagcgaccccagccccggcacccccccccacctgggcaacctgtgggtgaccgaccccacccccgacagcctgcacctgagctggaccgtgcccgagggccagttcgacaccttcatggtgcagtacagagacagagacggcagaccccaggtggtgcccgtggagggccccgagagaagcttcgtggtgagcagcctggaccccgaccacaagtacagattcaccctgttcggcatcgccaacaagaagagatacggccccctgaccgccgacggcaccaccgcccccgagagaaaggaggagccccccagacccgagttcctggagcagcccctgctgggcgagctgaccgtgaccggcgtgacccccgacagcctgagactgagctggaccgtggcccagggccccttcgacagcttcatggtgcagtacaaggacgcccagggccagccccaggccgtgcccgtggccggcgacgagaacgaggtgaccgtgcccggcctggaccccgacagaaagtacaagatgaacctgtacggcctgagaggcagacagagagtgggccccgagagcgtggtggccaagaccgccccccaggaggacgtggacgagacccccagccccaccgagctgggcaccgaggcccccgagagccccgaggagcccctgctgggcgagctgaccgtgaccggcagcagccccgacagcctgagcctgttctggaccgtgccccagggcagcttcgacagcttcaccgtgcagtacaaggacagagacggcagacccagagccgtgagagtgggcggcaaggagagcgaggtgaccgtgggcggcctggagcccggccacaagtacaagatgcacctgtacggcctgcacgagggccagagagtgggccccgtgagcgccgtgggcgtgaccgccccccagcaggaggagaccccccccgccaccgagagccccctggagcccagactgggcgagctgaccgtgaccgacgtgacccccaacagcgtgggcctgagctggaccgtgcccgagggccagttcgacagcttcatcgtgcagtacaaggacaaggacggccagccccaggtggtgcccgtggccgccgaccagagagaggtgaccgtgtacaacctggagcccgagagaaagtacaagatgaacatgtacggcctgcacgacggccagagaatgggccccctgagcgtggtgatcgtgaccgcccccctgccccccgcccccgccaccgaggccagcaagccccccctggagcccagactgggcgagctgaccgtgaccgacatcacccccgacagcgtgggcctgagctggaccgtgcccgagggcgagttcgacagcttcgtggtgcagtacaaggacagagacggccagccccaggtggtgcccgtggccgccgaccagagagaggtgaccatccccgacctggagcccagcagaaagtacaagttcctgctgttcggcatccaggacggcaagagaagaagccccgtgagcgtggaggccaagaccgtggccagaggcgacgccagccccggcgccccccccagactgggcgagctgtgggtgaccgaccccacccccgacagcctgagactgagctggaccgtgcccgagggccagttcgacagcttcgtggtgcagttcaaggacaaggacggcccccaggtggtgcccgtggagggccacgagagaagcgtgaccgtgacccccctggacgccggcagaaagtacagattcctgctgtacggcctgctgggcaagaagagacacggccccctgaccgccgacggcaccaccgaggccagaagcgccatggacgacaccggcaccaagagaccccccaagcccagactgggcgaggagctgcaggtgaccaccgtgacccagaacagcgtgggcctgagctggaccgtgcccgagggccagttcgacagcttcgtggtgcagtacaaggacagagacggccagccccaggtggtgcccgtggagggcagcctgagagaggtgagcgtgcccggcctggaccccgcccacagatacaagctgctgctgtacggcctgcaccacggcaagagagtgggccccatcagcgccgtggccatcaccgccggcagagaggagaccgagaccgagaccaccgcccccaccccccccgcccccgagccccacctgggcgagctgaccgtggaggaggccaccagccacaccctgcacctgagctggatggtgaccgagggcgagttcgacagcttcgagatccagtacaccgacagagacggccagctgcagatggtgagaatcggcggcgacagaaacgacatcaccctgagcggcctggagagcgaccacagatacctggtgaccctgtacggcttcagcgacggcaagcacgtgggccccgtgcacgtggaggccctgaccgtgcccgaggaggagaagcccagcgagccccccaccgccacccccgagccccccatcaagcccagactgggcgagctgaccgtgaccgacgccacccccgacagcctgagcctgagctggaccgtgcccgagggccagttcgaccacttcctggtgcagtacagaaacggcgacggccagcccaaggccgtgagagtgcccggccacgaggagggcgtgaccatcagcggcctggagcccgaccacaagtacaagatgaacctgtacggcttccacggcggccagagaatgggccccgtgagcgtggtgggcgtgaccgccgccgaggaggagacccccagccccaccgagcccagcatggaggcccccgagcccgccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcgccgtgggcgtgaccgcccccgaggaggagagccccgacgcccccctggccaagctgagactgggccagatgaccgtgagagacatcaccagcgacagcctgagcctgagctggaccgtgcccgagggccagttcgaccacttcctggtgcagttcaagaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccgtgggcctgaccgcccccggcaaggacgaggagatggcccccgccagcaccgagccccccacccccgagccccccatcaagcccagactggaggagctgaccgtgaccgacgccacccccgacagcctgagcctgagctggaccgtgcccgagggccagttcgaccacttcctggtgcagtacaagaacggcgacggccagcccaaggccaccagagtgcccggccacgaggacagagtgaccatcagcggcctggagcccgacaacaagtacaagatgaacctgtacggcttccacggcggccagagagtgggccccgtgagcgccatcggcgtgaccgccgccgaggaggagacccccagccccaccgagcccagcatggaggcccccgagccccccgaggagcccctgctgggcgagctgaccgtgaccggcagcagccccgacagcctgagcctgagctggaccgtgccccagggcagattcgacagcttcaccgtgcagtacaaggacagagacggcagaccccaggtggtgagagtgggcggcgaggagagcgaggtgaccgtgggcggcctggagcccggcagaaagtacaagatgcacctgtacggcctgcacgagggcagaagagtgggccccgtgagcaccgtgggcgtgaccgccccccaggaggacgtggacgagacccccagccccaccgagcccggcaccgaggcccccggcccccccgaggagcccctgctgggcgagctgaccgtgaccggcagcagccccgacagcctgagcctgagctggaccgtgccccagggcagattcgacagcttcaccgtgcagtacaaggacagagacggcagaccccaggccgtgagagtgggcggccaggagagcaaggtgaccgtgagaggcctggagcccggcagaaagtacaagatgcacctgtacggcctgcacgagggcagaagactgggccccgtgagcgccgtgggcgtgaccgaggacgaggccgagaccacccaggccgtgcccaccatgacccccgagccccccatcaagcccagactgggcgagctgaccatgaccgacgccacccccgacagcctgagcctgagctggaccgtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccagccccaccgagctgagcaccgaggcccccgagccccccgaggagcccctgctgggcgagctgaccgtgaccggcagcagccccgacagcctgagcctgagctggaccatcccccagggccacttcgacagcttcaccgtgcagtacaaggacagagacggcagaccccaggtgatgagagtgagaggcgaggagagcgaggtgaccgtgggcggcctggagcccggcagaaagtacaagatgcacctgtacggcctgcacgagggcagaagagtgggccccgtgagcaccgtgggcgtgaccgaggacgaggccgagaccacccaggccgtgcccaccaccacccccgagccccccaacaagcccagactgggcgagctgaccgtgaccgacgccacccccgacagcctgagcctgagctggatggtgcccgagggccagttcgaccacttcctggtgcagtacagaaacggcgacggccagcccaaggtggtgagagtgcccggccacgaggacggcgtgaccatcagcggcctggagcccgaccacaagtacaagatgaacctgtacggcttccacggcggccagagagtgggccccatcagcgtgatcggcgtgaccgccgccgaggaggagacccccgcccccaccgagcccagcaccgaggcccccgagccccccgaggagcccctgctgggcgagctgaccgtgaccggcagcagccccgacagcctgagcctgagctggaccatcccccagggcagattcgacagcttcaccgtgcagtacaaggacagagacggcagaccccaggtggtgagagtgagaggcgaggagagcgaggtgaccgtgggcggcctggagcccggctgcaagtacaagatgcacctgtacggcctgcacgagggccagagagtgggccccgtgagcgccgtgggcgtgaccgcccccaaggacgaggccgagaccacccaggccgtgcccaccatgacccccgagccccccatcaagcccagactgggcgagctgaccgtgaccgacgccacccccgacagcctgagcctgagctggatggtgcccgagggccagttcgaccacttcctggtgcagtacagaaacggcgacggccagcccaaggccgtgagagtgcccggccacgaggacggcgtgaccatcagcggcctggagcccgaccacaagtacaagatgaacctgtacggcttccacggcggccagagagtgggccccgtgagcgccatcggcgtgaccgaggaggagacccccagccccaccgagcccagcaccgaggcccccgaggcccccgaggagcccctgctgggcgagctgaccgtgaccggcagcagccccgacagcctgagcctgagctggaccgtgccccagggcagattcgacagcttcaccgtgcagtacaaggacagagacggccagccccaggtggtgagagtgagaggcgaggagagcgaggtgaccgtgggcggcctggagcccggcagaaagtacaagatgcacctgtacggcctgcacgagggccagagagtgggccccgtgagcaccgtgggcatcaccgcccccctgcccacccccctgcccgtggagcccagactgggcgagctggccgtggccgccgtgaccagcgacagcgtgggcctgagctggaccgtggcccagggccccttcgacagcttcctggtgcagtacagagacgcccagggccagccccaggccgtgcccgtgagcggcgacctgagagccgtggccgtgagcggcctggaccccgccagaaagtacaagttcctgctgttcggcctgcagaacggcaagagacacggccccgtgcccgtggaggccagaaccgcccccgacaccaagcccagccccagactgggcgagctgaccgtgaccgacgccacccccgacagcgtgggcctgagctggaccgtgcccgagggcgagttcgacagcttcgtggtgcagtacaaggacaaggacggcagactgcaggtggtgcccgtggccgccaaccagagagaggtgaccgtgcagggcctggagcccagcagaaagtacagattcctgctgtacggcctgagcggcagaaagagactgggccccatcagcgccgacagcaccaccgcccccctggagaaggagctgcccccccacctgggcgagctgaccgtggccgaggagaccagcagcagcctgagactgagctggaccgtggcccagggccccttcgacagcttcgtggtgcagtacagagacaccgacggccagcccagagccgtgcccgtggccgccgaccagagaaccgtgaccgtggaggacctggagcccggcaagaagtacaagttcctgctgtacggcctgctgggcggcaagagactgggccccgtgagcgccctgggcatgaccgcccccgaggaggacacccccgcccccgagctggcccccgaggcccccgagccccccgaggagcccagactgggcgtgctgaccgtgaccgacaccacccccgacagcatgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacgtgcaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagaaccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 13123 - DNA, 2022 bp, Artificial Sequence
  Description of Artificial Sequence: Synthetic coding sequence
atgagactgagctggagcgtggcccagggccccttcgacagcttcgtggtgcagtacgaggacaccaacggccagccccaggccctgctggtggacggcgaccagagcaagatcctgatcagcggcctggagcccagcaccccctacagattcctgctgtacggcctgcacgagggcaagagactgggccccctgagcgccgagggcaccaccggcctggcccccgccggccagaccagcgaggagagcagacccagactgagccagctgagcgtgaccgacgtgaccaccagcagcctgagactgaactgggaggccccccccggcgccttcgacagcttcctgctgagattcggcgtgcccagccccagcaccctggagccccaccccagacccctgctgcagagagagctgatggtgcccggcaccagacacagcgccgtgctgagagacctgagaagcggcaccctgtacagcctgaccctgtacggcctgagaggcccccacaaggccgacagcatccagggcaccgccagaaccctgagccccgtgctggagagccccagagacctgcagttcagcgagatcagagagaccagcgccaaggtgaactggatgcccccccccagcagagccgacagcttcaaggtgagctaccagctggccgacggcggcgagccccagagcgtgcaggtggacggccaggccagaacccagaagctgcagggcctgatccccggcgccagatacgaggtgaccgtggtgagcgtgagaggcttcgaggagagcgagcccctgaccggcttcctgaccaccgtgcccgacggccccacccagctgagagccctgaacctgaccgagggcttcgccgtgctgcactggaagcccccccagaaccccgtggacacctacgacgtgcaggtgaccgcccccggcgccccccccctgcaggccgagacccccggcagcgccgtggactaccccctgcacgacctggtgctgcacaccaactacaccgccaccgtgagaggcctgagaggccccaacctgaccagccccgccagcatcaccttcaccaccggcctggaggcccccagagacctggaggccaaggaggtgacccccagaaccgccctgctgacctggaccgagccccccgtgagacccgccggctacctgctgagcttccacacccccggcggccagaaccaggagatcctgctgcccggcggcatcaccagccaccagctgctgggcctgttccccagcaccagctacaacgccagactgcaggccatgtggggccagagcctgctgccccccgtgagcaccagcttcaccaccggcggcctgagaatccccttccccagagactgcggcgaggagatgcagaacggcgccggcgccagcagaaccagcaccatcttcctgaacggcaacagagagagacccctgaacgtgttctgcgacatggagaccgacggcggcggctggctggtgttccagagaagaatggacggccagaccgacttctggagagactgggaggactacgcccacggcttcggcaacatcagcggcgagttctggctgggcaacgaggccctgcacagcctgacccaggccggcgactacagcatgagagtggacctgagagccggcgacgaggccgtgttcgcccagtacgacagcttccacgtggacagcgccgccgagtactacagactgcacctggagggctaccacggcaccgccggcgacagcatgagctaccacagcggcagcgtgttcagcgccagagacagagaccccaacagcctgctgatcagctgcgccgtgagctacagaggcgcctggtggtacagaaactgccactacgccaacctgaacggcctgtacggcagcaccgtggaccaccagggcgtgagctggtaccactggaagggcttcgagttcagcgtgcccttcaccgagatgaagctgagacccagaaacttcagaagccccgccggcggcggctag

SEQ ID NO: 13124 - DNA, 954 bp, Artificial Sequence
  Description of Artificial Sequence: Synthetic coding sequence
atggccaagaacccccccgagaactgcgaggactgccacatcctgaacgccgaggccttcaagagcaagaagatctgcaagagcctgaagatctgcggcctggtgttcggcatcctggccctgaccctgatcgtgctgttctggggcagcaagcacttctggcccgaggtgcccaagaaggcctacgacatggagcacaccttctacagcaacggcgagaagaagaagatctacatggagatcgaccccgtgaccagaaccgagatcttcagaagcggcaacggcaccgacgagaccctggaggtgcacgacttcaagaacggctacaccggcatctacttcgtgggcctgcagaagtgcttcatcaagacccagatcaaggtgatccccgagttcagcgagcccgaggaggagatcgacgagaacgaggagatcaccaccaccttcttcgagcagagcgtgatctgggtgcccgccgagaagcccatcgagaacagagacttcctgaagaacagcaagatcctggagatctgcgacaacgtgaccatgtactggatcaaccccaccctgatcagcgtgagcgagctgcaggacttcgaggaggagggcgaggacctgcacttccccgccaacgagaagaagggcatcgagcagaacgagcagtgggtggtgccccaggtgaaggtggagaagaccagacacgccagacaggccagcgaggaggagctgcccatcaacgactacaccgagaacggcatcgagttcgaccccatgctggacgagagaggctactgctgcatctactgcagaagaggcaacagatactgcagaagagtgtgcgagcccctgctgggctactacccctacccctactgctaccagggcggcagagtgatctgcagagtgatcatgccctgcaactggtgggtggccagaatgctgggcagagtgtag

SEQ ID NO: 13125 - DNA, 1356 bp, Artificial Sequence
  Description of Artificial Sequence: Synthetic coding sequence
atggccacccccctggtggccggccccgccgccctgagattcgccgccgccgccagctggcaggtggtgagaggcagatgcgtggagcacttccccagagtgctggagttcctgagaagcctgagagccgtggcccccggcctggtgagatacagacaccacgagagactgtgcatgggcctgaaggccaaggtggtggtggagctgatcctgcagggcagaccctgggcccaggtgctgaaggccctgaaccaccacttccccgagagcggccccatcgtgagagaccccaaggccaccaagcaggacctgagaaagatcctggaggcccaggagaccttctaccagcaggtgaagcagctgagcgaggcccccgtggacctggccagcaagctgcaggagctggagcaggagtacggcgagcccttcctggccgccatggagaagctgctgttcgagtacctgtgccagctggagaaggccctgcccaccccccaggcccagcagctgcaggacgtgctgagctggatgcagcccggcgtgagcatcaccagcagcctggcctggagacagtacggcgtggacatgggctggctgctgcccgagtgcagcgtgaccgacagcgtgaacctggccgagcccatggagcagaaccccccccagcagcagagactggccctgcacaaccccctgcccaaggccaagcccggcacccacctgccccagggccccagcagcagaacccaccccgagcccctggccggcagacacttcaacctggcccccctgggcagaagaagagtgcagagccagtgggccagcaccagaggcggccacaaggagagacccaccgtgatgctgttccccttcagaaacctgggcagccccacccaggtgatcagcaagcccgagagcaaggaggagcacgccatctacaccgccgacctggccatgggcaccagagccgccagcaccggcaagagcaagagcccctgccagaccctgggcggcagagccctgaaggagaaccccgtggacctgcccgccaccgagcagaaggagaactgcctggactgctacatggaccccctgagactgagcctgctgccccccagagccagaaagcccgtgtgcccccccagcctgtgcagcagcgtgatcaccatcggcgacctggtgctggacagcgacgaggaggagaacggccagggcgagggcaaggagagcctggagaactaccagaagaccaagttcgacaccctgatccccaccctgtgcgagtacctgccccccagcggccacggcgccatccccgtgagcagctgcgactgcagagacagcagcagacccctgtag

SEQ ID NO: 13126 - DNA, 1065 bp, Artificial Sequence
  Description of Artificial Sequence: Synthetic coding sequence
atggccacccccctggtggccggccccgccgccctgagattcgccgccgccgccagctggcaggtggtgagaggcagatgcgtggagcacttccccagagtgctggagttcctgagaagcctgagagccgtggcccccggcctggtgagatacagacaccacgagagactgtgcatgggcctgaaggccaaggtggtggtggagctgatcctgcagggcagaccctgggcccaggtgctgaaggccctgaaccaccacttccccgagagcggccccatcgtgagagaccccaaggccaccaagcaggacctgagaaagatcctggaggcccaggagaccttctaccagcaggtgaagcagctgagcgaggcccccgtggacctggccagcaagctgcaggagctggagcaggagtacggcgagcccttcctggccgccatggagaagctgctgttcgagtacctgtgccagctggagaaggccctgcccaccccccaggcccagcagctgcaggacgtgctgagctggatgcagcccggcgtgagcatcaccagcagcctggcctggagacagtacggcgtggacatgggctggctgctgcccgagtgcagcgtgaccgacagcgtgaacctggccgagcccatggagcagaaccccccccagcagcagagactggccctgcacaaccccctgcccaaggccaagcccggcacccacctgccccagggccccagcagcagaacccaccccgagcccctggccggcagacacttcaacctggcccccctgggcagaagaagagtgcagagccagtgggccagcaccagaggcggccacaaggagagacccaccgtgatgctgttccccttcagaaacctgggcagccccacccaggtgatcagcaagcccgagagcaaggaggagcacgccatctacaccgccgacctggccatgggcaccagagccgccagcaccggcaagagcaagagcccctgccagaccctgggcggcagagccctgaaggagaaccccgtggacctgcccgccaccgagcagaaggagtag

SEQ ID NO: 13127 - DNA, 423 bp, Artificial Sequence
  Description of Artificial Sequence: Synthetic coding sequence
atggagcagaaccccccccagcagcagagactggccctgcacaaccccctgcccaaggccaagcccggcacccacctgccccagggccccagcagcagaacccaccccgagcccctggccggcagacacttcaacctggcccccctgggcagaagaagagtgcagagccagtgggccagcaccagaggcggccacaaggagagacccaccgtgatgctgttccccttcagaaacctgggcagccccacccaggtgatcagcaagcccgagagcaaggaggagcacgccatctacaccgccgacctggccatgggcaccagagccgccagcaccggcaagagcaagagcccctgccagaccctgggcggcagagccctgaaggagaaccccgtggacctgcccgccaccgagcagaaggagtag

SEQ ID NO: 13128 - DNA, 1251 bp, Artificial Sequence
  Description of Artificial Sequence: Synthetic coding sequence
atggccacccccctggtggccggccccgccgccctgagattcgccgccgccgccagctggcaggtggtgagaggcagatgcgtggagcacttccccagagtgctggagttcctgagaagcctgagagccgtggcccccggcctggtgagatacagacaccacgagagactgtgcatgggcctgaaggccaagaccaagcaggacctgagaaagatcctggaggcccaggagaccttctaccagcaggtgaagcagctgagcgaggcccccgtggacctggccagcaagctgcaggagctggagcaggagtacggcgagcccttcctggccgccatggagaagctgctgttcgagtacctgtgccagctggagaaggccctgcccaccccccaggcccagcagctgcaggacgtgctgagctggatgcagcccggcgtgagcatcaccagcagcctggcctggagacagtacggcgtggacatgggctggctgctgcccgagtgcagcgtgaccgacagcgtgaacctggccgagcccatggagcagaaccccccccagcagcagagactggccctgcacaaccccctgcccaaggccaagcccggcacccacctgccccagggccccagcagcagaacccaccccgagcccctggccggcagacacttcaacctggcccccctgggcagaagaagagtgcagagccagtgggccagcaccagaggcggccacaaggagagacccaccgtgatgctgttccccttcagaaacctgggcagccccacccaggtgatcagcaagcccgagagcaaggaggagcacgccatctacaccgccgacctggccatgggcaccagagccgccagcaccggcaagagcaagagcccctgccagaccctgggcggcagagccctgaaggagaaccccgtggacctgcccgccaccgagcagaaggagaactgcctggactgctacatggaccccctgagactgagcctgctgccccccagagccagaaagcccgtgtgcccccccagcctgtgcagcagcgtgatcaccatcggcgacctggtgctggacagcgacgaggaggagaacggccagggcgagggcaaggagagcctggagaactaccagaagaccaagttcgacaccctgatccccaccctgtgcgagtacctgccccccagcggccacggcgccatccccgtgagcagctgcgactgcagagacagcagcagacccctgtag

SEQ ID NO: 13129 - DNA, 3498 bp, Artificial Sequence
  Description of Artificial Sequence: Synthetic coding sequence
atggagcaggacagaaccaaccacgtggagggcaacagactgagccccttcctgatccccagcccccccatctgccagaccgagcccctggccaccaagctgcagaacggcagccccctgcccgagagagcccaccccgaggtgaacggcgacaccaagtggcacagcttcaagagctactacggcatcccctgcatgaagggcagccagaacagcagagtgagccccgacttcacccaggagagcagaggctacagcaagtgcctgcagaacggcggcatcaagagaaccgtgagcgagcccagcctgagcggcctgctgcagatcaagaagctgaagcaggaccagaaggccaacggcgagagaagaaacttcggcgtgagccaggagagaaaccccggcgagagcagccagcccaacgtgagcgacctgagcgacaagaaggagagcgtgagcagcgtggcccaggagaacgccgtgaaggacttcaccagcttcagcacccacaactgcagcggccccgagaaccccgagctgcagatcctgaacgagcaggagggcaagagcgccaactaccacgacaagaacatcgtgctgctgaagaacaaggccgtgctgatgcccaacggcgccaccgtgagcgccagcagcgtggagcacacccacggcgagctgctggagaagaccctgagccagtactaccccgactgcgtgagcatcgccgtgcagaagaccaccagccacatcaacgccatcaacagccaggccaccaacgagctgagctgcgagatcacccaccccagccacaccagcggccagatcaacagcgcccagaccagcaacagcgagctgccccccaagcccgccgccgtggtgagcgaggcctgcgacgccgacgacgccgacaacgccagcaagctggccgccatgctgaacacctgcagcttccagaagcccgagcagctgcagcagcagaagagcgtgttcgagatctgccccagccccgccgagaacaacatccagggcaccaccaagctggccagcggcgaggagttctgcagcggcagcagcagcaacctgcaggcccccggcggcagcagcgagagatacctgaagcagaacgagatgaacggcgcctacttcaagcagagcagcgtgttcaccaaggacagcttcagcgccaccaccaccccccccccccccagccagctgctgctgagcccccccccccccctgccccaggtgccccagctgcccagcgagggcaagagcaccctgaacggcggcgtgctggaggagcaccaccactaccccaaccagagcaacaccaccctgctgagagaggtgaagatcgagggcaagcccgaggccccccccagccagagccccaaccccagcacccacgtgtgcagccccagccccatgctgagcgagagaccccagaacaactgcgtgaacagaaacgacatccagaccgccggcaccatgaccgtgcccctgtgcagcgagaagaccagacccatgagcgagcacctgaagcacaacccccccatcttcggcagcagcggcgagctgcaggacaactgccagcagctgatgagaaacaaggagcaggagatcctgaagggcagagacaaggagcagaccagagacctggtgccccccacccagcactacctgaagcccggctggatcgagctgaaggcccccagattccaccaggccgagagccacctgaagagaaacgaggccagcctgcccagcatcctgcagtaccagcccaacctgagcaaccagatgaccagcaagcagtacaccggcaacagcaacatgcccggcggcctgcccagacaggcctacacccagaagaccacccagctggagcacaagagccagatgtaccaggtggagatgaaccagggccagagccagggcaccgtggaccagcacctgcagttccagaagcccagccaccaggtgcacttcagcaagaccgaccacctgcccaaggcccacgtgcagagcctgtgcggcaccagattccacttccagcagagagccgacagccagaccgagaagctgatgagccccgtgctgaagcagcacctgaaccagcaggccagcgagaccgagcccttcagcaacagccacctgctgcagcacaagccccacaagcaggccgcccagacccagcccagccagagcagccacctgccccagaaccagcagcagcagcagaagctgcagatcaagaacaaggaggagatcctgcagaccttcccccacccccagagcaacaacgaccagcagagagagggcagcttcttcggccagaccaaggtggaggagtgcttccacggcgagaaccagtacagcaagagcagcgagttcgagacccacaacgtgcagatgggcctggaggaggtgcagaacatcaacagaagaaacagcccctacagccagaccatgaagagcagcgcctgcaagatccaggtgagctgcagcaacaacacccacctggtgagcgagaacaaggagcagaccacccaccccgagctgttcgccggcaacaagacccagaacctgcaccacatgcagtacttccccaacaacgtgatccccaagcaggacctgctgcacagatgcttccaggagcaggagcagaagagccagcaggccagcgtgctgcagggctacaagaacagaaaccaggacatgagcggccagcaggccgcccagctggcccagcagagatacctgatccacaaccacgccaacgtgttccccgtgcccgaccagggcggcagccacacccagacccccccccagaaggacacccagaagcacgccgccctgagatggcacctgctgcagaagcaggagcagcagcagacccagcagccccagaccgagagctgccacagccagatgcacagacccatcaaggtggagcccggctgcaagccccacgcctgcatgcacaccgccccccccgagaacaagacctggaagaaggtgaccaagcaggagaacccccccgccagctgcgacaacgtgcagcagaagagcatcatcgagaccatggagcagcacctgaagcagttccacgccaagagcctgttcgaccacaaggccctgaccctgaagagccagaagcaggtgaaggtggagatgagcggccccgtgaccgtgctgaccagacagaccaccgccgccgagctggacagccacacccccgccctggagcagcagaccaccagcagcgagaagacccccaccaagagaaccgccgccagcgtgctgaacaacttcatcgagagccccagcaagctgctggacacccccatcaagaacctgctggacacccccgtgaagacccagtacgacttccccagctgcagatgcgtgggcaagtgccagaagtgcaccgagacccacggcgtgtaccccgagctggccaacctgagcagcgacatgggcttcagcttcttcttctag

SEQ ID NO: 13130 - DNA, 6009 bp, Artificial Sequence
  Description of Artificial Sequence: Synthetic coding sequence
atggagcaggacagaaccaaccacgtggagggcaacagactgagccccttcctgatccccagcccccccatctgccagaccgagcccctggccaccaagctgcagaacggcagccccctgcccgagagagcccaccccgaggtgaacggcgacaccaagtggcacagcttcaagagctactacggcatcccctgcatgaagggcagccagaacagcagagtgagccccgacttcacccaggagagcagaggctacagcaagtgcctgcagaacggcggcatcaagagaaccgtgagcgagcccagcctgagcggcctgctgcagatcaagaagctgaagcaggaccagaaggccaacggcgagagaagaaacttcggcgtgagccaggagagaaaccccggcgagagcagccagcccaacgtgagcgacctgagcgacaagaaggagagcgtgagcagcgtggcccaggagaacgccgtgaaggacttcaccagcttcagcacccacaactgcagcggccccgagaaccccgagctgcagatcctgaacgagcaggagggcaagagcgccaactaccacgacaagaacatcgtgctgctgaagaacaaggccgtgctgatgcccaacggcgccaccgtgagcgccagcagcgtggagcacacccacggcgagctgctggagaagaccctgagccagtactaccccgactgcgtgagcatcgccgtgcagaagaccaccagccacatcaacgccatcaacagccaggccaccaacgagctgagctgcgagatcacccaccccagccacaccagcggccagatcaacagcgcccagaccagcaacagcgagctgccccccaagcccgccgccgtggtgagcgaggcctgcgacgccgacgacgccgacaacgccagcaagctggccgccatgctgaacacctgcagcttccagaagcccgagcagctgcagcagcagaagagcgtgttcgagatctgccccagccccgccgagaacaacatccagggcaccaccaagctggccagcggcgaggagttctgcagcggcagcagcagcaacctgcaggcccccggcggcagcagcgagagatacctgaagcagaacgagatgaacggcgcctacttcaagcagagcagcgtgttcaccaaggacagcttcagcgccaccaccaccccccccccccccagccagctgctgctgagcccccccccccccctgccccaggtgccccagctgcccagcgagggcaagagcaccctgaacggcggcgtgctggaggagcaccaccactaccccaaccagagcaacaccaccctgctgagagaggtgaagatcgagggcaagcccgaggccccccccagccagagccccaaccccagcacccacgtgtgcagccccagccccatgctgagcgagagaccccagaacaactgcgtgaacagaaacgacatccagaccgccggcaccatgaccgtgcccctgtgcagcgagaagaccagacccatgagcgagcacctgaagcacaacccccccatcttcggcagcagcggcgagctgcaggacaactgccagcagctgatgagaaacaaggagcaggagatcctgaagggcagagacaaggagcagaccagagacctggtgccccccacccagcactacctgaagcccggctggatcgagctgaaggcccccagattccaccaggccgagagccacctgaagagaaacgaggccagcctgcccagcatcctgcagtaccagcccaacctgagcaaccagatgaccagcaagcagtacaccggcaacagcaacatgcccggcggcctgcccagacaggcctacacccagaagaccacccagctggagcacaagagccagatgtaccaggtggagatgaaccagggccagagccagggcaccgtggaccagcacctgcagttccagaagcccagccaccaggtgcacttcagcaagaccgaccacctgcccaaggcccacgtgcagagcctgtgcggcaccagattccacttccagcagagagccgacagccagaccgagaagctgatgagccccgtgctgaagcagcacctgaaccagcaggccagcgagaccgagcccttcagcaacagccacctgctgcagcacaagccccacaagcaggccgcccagacccagcccagccagagcagccacctgccccagaaccagcagcagcagcagaagctgcagatcaagaacaaggaggagatcctgcagaccttcccccacccccagagcaacaacgaccagcagagagagggcagcttcttcggccagaccaaggtggaggagtgcttccacggcgagaaccagtacagcaagagcagcgagttcgagacccacaacgtgcagatgggcctggaggaggtgcagaacatcaacagaagaaacagcccctacagccagaccatgaagagcagcgcctgcaagatccaggtgagctgcagcaacaacacccacctggtgagcgagaacaaggagcagaccacccaccccgagctgttcgccggcaacaagacccagaacctgcaccacatgcagtacttccccaacaacgtgatccccaagcaggacctgctgcacagatgcttccaggagcaggagcagaagagccagcaggccagcgtgctgcagggctacaagaacagaaaccaggacatgagcggccagcaggccgcccagctggcccagcagagatacctgatccacaaccacgccaacgtgttccccgtgcccgaccagggcggcagccacacccagacccccccccagaaggacacccagaagcacgccgccctgagatggcacctgctgcagaagcaggagcagcagcagacccagcagccccagaccgagagctgccacagccagatgcacagacccatcaaggtggagcccggctgcaagccccacgcctgcatgcacaccgccccccccgagaacaagacctggaagaaggtgaccaagcaggagaacccccccgccagctgcgacaacgtgcagcagaagagcatcatcgagaccatggagcagcacctgaagcagttccacgccaagagcctgttcgaccacaaggccctgaccctgaagagccagaagcaggtgaaggtggagatgagcggccccgtgaccgtgctgaccagacagaccaccgccgccgagctggacagccacacccccgccctggagcagcagaccaccagcagcgagaagacccccaccaagagaaccgccgccagcgtgctgaacaacttcatcgagagccccagcaagctgctggacacccccatcaagaacctgctggacacccccgtgaagacccagtacgacttccccagctgcagatgcgtggagcagatcatcgagaaggacgagggccccttctacacccacctgggcgccggccccaacgtggccgccatcagagagatcatggaggagagattcggccagaagggcaaggccatcagaatcgagagagtgatctacaccggcaaggagggcaagagcagccagggctgccccatcgccaagtgggtggtgagaagaagcagcagcgaggagaagctgctgtgcctggtgagagagagagccggccacacctgcgaggccgccgtgatcgtgatcctgatcctggtgtgggagggcatccccctgagcctggccgacaagctgtacagcgagctgaccgagaccctgagaaagtacggcaccctgaccaacagaagatgcgccctgaacgaggagagaacctgcgcctgccagggcctggaccccgagacctgcggcgccagcttcagcttcggctgcagctggagcatgtactacaacggctgcaagttcgccagaagcaagatccccagaaagttcaagctgctgggcgacgaccccaaggaggaggagaagctggagagccacctgcagaacctgagcaccctgatggcccccacctacaagaagctggcccccgacgcctacaacaaccagatcgagtacgagcacagagcccccgagtgcagactgggcctgaaggagggcagacccttcagcggcgtgaccgcctgcctggacttctgcgcccacgcccacagagacctgcacaacatgcagaacggcagcaccctggtgtgcaccctgaccagagaggacaacagagagttcggcggcaagcccgaggacgagcagctgcacgtgctgcccctgtacaaggtgagcgacgtggacgagttcggcagcgtggaggcccaggaggagaagaagagaagcggcgccatccaggtgctgagcagcttcagaagaaaggtgagaatgctggccgagcccgtgaagacctgcagacagagaaagctggaggccaagaaggccgccgccgagaagctgagcagcctggagaacagcagcaacaagaacgagaaggagaagagcgcccccagcagaaccaagcagaccgagaacgccagccaggccaagcagctggccgagctgctgagactgagcggccccgtgatgcagcagagccagcagccccagcccctgcagaagcagcccccccagccccagcagcagcagagaccccagcagcagcagccccaccacccccagaccgagagcgtgaacagctacagcgccagcggcagcaccaacccctacatgagaagacccaaccccgtgagcccctaccccaacagcagccacaccagcgacatctacggcagcaccagccccatgaacttctacagcaccagcagccaggccgccggcagctacctgaacagcagcaaccccatgaacccctaccccggcctgctgaaccagaacacccagtaccccagctaccagtgcaacggcaacctgagcgtggacaactgcagcccctacctgggcagctacagcccccagagccagcccatggacctgtacagataccccagccaggaccccctgagcaagctgagcctgccccccatccacaccctgtaccagcccagattcggcaacagccagagcttcaccagcaagtacctgggctacggcaaccagaacatgcagggcgacggcttcagcagctgcaccatcagacccaacgtgcaccacgtgggcaagctgcccccctaccccacccacgagatggacggccacttcatgggcgccaccagcagactgccccccaacctgagcaaccccaacatggactacaagaacggcgagcaccacagccccagccacatcatccacaactacagcgccgcccccggcatgttcaacagcagcctgcacgccctgcacctgcagaacaaggagaacgacatgctgagccacaccgccaacggcctgagcaagatgctgcccgccctgaaccacgacagaaccgcctgcgtgcagggcggcctgcacaagctgagcgacgccaacggccaggagaagcagcccctggccctggtgcagggcgtggccagcggcgccgaggacaacgacgaggtgtggagcgacagcgagcagagcttcctggaccccgacatcggcggcgtggccgtggcccccacccacggcagcatcctgatcgagtgcgccaagagagagctgcacgccaccacccccctgaagaaccccaacagaaaccaccccaccagaatcagcctggtgttctaccagcacaagagcatgaacgagcccaagcacggcctggccctgtgggaggccaagatggccgagaaggccagagagaaggaggaggagtgcgagaagtacggccccgactacgtgccccagaagagccacggcaagaaggtgaagagagagcccgccgagccccacgagaccagcgagcccacctacctgagattcatcaagagcctggccgagagaaccatgagcgtgaccaccgacagcaccgtgaccaccagcccctacgccttcaccagagtgaccggcccctacaacagatacatctag

SEQ ID NO: 13131 - DNA, 3498 bp, Artificial Sequence; identical to SEQ ID NO: 13129
  Description of Artificial Sequence: Synthetic coding sequence

SEQ ID NO: 13132 - DNA, 333 bp, Artificial Sequence
  Description of Artificial Sequence: Synthetic coding sequence
atggagcaggacagaaccaaccacgtggagggcaacagactgagccccttcctgatccccagcccccccatctgccagaccgagcccctggccaccaagctgcagaacggcagccccctgcccgagagagcccaccccgaggtgaacggcgacaccaagtggcacagcttcaagagctactacggcatcccctgcatgaagggcagccagaacagcagagtgagccccgacttcacccaggagagcagaggctacagcaagtgcctgcagaacggcggcatcaagagaaccgtgagcgagcccagcctgagcggcctgctgcagatcaagtag

SEQ ID NO: 13133 - DNA, 1914 bp, Artificial Sequence
  Description of Artificial Sequence: Synthetic coding sequence
atggagcaggacagaaccaaccacgtggagggcaacagactgagccccttcctgatccccagcccccccatctgccagaccgagcccctggccaccaagctgcagaacggcagccccctgcccgagagagcccaccccgaggtgaacggcgacaccaagtggcacagcttcaagagctactacggcatcccctgcatgaagggcagccagaacagcagagtgagccccgacttcacccaggagagcagaggctacagcaagtgcctgcagaacggcggcatcaagagaaccgtgagcgagcccagcctgagcggcctgctgcagatcaagaagctgaagcaggaccagaaggccaacggcgagagaagaaacttcggcgtgagccaggagagaaaccccggcgagagcagccagcccaacgtgagcgacctgagcgacaagaaggagagcgtgagcagcgtggcccaggagaacgccgtgaaggacttcaccagcttcagcacccacaactgcagcggccccgagaaccccgagctgcagatcctgaacgagcaggagggcaagagcgccaactaccacgacaagaacatcgtgctgctgaagaacaaggccgtgctgatgcccaacggcgccaccgtgagcgccagcagcgtggagcacacccacggcgagctgctggagaagaccctgagccagtactaccccgactgcgtgagcatcgccgtgcagaagaccaccagccacatcaacgccatcaacagccaggccaccaacgagctgagctgcgagatcacccaccccagccacaccagcggccagatcaacagcgcccagaccagcaacagcgagctgccccccaagcccgccgccgtggtgagcgaggcctgcgacgccgacgacgccgacaacgccagcaagctggccgccatgctgaacacctgcagcttccagaagcccgagcagctgcagcagcagaagagcgtgttcgagatctgccccagccccgccgagaacaacatccagggcaccaccaagctggccagcggcgaggagttctgcagcggcagcagcagcaacctgcaggcccccggcggcagcagcgagagatacctgaagcagaacgagatgaacggcgcctacttcaagcagagcagcgtgttcaccaaggacagcttcagcgccaccaccaccccccccccccccagccagctgctgctgagcccccccccccccctgccccaggtgccccagctgcccagcgagggcaagagcaccctgaacggcggcgtgctggaggagcaccaccactaccccaaccagagcaacaccaccctgctgagagaggtgaagatcgagggcaagcccgaggccccccccagccagagccccaaccccagcacccacgtgtgcagccccagccccatgctgagcgagagaccccagaacaactgcgtgaacagaaacgacatccagaccgccggcaccatgaccgtgcccctgtgcagcgagaagaccagacccatgagcgagcacctgaagcacaacccccccatcttcggcagcagcggcgagctgcaggacaactgccagcagctgatgagaaacaaggagcaggagatcctgaagggcagagacaaggagcagaccagagacctggtgccccccacccagcactacctgaagcccggctggatcgagctgaaggcccccagattccaccaggccgagagccacctgaagagaaacgaggccagcctgcccagcatcctgcagtaccagcccaacctgagcaaccagatgaccagcaagcagtacaccggcaacagcaacatgcccggcggcctgcccagacaggcctacacccagaagaccacccagctgagcaccagccacaagtgcaccaagctgaagtag

SEQ ID NO: 13134 - DNA, 6009 bp, Artificial Sequence; identical to SEQ ID NO: 13130
  Description of Artificial Sequence: Synthetic coding sequence

SEQ ID NO: 13135 - DNA, 3585 bp, Artificial Sequence
  Description of Artificial Sequence: Synthetic coding sequence
atggagcaggacagaaccaaccacgtggagggcaacagactgagccccttcctgatccccagcccccccatctgccagaccgagcccctggccaccaagctgcagaacggcagccccctgcccgagagagcccaccccgaggtgaacggcgacaccaagtggcacagcttcaagagctactacggcatcccctgcatgaagggcagccagaacagcagagtgagccccgacttcacccaggagagcagaggctacagcaagtgcctgcagaacggcggcatcaagagaaccgtgagcgagcccagcctgagcggcctgctgcagatcaagaagctgaagcaggaccagaaggccaacggcgagagaagaaacttcggcgtgagccaggagagaaaccccggcgagagcagccagcccaacgtgagcgacctgagcgacaagaaggagagcgtgagcagcgtggcccaggagaacgccgtgaaggacttcaccagcttcagcacccacaactgcagcggccccgagaaccccgagctgcagatcctgaacgagcaggagggcaagagcgccaactaccacgacaagaacatcgtgctgctgaagaacaaggccgtgctgatgcccaacggcgccaccgtgagcgccagcagcgtggagcacacccacggcgagctgctggagaagaccctgagccagtactaccccgactgcgtgagcatcgccgtgcagaagaccaccagccacatcaacgccatcaacagccaggccaccaacgagctgagctgcgagatcacccaccccagccacaccagcggccagatcaacagcgcccagaccagcaacagcgagctgccccccaagcccgccgccgtggtgagcgaggcctgcgacgccgacgacgccgacaacgccagcaagctggccgccatgctgaacacctgcagcttccagaagcccgagcagctgcagcagcagaagagcgtgttcgagatctgccccagccccgccgagaacaacatccagggcaccaccaagctggccagcggcgaggagttctgcagcggcagcagcagcaacctgcaggcccccggcggcagcagcgagagatacctgaagcagaacgagatgaacggcgcctacttcaagcagagcagcgtgttcaccaaggacagcttcagcgccaccaccaccccccccccccccagccagctgctgctgagcccccccccccccctgccccaggtgccccagctgcccagcgagggcaagagcaccctgaacggcggcgtgctggaggagcaccaccactaccccaaccagagcaacaccaccctgctgagagaggtgaagatcgagggcaagcccgaggccccccccagccagagccccaaccccagcacccacgtgtgcagccccagccccatgctgagcgagagaccccagaacaactgcgtgaacagaaacgacatccagaccgccggcaccatgaccgtgcccctgtgcagcgagaagaccagacccatgagcgagcacctgaagcacaacccccccatcttcggcagcagcggcgagctgcaggacaactgccagcagctgatgagaaacaaggagcaggagatcctgaagggcagagacaaggagcagaccagagacctggtgccccccacccagcactacctgaagcccggctggatcgagctgaaggcccccagattccaccaggccgagagccacctgaagagaaacgaggccagcctgcccagcatcctgcagtaccagcccaacctgagcaaccagatgaccagcaagcagtacaccggcaacagcaacatgcccggcggcctgcccagacaggcctacacccagaagaccacccagctggagcacaagagccagatgtaccaggtggagatgaaccagggccagagccagggcaccgtggaccagcacctgcagttccagaagcccagccaccaggtgcacttcagcaagaccgaccacctgcccaaggcccacgtgcagagcctgtgcggcaccagattccacttccagcagagagccgacagccagaccgagaagctgatgagccccgtgctgaagcagcacctgaaccagcaggccagcgagaccgagcccttcagcaacagccacctgctgcagcacaagccccacaagcaggccgcccagacccagcccagccagagcagccacctgccccagaaccagcagcagcagcagaagctgcagatcaagaacaaggaggagatcctgcagaccttcccccacccccagagcaacaacgaccagcagagagagggcagcttcttcggccagaccaaggtggaggagtgcttccacggcgagaaccagtacagcaagagcagcgagttcgagacccacaacgtgcagatgggcctggaggaggtgcagaacatcaacagaagaaacagcccctacagccagaccatgaagagcagcgcctgcaagatccaggtgagctgcagcaacaacacccacctggtgagcgagaacaaggagcagaccacccaccccgagctgttcgccggcaacaagacccagaacctgcaccacatgcagtacttccccaacaacgtgatccccaagcaggacctgctgcacagatgcttccaggagcaggagcagaagagccagcaggccagcgtgctgcagggctacaagaacagaaaccaggacatgagcggccagcaggccgcccagctggcccagcagagatacctgatccacaaccacgccaacgtgttccccgtgcccgaccagggcggcagccacacccagacccccccccagaaggacacccagaagcacgccgccctgagatggcacctgctgcagaagcaggagcagcagcagacccagcagccccagaccgagagctgccacagccagatgcacagacccatcaaggtggagcccggctgcaagccccacgcctgcatgcacaccgccccccccgagaacaagacctggaagaaggtgaccaagcaggagaacccccccgccagctgcgacaacgtgcagcagaagagcatcatcgagaccatggagcagcacctgaagcagttccacgccaagagcctgttcgaccacaaggccctgaccctgaagagccagaagcaggtgaaggtggagatgagcggccccgtgaccgtgctgaccagacagaccaccgccgccgagctggacagccacacccccgccctggagcagcagaccaccagcagcgagaagacccccaccaagagaaccgccgccagcgtgctgaacaacttcatcgagagccccagcaagctgctggacacccccatcaagaacctgctggacacccccgtgaagacccagtacgacttccccagctgcagatgcgtgggcctggacagaagagtgaagctgctgggcctgaaggagagcagcatcctggtgaagaaggccaaggtgctgagagacgtgctgctgctgagcggctggttcgccgaggccgccgtgaagagaagctactgcgtgtggtgcggcagcgagctggccacccccgtgagactgcagtag

SEQ ID NO: 13136 - DNA, 6072 bp, Artificial Sequence
  Description of Artificial Sequence: Synthetic coding sequence
atgatccaggaggagcagatccagctggagggcagcctggtggacggccccgaggccagcctgatggagcaggacagaaccaaccacgtggagggcaacagactgagccccttcctgatccccagcccccccatctgccagaccgagcccctggccaccaagctgcagaacggcagccccctgcccgagagagcccaccccgaggtgaacggcgacaccaagtggcacagcttcaagagctactacggcatcccctgcatgaagggcagccagaacagcagagtgagccccgacttcacccaggagagcagaggctacagcaagtgcctgcagaacggcggcatcaagagaaccgtgagcgagcccagcctgagcggcctgctgcagatcaagaagctgaagcaggaccagaaggccaacggcgagagaagaaacttcggcgtgagccaggagagaaaccccggcgagagcagccagcccaacgtgagcgacctgagcgacaagaaggagagcgtgagcagcgtggcccaggagaacgccgtgaaggacttcaccagcttcagcacccacaactgcagcggccccgagaaccccgagctgcagatcctgaacgagcaggagggcaagagcgccaactaccacgacaagaacatcgtgctgctgaagaacaaggccgtgctgatgcccaacggcgccaccgtgagcgccagcagcgtggagcacacccacggcgagctgctggagaagaccctgagccagtactaccccgactgcgtgagcatcgccgtgcagaagaccaccagccacatcaacgccatcaacagccaggccaccaacgagctgagctgcgagatcacccaccccagccacaccagcggccagatcaacagcgcccagaccagcaacagcgagctgccccccaagcccgccgccgtggtgagcgaggcctgcgacgccgacgacgccgacaacgccagcaagctggccgccatgctgaacacctgcagcttccagaagcccgagcagctgcagcagcagaagagcgtgttcgagatctgccccagccccgccgagaacaacatccagggcaccaccaagctggccagcggcgaggagttctgcagcggcagcagcagcaacctgcaggcccccggcggcagcagcgagagatacctgaagcagaacgagatgaacggcgcctacttcaagcagagcagcgtgttcaccaaggacagcttcagcgccaccaccaccccccccccccccagccagctgctgctgagcccccccccccccctgccccaggtgccccagctgcccagcgagggcaagagcaccctgaacggcggcgtgctggaggagcaccaccactaccccaaccagagcaacaccaccctgctgagagaggtgaagatcgagggcaagcccgaggccccccccagccagagccccaaccccagcacccacgtgtgcagccccagccccatgctgagcgagagaccccagaacaactgcgtgaacagaaacgacatccagaccgccggcaccatgaccgtgcccctgtgcagcgagaagaccagacccatgagcgagcacctgaagcacaacccccccatcttcggcagcagcggcgagctgcaggacaactgccagcagctgatgagaaacaaggagcaggagatcctgaagggcagagacaaggagcagaccagagacctggtgccccccacccagcactacctgaagcccggctggatcgagctgaaggcccccagattccaccaggccgagagccacctgaagagaaacgaggccagcctgcccagcatcctgcagtaccagcccaacctgagcaaccagatgaccagcaagcagtacaccggcaacagcaacatgcccggcggcctgcccagacaggcctacacccagaagaccacccagctggagcacaagagccagatgtaccaggtggagatgaaccagggccagagccagggcaccgtggaccagcacctgcagttccagaagcccagccaccaggtgcacttcagcaagaccgaccacctgcccaaggcccacgtgcagagcctgtgcggcaccagattccacttccagcagagagccgacagccagaccgagaagctgatgagccccgtgctgaagcagcacctgaaccagcaggccagcgagaccgagcccttcagcaacagccacctgctgcagcacaagccccacaagcaggccgcccagacccagcccagccagagcagccacctgccccagaaccagcagcagcagcagaagctgcagatcaagaacaaggaggagatcctgcagaccttcccccacccccagagcaacaacgaccagcagagagagggcagcttcttcggccagaccaaggtggaggagtgcttccacggcgagaaccagtacagcaagagcagcgagttcgagacccacaacgtgcagatgggcctggaggaggtgcagaacatcaacagaagaaacagcccctacagccagaccatgaagagcagcgcctgcaagatccaggtgagctgcagcaacaacacccacctggtgagcgagaacaaggagcagaccacccaccccgagctgttcgccggcaacaagacccagaacctgcaccacatgcagtacttccccaacaacgtgatccccaagcaggacctgctgcacagatgcttccaggagcaggagcagaagagccagcaggccagcgtgctgcagggctacaagaacagaaaccaggacatgagcggccagcaggccgcccagctggcccagcagagatacctgatccacaaccacgccaacgtgttccccgtgcccgaccagggcggcagccacacccagacccccccccagaaggacacccagaagcacgccgccctgagatggcacctgctgcagaagcaggagcagcagcagacccagcagccccagaccgagagctgccacagccagatgcacagacccatcaaggtggagcccggctgcaagccccacgcctgcatgcacaccgccccccccgagaacaagacctggaagaaggtgaccaagcaggagaacccccccgccagctgcgacaacgtgcagcagaagagcatcatcgagaccatggagcagcacctgaagcagttccacgccaagagcctgttcgaccacaaggccctgaccctgaagagccagaagcaggtgaaggtggagatgagcggccccgtgaccgtgctgaccagacagaccaccgccgccgagctggacagccacacccccgccctggagcagcagaccaccagcagcgagaagacccccaccaagagaaccgccgccagcgtgctgaacaacttcatcgagagccccagcaagctgctggacacccccatcaagaacctgctggacacccccgtgaagacccagtacgacttccccagctgcagatgcgtggagcagatcatcgagaaggacgagggccccttctacacccacctgggcgccggccccaacgtggccgccatcagagagatcatggaggagagattcggccagaagggcaaggccatcagaatcgagagagtgatctacaccggcaaggagggcaagagcagccagggctgccccatcgccaagtgggtggtgagaagaagcagcagcgaggagaagctgctgtgcctggtgagagagagagccggccacacctgcgaggccgccgtgatcgtgatcctgatcctggtgtgggagggcatccccctgagcctggccgacaagctgtacagcgagctgaccgagaccctgagaaagtacggcaccctgaccaacagaagatgcgccctgaacgaggagagaacctgcgcctgccagggcctggaccccgagacctgcggcgccagcttcagcttcggctgcagctggagcatgtactacaacggctgcaagttcgccagaagcaagatccccagaaagttcaagctgctgggcgacgaccccaaggaggaggagaagctggagagccacctgcagaacctgagcaccctgatggcccccacctacaagaagctggcccccgacgcctacaacaaccagatcgagtacgagcacagagcccccgagtgcagactgggcctgaaggagggcagacccttcagcggcgtgaccgcctgcctggacttctgcgcccacgcccacagagacctgcacaacatgcagaacggcagcaccctggtgtgcaccctgaccagagaggacaacagagagttcggcggcaagcccgaggacgagcagctgcacgtgctgcccctgtacaaggtgagcgacgtggacgagttcggcagcgtggaggcccaggaggagaagaagagaagcggcgccatccaggtgctgagcagcttcagaagaaaggtgagaatgctggccgagcccgtgaagacctgcagacagagaaagctggaggccaagaaggccgccgccgagaagctgagcagcctggagaacagcagcaacaagaacgagaaggagaagagcgcccccagcagaaccaagcagaccgagaacgccagccaggccaagcagctggccgagctgctgagactgagcggccccgtgatgcagcagagccagcagccccagcccctgcagaagcagcccccccagccccagcagcagcagagaccccagcagcagcagccccaccacccccagaccgagagcgtgaacagctacagcgccagcggcagcaccaacccctacatgagaagacccaaccccgtgagcccctaccccaacagcagccacaccagcgacatctacggcagcaccagccccatgaacttctacagcaccagcagccaggccgccggcagctacctgaacagcagcaaccccatgaacccctaccccggcctgctgaaccagaacacccagtaccccagctaccagtgcaacggcaacctgagcgtggacaactgcagcccctacctgggcagctacagcccccagagccagcccatggacctgtacagataccccagccaggaccccctgagcaagctgagcctgccccccatccacaccctgtaccagcccagattcggcaacagccagagcttcaccagcaagtacctgggctacggcaaccagaacatgcagggcgacggcttcagcagctgcaccatcagacccaacgtgcaccacgtgggcaagctgcccccctaccccacccacgagatggacggccacttcatgggcgccaccagcagactgccccccaacctgagcaaccccaacatggactacaagaacggcgagcaccacagccccagccacatcatccacaactacagcgccgcccccggcatgttcaacagcagcctgcacgccctgcacctgcagaacaaggagaacgacatgctgagccacaccgccaacggcctgagcaagatgctgcccgccctgaaccacgacagaaccgcctgcgtgcagggcggcctgcacaagctgagcgacgccaacggccaggagaagcagcccctggccctggtgcagggcgtggccagcggcgccgaggacaacgacgaggtgtggagcgacagcgagcagagcttcctggaccccgacatcggcggcgtggccgtggcccccacccacggcagcatcctgatcgagtgcgccaagagagagctgcacgccaccacccccctgaagaaccccaacagaaaccaccccaccagaatcagcctggtgttctaccagcacaagagcatgaacgagcccaagcacggcctggccctgtgggaggccaagatggccgagaaggccagagagaaggaggaggagtgcgagaagtacggccccgactacgtgccccagaagagccacggcaagaaggtgaagagagagcccgccgagccccacgagaccagcgagcccacctacctgagattcatcaagagcctggccgagagaaccatgagcgtgaccaccgacagcaccgtgaccaccagcccctacgccttcaccagagtgaccggcccctacaacagatacatctag

SEQ ID NO: 13137 - DNA, 615 bp, Artificial Sequence
  Description of Artificial Sequence: Synthetic coding sequence
atggtgtgcggcggcttcgcctgcagcaagaactgcctgtgcgccctgaacctgctgtacaccctggtgagcctgctgctgatcggcatcgccgcctggggcatcggcttcggcctgatcagcagcctgagagtggtgggcgtggtgatcgccgtgggcatcttcctgttcctgatcgccctggtgggcctgatcggcgccgtgaagcaccaccaggtgctgctgttcttctacatgatcatcctgctgctggtgttcatcgtgcagttcagcgtgagctgcgcctgcctggccctgaaccaggagcagcagggccagctgctggaggtgggctggaacaacaccgccagcgccagaaacgacatccagagaaacctgaactgctgcggcttcagaagcgtgaaccccaacgacacctgcctggccagctgcgtgaagagcgaccacagctgcagcccctgcgcccccatcatcggcgagtacgccggcgaggtgctgagattcgtgggcggcatcggcctgttcttcagcttcaccgagatcctgggcgtgtggctgacctacagatacagaaaccagaaggaccccagagccaaccccagcgccttcctgtag

SEQ ID NO: 13138 - DNA, 738 bp, Artificial Sequence
  Description of Artificial Sequence: Synthetic coding sequence
atggccagccccagcagaagactgcagaccaagcccgtgatcacctgcttcaagagcgtgctgctgatctacaccttcatcttctggatcaccggcgtgatcctgctggccgtgggcatctggggcaaggtgagcctggagaactacttcagcctgctgaacgagaaggccaccaacgtgcccttcgtgctgatcgccaccggcaccgtgatcatcctgctgggcaccttcggctgcttcgccacctgcagagccagcgcctggatgctgaagctgtacgccatgttcctgaccctggtgttcctggtggagctggtggccgccatcgtgggcttcgtgttcagacacgagatcaagaacagcttcaagaacaactacgagaaggccctgaagcagtacaacagcaccggcgactacagaagccacgccgtggacaagatccagaacaccctgcactgctgcggcgtgaccgactacagagactggaccgacaccaactactacagcgagaagggcttccccaagagctgctgcaagctggaggactgcaccccccagagagacgccgacaaggtgaacaacgagggctgcttcatcaaggtgatgaccatcatcgagagcgagatgggcgtggtggccggcatcagcttcggcgtggcctgcttccagctgatcggcatcttcctggcctactgcctgagcagagccatcaccaacaaccagtacgagatcgtgtag

SEQ ID NO: 13139 - DNA, 684 bp, Artificial Sequence
  Description of Artificial Sequence: Synthetic coding sequence
atggccagccccagcagaagactgcagaccaagcccgtgatcacctgcttcaagagcgtgctgctgatctacaccttcatcttctggatcaccggcgtgatcctgctggccgtgggcatctggggcaaggtgagcctggagaactacttcagcctgctgaacgagaaggccaccttcggctgcttcgccacctgcagagccagcgcctggatgctgaagctgtacgccatgttcctgaccctggtgttcctggtggagctggtggccgccatcgtgggcttcgtgttcagacacgagatcaagaacagcttcaagaacaactacgagaaggccctgaagcagtacaacagcaccggcgactacagaagccacgccgtggacaagatccagaacaccctgcactgctgcggcgtgaccgactacagagactggaccgacaccaactactacagcgagaagggcttccccaagagctgctgcaagctggaggactgcaccccccagagagacgccgacaaggtgaacaacgagggctgcttcatcaaggtgatgaccatcatcgagagcgagatgggcgtggtggccggcatcagcttcggcgtggcctgcttccagctgatcggcatcttcctggcctactgcctgagcagagccatcaccaacaaccagtacgagatcgtgtag

SEQ ID NO: 13140 - DNA, 669 bp, Artificial Sequence
  Description of Artificial Sequence: Synthetic coding sequence
atggagagaaagggcagcgccgccggcgccaagggcaaccccagcccccccgccgccggcgagggccagagaccccccccccccctgtgcgtgcccggcggcggcggcggcgcccccgccagaggccaggtgggcgccgccgccgagcccgccgagctgatcagaagagcccacgagttcaagagccagggcgcccagtgctacaaggacaagaagttcagagaggccatcggcaagtaccacagagccctgctggagctgaagggcctgctgcccccccccggcgagagagagagagacagcagacccgccagccccgccggcgccctgaagcccggcagactgagcgaggagcagagcaagaccgtggaggccatcgagatcgactgctacaacagcctggccgcctgcctgctgcaggccgagctggtgaactacgagagagtgaaggagtactgcctgaaggtgctgaagaaggagggcgagaacttcaaggccctgtacagaagcggcgtggccttctaccacctgggcgactacgacaaggccctgtactacctgaaggaggccagaacccagcagcccaccgacaccaacgtgatcagatacatccagctgaccgagatgaagctgagcagatgcagccagagagagaaggaggccatgtag

SEQ ID NO: 13141 - DNA, 258 bp, Artificial Sequence
  Description of Artificial Sequence: Synthetic coding sequence
atggtgaagcagatcgagagcaagaccgccttccaggaggccctggacgccgccggcgacaagctggtggtggtggacttcagcgccacctggtgcggcccctgcaagatgatcaagcccttcttccacgacgtggccagcgagtgcgaggtgaagtgcatgcccaccttccagttcttcaagaagggccagaaggtgggcgagttcagcggcgccaacaaggagaagctggaggccaccatcaacgagctggtgtag

SEQ ID NO: 13142 - DNA, 318 bp, Artificial Sequence
  Description of Artificial Sequence: Synthetic coding sequence
atggtgaagcagatcgagagcaagaccgccttccaggaggccctggacgccgccggcgacaagctggtggtggtggacttcagcgccacctggtgcggcccctgcaagatgatcaagcccttcttccacagcctgagcgagaagtacagcaacgtgatcttcctggaggtggacgtggacgactgccaggacgtggccagcgagtgcgaggtgaagtgcatgcccaccttccagttcttcaagaagggccagaaggtgggcgagttcagcggcgccaacaaggagaagctggaggccaccatcaacgagctggtgtag

SEQ ID NO: 13143 - DNA, 1176 bp, Artificial Sequence
  Description of Artificial Sequence: Synthetic coding sequence
atggtgatgttcaagaagatcaagagcttcgaggtggtgttcaacgaccccgagaaggtgtacggcagcggcgagaaggtggccggcagagtgatcgtggaggtgtgcgaggtgaccagagtgaaggccgtgagaatcctggcctgcggcgtggccaaggtgctgtggatgcagggcagccagcagtgcaagcagaccagcgagtacctgagatacgaggacaccctgctgctggaggaccagcccaccggcgagaacgagatggtgatcatgagacccggcaacaagtacgagtacaagttcggcttcgagctgccccagggccccctgggcaccagcttcaagggcaagtacggctgcgtggactactgggtgaaggccttcctggacagacccagccagcccacccaggagaccaagaagaacttcgaggtggtggacctggtggacgtgaacacccccgacctgatggcccccgtgagcgccaagaaggagaagaaggtgagctgcatgttcatccccgacggcagagtgagcgtgagcgccagaatcgacagaaagggcttctgcgagggcgacgagatcagcatccacgccgacttcgagaacacctgcagcagaatcgtggtgcccaaggccgccatcgtggccagacacacctacctggccaacggccagaccaaggtgctgacccagaagctgagcagcgtgagaggcaaccacatcatcagcggcacctgcgccagctggagaggcaagagcctgagagtgcagaagatcagacccagcatcctgggctgcaacatcctgagagtggagtacagcctgctgatctacgtgagcgtgcccggcagcaagaaggtgatcctggacctgcccctggtgatcggcagcagaagcggcctgagcagcagaaccagcagcatggccagcagaaccagcagcgagatgagctgggtggacctgaacatccccgacacccccgaggcccccccctgctacatggacgtgatccccgaggaccacagactggagagccccaccacccccctgctggacgacatggacggcagccaggacagccccatcttcatgtacgcccccgagttcaagttcatgcccccccccacctacaccgaggtggacccctgcatcctgaacaacaacgtgcagtag

SEQ ID NO: 13144 - DNA, 1494 bp, Artificial Sequence
  Description of Artificial Sequence: Synthetic coding sequence
atgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgctag

SEQ ID NO: 13145 - DNA, 1746 bp, Artificial Sequence
  Description of Artificial Sequence: Synthetic coding sequence
atgcagcaggtgatgctgacctgcaagggcgtgaacagaggccacgccgtgcccgccggccccggcagaaagcccagacccagaagaagcagcagactgctggccggcgagaagcacctgaccagaagcgccctgctgctgtgccacaccgaggacggcagagccctggagggcaccctgagcgagctggccgccgagaccgacctgcccgtggtgttcgtgaagcagagaaagatcggcggccacggccccaccctgaaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgagttcttcagcttcatctag

SEQ ID NO: 13146 - DNA, 1650 bp, Artificial Sequence
  Description of Artificial Sequence: Synthetic coding sequence
atgagctgcgaggacggcagagccctggagggcaccctgagcgagctggccgccgagaccgacctgcccgtggtgttcgtgaagcagagaaagatcggcggccacggccccaccctgaaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgctag

SEQ ID NO: 13147 - DNA, 1626 bp, Artificial Sequence
  Description of Artificial Sequence: Synthetic coding sequence
atgctgagcagactggtgctgaacagctgggcccaggccatcatcagacccagaccccccaaggtgctgggcctgcaggtgaccaccttcagcgaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgctag

SEQ ID NO: 13148 - DNA, 1839 bp, Artificial Sequence
  Description of Artificial Sequence: Synthetic coding sequence
atgcccgtggacgactactggctgtgcctgcccgccagctgcgccagacccttcgtgcagaccgtgagagtggtgcagagctgcccccactgctgctggttccccggcgtgctgcccagcgtgcccgagcccctgagaatgcccgccatgctgcccaccggcagccacagcgccgtgctgccccccagccactgcagcaccgccccccccagcaccagccaggagcccagcagcagcgccgaccccaagctgtgcctgagcccccccaccagcgacagcagacaggagagaaacgtgcagttcggcctggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgctag

SEQ ID NO: 13149 - DNA, 1944 bp, Artificial Sequence
  Description of Artificial Sequence: Synthetic coding sequence
atgggctgcgccgagggcaaggccgtggccgccgccgcccccaccgagctgcagaccaagggcaagaacggcgacggcagaagaagaagcgccaaggaccaccaccccggcaagaccctgcccgagaaccccgccggcttcaccagcaccgccaccgccgacagcagagccctgctgcaggcctacatcgacggccacagcgtggtgatcttcagcagaagcacctgcaccagatgcaccgaggtgaagaagctgttcaagagcctgtgcgtgccctacttcgtgctggagctggaccagaccgaggacggcagagccctggagggcaccctgagcgagctggccgccgagaccgacctgcccgtggtgttcgtgaagcagagaaagatcggcggccacggccccaccctgaaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgctag

SEQ ID NO: 13150 - DNA, 1500 bp, Artificial Sequence
  Description of Artificial Sequence: Synthetic coding sequence
  Description of Combined DNA/RNA Molecule: Synthetic coding sequence
atgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgcugaggctag

SEQ ID NO: 13151 - DNA, 1500 bp, Artificial Sequence; identical to SEQ ID NO: 13150
  Description of Artificial Sequence: Synthetic coding sequence
  Description of Combined DNA/RNA Molecule: Synthetic coding sequence

SEQ ID NO: 13152 - DNA, 1950 bp, Artificial Sequence
  Description of Artificial Sequence: Synthetic coding sequence
  Description of Combined DNA/RNA Molecule: Synthetic coding sequence
atgggctgcgccgagggcaaggccgtggccgccgccgcccccaccgagctgcagaccaagggcaagaacggcgacggcagaagaagaagcgccaaggaccaccaccccggcaagaccctgcccgagaaccccgccggcttcaccagcaccgccaccgccgacagcagagccctgctgcaggcctacatcgacggccacagcgtggtgatcttcagcagaagcacctgcaccagatgcaccgaggtgaagaagctgttcaagagcctgtgcgtgccctacttcgtgctggagctggaccagaccgaggacggcagagccctggagggcaccctgagcgagctggccgccgagaccgacctgcccgtggtgttcgtgaagcagagaaagatcggcggccacggccccaccctgaaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgcugaggctag

SEQ ID NO: 13153 - DNA, 213 bp, Artificial Sequence
  Description of Artificial Sequence: Synthetic coding sequence
atgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgtag

SEQ ID NO: 13154 - DNA, 1632 bp, Artificial Sequence
  Description of Artificial Sequence: Synthetic coding sequence
  Description of Combined DNA/RNA Molecule: Synthetic coding sequence
atgctgagcagactggtgctgaacagctgggcccaggccatcatcagacccagaccccccaaggtgctgggcctgcaggtgaccaccttcagcgaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgcugaggctag

SEQ ID NO: 13155 - DNA, 315 bp, Artificial Sequence
  Description of Artificial Sequence: Synthetic coding sequence
atgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggcctag

SEQ ID NO: 13156 - DNA, 1656 bp, Artificial Sequence
  Description of Artificial Sequence: Synthetic coding sequence
  Description of Combined DNA/RNA Molecule: Synthetic coding sequence
atgagctgcgaggacggcagagccctggagggcaccctgagcgagctggccgccgagaccgacctgcccgtggtgttcgtgaagcagagaaagatcggcggccacggccccaccctgaaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgcugaggctag

SEQ ID NO: 13157 - DNA, 1707 bp, Artificial Sequence
  Description of Artificial Sequence: Synthetic coding sequence
  Description of Combined DNA/RNA Molecule: Synthetic coding sequence
atgcccgccatgctgcccaccggcagccacagcgccgtgctgccccccagccactgcagcaccgccccccccagcaccagccaggagcccagcagcagcgccgaccccaagctgtgcctgagcccccccaccagcgacagcagacaggagagaaacgtgcagttcggcctggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgcugaggctag

SEQ ID NO: 13158 - DNA, 528 bp, Artificial Sequence
  Description of Artificial Sequence: Synthetic coding sequence
atgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtag

SEQ ID NO: 13159 - DNA, 162 bp, Artificial Sequence
  Description of Artificial Sequence: Synthetic coding sequence
atgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggtag

SEQ ID NO: 13160 - DNA, 219 bp, Artificial Sequence
  Description of Artificial Sequence: Synthetic coding sequence
atgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccagtag

SEQ ID NO: 13161 - DNA, 420 bp, Artificial Sequence
  Description of Artificial Sequence: Synthetic coding sequence
atgctgagcagactggtgctgaacagctgggcccaggccatcatcagacccagaccccccaaggtgctgggcctgcaggtgaccaccttcagcgaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccggcatgtag

SEQ ID NO: 13162 - DNA, 1380 bp, Artificial Sequence
  Description of Artificial Sequence: Synthetic coding sequence
atggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgctag

SEQ ID NO: 13163 - DNA, 1644 bp, Artificial Sequence
  Description of Artificial Sequence: Synthetic coding sequence
atggaggacggcagagccctggagggcaccctgagcgagctggccgccgagaccgacctgcccgtggtgttcgtgaagcagagaaagatcggcggccacggccccaccctgaaggcctaccaggagggcagactgcagaagctgctgaagatgaacggccccgaggacctgcccaagagctacgactacgacctgatcatcatcggcggcggcagcggcggcctggccgccgccaaggaggccgcccagtacggcaagaaggtgatggtgctggacttcgtgacccccacccccctgggcaccagatggggcctgggcggcacctgcgtgaacgtgggctgcatccccaagaagctgatgcaccaggccgccctgctgggccaggccctgcaggacagcagaaactacggctggaaggtggaggagaccgtgaagcacgactgggacagaatgatcgaggccgtgcagaaccacatcggcagcctgaactggggctacagagtggccctgagagagaagaaggtggtgtacgagaacgcctacggccagttcatcggcccccacagaatcaaggccaccaacaacaagggcaaggagaagatctacagcgccgagagattcctgatcgccaccggcgagagacccagatacctgggcatccccggcgacaaggagtactgcatcagcagcgacgacctgttcagcctgccctactgccccggcaagaccctggtggtgggcgccagctacgtggccctggagtgcgccggcttcctggccggcatcggcctggacgtgaccgtgatggtgagaagcatcctgctgagaggcttcgaccaggacatggccaacaagatcggcgagcacatggaggagcacggcatcaagttcatcagacagttcgtgcccatcaaggtggagcagatcgaggccggcacccccggcagactgagagtggtggcccagagcaccaacagcgaggagatcatcgagggcgagtacaacaccgtgatgctggccatcggcagagacgcctgcaccagaaagatcggcctggagaccgtgggcgtgaagatcaacgagaagaccggcaagatccccgtgaccgacgaggagcagaccaacgtgccctacatctacgccatcggcgacatcctggaggacaaggtggagctgacccccgtggccatccaggccggcagactgctggcccagagactgtacgccggcagcaccgtgaagtgcgactacgagaacgtgcccaccaccgtgttcacccccctggagtacggcgcctgcggcctgagcgaggagaaggccgtggagaagttcggcgaggagaacatcgaggtgtaccacagctacttctggcccctggagtggaccatccccagcagagacaacaacaagtgctacgccaagatcatctgcaacaccaaggacaacgagagagtggtgggcttccacgtgctgggccccaacgccggcgaggtgacccagggcttcgccgccgccctgaagtgcggcctgaccaagaagcagctggacagcaccatcggcatccaccccgtgtgcgccgaggtgttcaccaccctgagcgtgaccaagagaagcggcgccagcatcctgcaggccggctgctag

SEQ ID NO: 13164 - DNA, 945 bp, Artificial Sequence
  Description of Artificial Sequence: Synthetic coding sequence
atgggcagccaggccctgccccccggccccatgcagaccctgatcttcttcgacatggaggccaccggcctgcccttcagccagcccaaggtgaccgagctgtgcctgctggccgtgcacagatgcgccctggagagcccccccaccagccagggccccccccccaccgtgccccccccccccagagtggtggacaagctgagcctgtgcgtggcccccggcaaggcctgcagccccgccgccagcgagatcaccggcctgagcaccgccgtgctggccgcccacggcagacagtgcttcgacgacaacctggccaacctgctgctggccttcctgagaagacagccccagccctggtgcctggtggcccacaacggcgacagatacgacttccccctgctgcaggccgagctggccatgctgggcctgaccagcgccctggacggcgccttctgcgtggacagcatcaccgccctgaaggccctggagagagccagcagccccagcgagcacggccccagaaagagctacagcctgggcagcatctacaccagactgtacggccagagcccccccgacagccacaccgccgagggcgacgtgctggccctgctgagcatctgccagtggagaccccaggccctgctgagatgggtggacgcccacgccagacccttcggcaccatcagacccatgtacggcgtgaccgccagcgccagaaccaagcccagacccagcgccgtgaccaccaccgcccacctggccaccaccagaaacaccagccccagcctgggcgagagcagaggcaccaaggacctgccccccgtgaaggaccccggcgccctgagcagagagggcctgctggcccccctgggcctgctggccatcctgaccctggccgtggccaccctgtacggcctgagcctggccacccccggcgagtag

SEQ ID NO: 13165 - DNA, 1110 bp, Artificial Sequence
  Description of Artificial Sequence: Synthetic coding sequence
atgggccccggcgccagaagacagggcagaatcgtgcagggcagacccgagatgtgcttctgccccccccccacccccctgccccccctgagaatcctgaccctgggcacccacacccccaccccctgcagcagccccggcagcgccgccggcacctaccccaccatgggcagccaggccctgccccccggccccatgcagaccctgatcttcttcgacatggaggccaccggcctgcccttcagccagcccaaggtgaccgagctgtgcctgctggccgtgcacagatgcgccctggagagcccccccaccagccagggccccccccccaccgtgccccccccccccagagtggtggacaagctgagcctgtgcgtggcccccggcaaggcctgcagccccgccgccagcgagatcaccggcctgagcaccgccgtgctggccgcccacggcagacagtgcttcgacgacaacctggccaacctgctgctggccttcctgagaagacagccccagccctggtgcctggtggcccacaacggcgacagatacgacttccccctgctgcaggccgagctggccatgctgggcctgaccagcgccctggacggcgccttctgcgtggacagcatcaccgccctgaaggccctggagagagccagcagccccagcgagcacggccccagaaagagctacagcctgggcagcatctacaccagactgtacggccagagcccccccgacagccacaccgccgagggcgacgtgctggccctgctgagcatctgccagtggagaccccaggccctgctgagatgggtggacgcccacgccagacccttcggcaccatcagacccatgtacggcgtgaccgccagcgccagaaccaagcccagacccagcgccgtgaccaccaccgcccacctggccaccaccagaaacaccagccccagcctgggcgagagcagaggcaccaaggacctgccccccgtgaaggaccccggcgccctgagcagagagggcctgctggcccccctgggcctgctggccatcctgaccctggccgtggccaccctgtacggcctgagcctggccacccccggcgagtag

SEQ ID NO: 13166 - DNA, 528 bp, Artificial Sequence
  Description of Artificial Sequence: Synthetic coding sequence
atgctgggcctgaccagcgccctggacggcgccttctgcgtggacagcatcaccgccctgaaggccctggagagagccagcagccccagcgagcacggccccagaaagagctacagcctgggcagcatctacaccagactgtacggccagagcccccccgacagccacaccgccgagggcgacgtgctggccctgctgagcatctgccagtggagaccccaggccctgctgagatgggtggacgcccacgccagacccttcggcaccatcagacccatgtacggcgtgaccgccagcgccagaaccaagcccagacccagcgccgtgaccaccaccgcccacctggccaccaccagaaacaccagccccagcctgggcgagagcagaggcaccaaggacctgccccccgtgaaggaccccggcgccctgagcagagagggcctgctggcccccctgggcctgctggccatcctgaccctggccgtggccaccctgtacggcctgagcctggccacccccggcgagtag

SEQ ID NO: 13167 - DNA, 945 bp, Artificial Sequence; identical to SEQ ID NO: 13164
  Description of Artificial Sequence: Synthetic coding sequence

SEQ ID NO: 13168 - DNA, 915 bp, Artificial Sequence
  Description of Artificial Sequence: Synthetic coding sequence
atgcagaccctgatcttcttcgacatggaggccaccggcctgcccttcagccagcccaaggtgaccgagctgtgcctgctggccgtgcacagatgcgccctggagagcccccccaccagccagggccccccccccaccgtgccccccccccccagagtggtggacaagctgagcctgtgcgtggcccccggcaaggcctgcagccccgccgccagcgagatcaccggcctgagcaccgccgtgctggccgcccacggcagacagtgcttcgacgacaacctggccaacctgctgctggccttcctgagaagacagccccagccctggtgcctggtggcccacaacggcgacagatacgacttccccctgctgcaggccgagctggccatgctgggcctgaccagcgccctggacggcgccttctgcgtggacagcatcaccgccctgaaggccctggagagagccagcagccccagcgagcacggccccagaaagagctacagcctgggcagcatctacaccagactgtacggccagagcccccccgacagccacaccgccgagggcgacgtgctggccctgctgagcatctgccagtggagaccccaggccctgctgagatgggtggacgcccacgccagacccttcggcaccatcagacccatgtacggcgtgaccgccagcgccagaaccaagcccagacccagcgccgtgaccaccaccgcccacctggccaccaccagaaacaccagccccagcctgggcgagagcagaggcaccaaggacctgccccccgtgaaggaccccggcgccctgagcagagagggcctgctggcccccctgggcctgctggccatcctgaccctggccgtggccaccctgtacggcctgagcctggccacccccggcgagtag

SEQ ID NO: 13169 - DNA, 528 bp, Artificial Sequence; identical to SEQ ID NO: 13166
  Description of Artificial Sequence: Synthetic coding sequence

SEQ ID NO: 13170 - DNA, 3513 bp, Artificial Sequence
  Description of Artificial Sequence: Synthetic coding sequence
atgggcctggcctggggcctgggcgtgctgttcctgatgcacgtgtgcggcaccaacagaatccccgagagcggcggcgacaacagcgtgttcgacatcttcgagctgaccggcgccgccagaaagggcagcggcagaagactggtgaagggccccgaccccagcagccccgccttcagaatcgaggacgccaacctgatcccccccgtgcccgacgacaagttccaggacctggtggacgccgtgagagccgagaagggcttcctgctgctggccagcctgagacagatgaagaagaccagaggcaccctgctggccctggagagaaaggaccacagcggccaggtgttcagcgtggtgagcaacggcaaggccggcaccctggacctgagcctgaccgtgcagggcaagcagcacgtggtgagcgtggaggaggccctgctggccaccggccagtggaagagcatcaccctgttcgtgcaggaggacagagcccagctgtacatcgactgcgagaagatggagaacgccgagctggacgtgcccatccagagcgtgttcaccagagacctggccagcatcgccagactgagaatcgccaagggcggcgtgaacgacaacttccagggcgtgctgcagaacgtgagattcgtgttcggcaccacccccgaggacatcctgagaaacaagggctgcagcagcagcaccagcgtgctgctgaccctggacaacaacgtggtgaacggcagcagccccgccatcagaaccaactacatcggccacaagaccaaggacctgcaggccatctgcggcatcagctgcgacgagctgagcagcatggtgctggagctgagaggcctgagaaccatcgtgaccaccctgcaggacagcatcagaaaggtgaccgaggagaacaaggagctggccaacgagctgagaagaccccccctgtgctaccacaacggcgtgcagtacagaaacaacgaggagtggaccgtggacagctgcaccgagtgccactgccagaacagcgtgaccatctgcaagaaggtgagctgccccatcatgccctgcagcaacgccaccgtgcccgacggcgagtgctgccccagatgctggcccagcgacagcgccgacgacggctggagcccctggagcgagtggaccagctgcagcaccagctgcggcaacggcatccagcagagaggcagaagctgcgacagcctgaacaacagatgcgagggcagcagcgtgcagaccagaacctgccacatccaggagtgcgacaagagattcaagcaggacggcggctggagccactggagcccctggagcagctgcagcgtgacctgcggcgacggcgtgatcaccagaatcagactgtgcaacagccccagcccccagatgaacggcaagccctgcgagggcgaggccagagagaccaaggcctgcaagaaggacgcctgccccatcaacggcggctggggcccctggagcccctgggacatctgcagcgtgacctgcggcggcggcgtgcagaagagaagcagactgtgcaacaaccccaccccccagttcggcggcaaggactgcgtgggcgacgtgaccgagaaccagatctgcaacaagcaggactgccccatcgacggctgcctgagcaacccctgcttcgccggcgtgaagtgcaccagctaccccgacggcagctggaagtgcggcgcctgcccccccggctacagcggcaacggcatccagtgcaccgacgtggacgagtgcaaggaggtgcccgacgcctgcttcaaccacaacggcgagcacagatgcgagaacaccgaccccggctacaactgcctgccctgcccccccagattcaccggcagccagcccttcggccagggcgtggagcacgccaccgccaacaagcaggtgtgcaagcccagaaacccctgcaccgacggcacccacgactgcaacaagaacgccaagtgcaactacctgggccactacagcgaccccatgtacagatgcgagtgcaagcccggctacgccggcaacggcatcatctgcggcgaggacaccgacctggacggctggcccaacgagaacctggtgtgcgtggccaacgccacctaccactgcaagaaggacaactgccccaacctgcccaacagcggccaggaggactacgacaaggacggcatcggcgacgcctgcgacgacgacgacgacaacgacaagatccccgacgacagagacaactgccccttccactacaaccccgcccagtacgactacgacagagacgacgtgggcgacagatgcgacaactgcccctacaaccacaaccccgaccaggccgacaccgacaacaacggcgagggcgacgcctgcgccgccgacatcgacggcgacggcatcctgaacgagagagacaactgccagtacgtgtacaacgtggaccagagagacaccgacatggacggcgtgggcgaccagtgcgacaactgccccctggagcacaaccccgaccagctggacagcgacagcgacagaatcggcgacacctgcgacaacaaccaggacatcgacgaggacggccaccagaacaacctggacaactgcccctacgtgcccaacgccaaccaggccgaccacgacaaggacggcaagggcgacgcctgcgaccacgacgacgacaacgacggcatccccgacgacaaggacaactgcagactggtgcccaaccccgaccagaaggacagcgacggcgacggcagaggcgacgcctgcaaggacgacttcgaccacgacagcgtgcccgacatcgacgacatctgccccgagaacgtggacatcagcgagaccgacttcagaagattccagatgatccccctggaccccaagggcaccagccagaacgaccccaactgggtggtgagacaccagggcaaggagctggtgcagaccgtgaactgcgaccccggcctggccgtgggctacgacgagttcaacgccgtggacttcagcggcaccttcttcatcaacaccgagagagacgacgactacgccggcttcgtgttcggctaccagagcagcagcagattctacgtggtgatgtggaagcaggtgacccagagctactgggacaccaaccccaccagagcccagggctacagcggcctgagcgtgaaggtggtgaacagcaccaccggccccggcgagcacctgagaaacgccctgtggcacaccggcaacacccccggccaggtgagaaccctgtggcacgaccccagacacatcggctggaaggacttcaccgcctacagatggagactgagccacagacccaagaccggcttcatcagagtggtgatgtacgagggcaagaagatcatggccgacagcggccccatctacgacaagacctacgccggcggcagactgggcctgttcgtgttcagccaggagatggtgttcttcagcgacctgaagtacgagtgcagagacccctag

SEQ ID NO: 13171 - DNA, 285 bp, Artificial Sequence
  Description of Artificial Sequence: Synthetic coding sequence
atgggcctggcctggggcctgggcgtgctgttcctgatgcacgtgtgcggcaccaacagaatccccgagagcggcggcgacaacagcgtgttcgacatcttcgagctgaccggcgccgccagaaagggcagcggcagaagactggtgaagggccccgaccccagcagccccgccttcagaatcgaggacgccaacctgatcccccccgtgcccgacgacaagttccaggacctggtggacgccgtgagagccgagaagggcttcctgctgctggccagcctgtag

SEQ ID NO: 13172 - DNA, 501 bp, Artificial Sequence
  Description of Artificial Sequence: Synthetic coding sequence
atggccgccggcaacgtggtgctggtgcccctggtgaccgtggagatggccagcagcgcccagatgctgatgagcgccaagaagtgcctgatgcccgccagcaccaccatggagagcaccggcgtgagaaccagaacccccgccaccaccgcctgccccgccccccacgccagccccgcccacagccccagcgccagagtgagcaacatgcccagacccaccaacagatgcgccagccccatccccctgtgcctgtgccacagagccggctgctactgcgaggccatcagcgagcagtggacccagaagcacttccaggcctgccagagaagagaggacagcctggagctggccaacaagaccaccctgaccagcagcttcagaaacaccggcagcagaggccagagcaccaagggcagagcccacaccagagacgactgcatgaagaagatctggagaaactgctacatgttcggcaccaagagcttcagcggcgactag

SEQ ID NO: 13173 - DNA, 3519 bp, Artificial Sequence
  Description of Artificial Sequence: Synthetic coding sequence
atggtgtggagactggtgctgctggccctgtgggtgtggcccagcacccaggccggccaccaggacaaggacaccaccttcgacctgttcagcatcagcaacatcaacagaaagaccatcggcgccaagcagttcagaggccccgaccccggcgtgcccgcctacagattcgtgagattcgactacatcccccccgtgaacgccgacgacctgagcaagatcaccaagatcatgagacagaaggagggcttcttcctgaccgcccagctgaagcaggacggcaagagcagaggcaccctgctggccctggagggccccggcctgagccagagacagttcgagatcgtgagcaacggccccgccgacaccctggacctgacctactggatcgacggcaccagacacgtggtgagcctggaggacgtgggcctggccgacagccagtggaagaacgtgaccgtgcaggtggccggcgagacctacagcctgcacgtgggctgcgacctgatcgacagcttcgccctggacgagcccttctacgagcacctgcaggccgagaagagcagaatgtacgtggccaagggcagcgccagagagagccacttcagaggcctgctgcagaacgtgcacctggtgttcgagaacagcgtggaggacatcctgagcaagaagggctgccagcagggccagggcgccgagatcaacgccatcagcgagaacaccgagaccctgagactgggcccccacgtgaccaccgagtacgtgggccccagcagcgagagaagacccgaggtgtgcgagagaagctgcgaggagctgggcaacatggtgcaggagctgagcggcctgcacgtgctggtgaaccagctgagcgagaacctgaagagagtgagcaacgacaaccagttcctgtgggagctgatcggcggcccccccaagaccagaaacatgagcgcctgctggcaggacggcagattcttcgccgagaacgagacctgggtggtggacagctgcaccacctgcacctgcaagaagttcaagaccatctgccaccagatcacctgcccccccgccacctgcgccagccccagcttcgtggagggcgagtgctgccccagctgcctgcacagcgtggacggcgaggagggctggagcccctgggccgagtggacccagtgcagcgtgacctgcggcagcggcacccagcagagaggcagaagctgcgacgtgaccagcaacacctgcctgggccccagcatccagaccagagcctgcagcctgagcaagtgcgacaccagaatcagacaggacggcggctggagccactggagcccctggagcagctgcagcgtgacctgcggcgtgggcaacatcaccagaatcagactgtgcaacagccccgtgccccagatgggcggcaagaactgcaagggcagcggcagagagaccaaggcctgccagggcgccccctgccccatcgacggcagatggagcccctggagcccctggagcgcctgcaccgtgacctgcgccggcggcatcagagagagaaccagagtgtgcaacagccccgagccccagtacggcggcaaggcctgcgtgggcgacgtgcaggagagacagatgtgcaacaagagaagctgccccgtggacggctgcctgagcaacccctgcttccccggcgcccagtgcagcagcttccccgacggcagctggagctgcggcagctgccccgtgggcttcctgggcaacggcacccactgcgaggacctggacgagtgcgccctggtgcccgacatctgcttcagcaccagcaaggtgcccagatgcgtgaacacccagcccggcttccactgcctgccctgcccccccagatacagaggcaaccagcccgtgggcgtgggcctggaggccgccaagaccgagaagcaggtgtgcgagcccgagaacccctgcaaggacaagacccacaactgccacaagcacgccgagtgcatctacctgggccacttcagcgaccccatgtacaagtgcgagtgccagaccggctacgccggcgacggcctgatctgcggcgaggacagcgacctggacggctggcccaacctgaacctggtgtgcgccaccaacgccacctaccactgcatcaaggacaactgcccccacctgcccaacagcggccaggaggacttcgacaaggacggcatcggcgacgcctgcgacgacgacgacgacaacgacggcgtgaccgacgagaaggacaactgccagctgctgttcaaccccagacaggccgactacgacaaggacgaggtgggcgacagatgcgacaactgcccctacgtgcacaaccccgcccagatcgacaccgacaacaacggcgagggcgacgcctgcagcgtggacatcgacggcgacgacgtgttcaacgagagagacaactgcccctacgtgtacaacaccgaccagagagacaccgacggcgacggcgtgggcgaccactgcgacaactgccccctggtgcacaaccccgaccagaccgacgtggacaacgacctggtgggcgaccagtgcgacaacaacgaggacatcgacgacgacggccaccagaacaaccaggacaactgcccctacatcagcaacgccaaccaggccgaccacgacagagacggccagggcgacgcctgcgaccccgacgacgacaacgacggcgtgcccgacgacagagacaactgcagactggtgttcaaccccgaccaggaggacctggacggcgacggcagaggcgacatctgcaaggacgacttcgacaacgacaacatccccgacatcgacgacgtgtgccccgagaacaacgccatcagcgagaccgacttcagaaacttccagatggtgcccctggaccccaagggcaccacccagatcgaccccaactgggtgatcagacaccagggcaaggagctggtgcagaccgccaacagcgaccccggcatcgccgtgggcttcgacgagttcggcagcgtggacttcagcggcaccttctacgtgaacaccgacagagacgacgactacgccggcttcgtgttcggctaccagagcagcagcagattctacgtggtgatgtggaagcaggtgacccagacctactgggaggaccagcccaccagagcctacggctacagcggcgtgagcctgaaggtggtgaacagcaccaccggcaccggcgagcacctgagaaacgccctgtggcacaccggcaacacccccggccaggtgagaaccctgtggcacgaccccagaaacatcggctggaaggactacaccgcctacagatggcacctgacccacagacccaagaccggctacatcagagtgctggtgcacgagggcaagcaggtgatggccgacagcggccccatctacgaccagacctacgccggcggcagactgggcctgttcgtgttcagccaggagatggtgtacttcagcgacctgaagtacgagtgcagagacatctag

SEQ ID NO: 13174 - DNA, 1293 bp, Artificial Sequence
  Description of Artificial Sequence: Synthetic coding sequence
gacgacgacaacgacggcgtgaccgacgagaaggacaactgccagctgctgttcaaccccagacaggccgactacgacaaggacgaggtgggcgacagatgcgacaactgcccctacgtgcacaaccccgcccagatcgacaccgacaacaacggcgagggcgacgcctgcagcgtggacatcgacggcgacgacgtgttcaacgagagagacaactgcccctacgtgtacaacaccgaccagagagacaccgacggcgacggcgtgggcgaccactgcgacaactgccccctggtgcacaaccccgaccagaccgacgtggacaacgacctggtgggcgaccagtgcgacaacaacgaggacatcgacgacgacggccaccagaacaaccaggacaactgcccctacatcagcaacgccaaccaggccgaccacgacagagacggccagggcgacgcctgcgaccccgacgacgacaacgacggcgtgcccgacgacagagacaactgcagactggtgttcaaccccgaccaggaggacctggacggcgacggcagaggcgacatctgcaaggacgacttcgacaacgacaacatccccgacatcgacgacgtgtgccccgagaacaacgccatcagcgagaccgacttcagaaacttccagatggtgcccctggaccccaagggcaccacccagatcgaccccaactgggtgatcagacaccagggcaaggagctggtgcagaccgccaacagcgaccccggcatcgccgtgggcttcgacgagttcggcagcgtggacttcagcggcaccttctacgtgaacaccgacagagacgacgactacgccggcttcgtgttcggctaccagagcagcagcagattctacgtggtgatgtggaagcaggtgacccagacctactgggaggaccagcccaccagagcctacggctacagcggcgtgagcctgaaggtggtgaacagcaccaccggcaccggcgagcacctgagaaacgccctgtggcacaccggcaacacccccggccaggtgagaaccctgtggcacgaccccagaaacatcggctggaaggactacaccgcctacagatggcacctgacccacagacccaagaccggctacatcagagtgctggtgcacgagggcaagcaggtgatggccgacagcggccccatctacgaccagacctacgccggcggcagactgggcctgttcgtgttcagccaggagatggtgtacttcagcgacctgaagtacgagtgcagagtgatctag

SEQ ID NO: 13175 - DNA, 252 bp, Artificial Sequence
  Description of Artificial Sequence: Synthetic coding sequence
atggtgtggagactggtgctgctggccctgtgggtgtggcccagcacccaggccggccaccaggacaaggacaccaccttcgacctgttcagcatcagcaacatcaacagaaagaccatcggcgccaagcagttcagaggccccgaccccggcgtgcccgcctacagattcgtgagattcgactacatcccccccgtgaacgccgacgacctgagcaagatcaccaagatcatgagacagaaggagggctag

SEQ ID NO: 13176 - DNA, 1449 bp, Artificial Sequence
  Description of Artificial Sequence: Synthetic coding sequence
atggccgccctgatgacccccggcaccggcgccccccccgcccccggcgacttcagcggcgagggcagccagggcctgcccgaccccagccccgagcccaagcagctgcccgagctgatcagaatgaagagagacggcggcagactgagcgaggccgacatcagaggcttcgtggccgccgtggtgaacggcagcgcccagggcgcccagatcggcgccatgctgatggccatcagactgagaggcatggacctggaggagaccagcgtgctgacccaggccctggcccagagcggccagcagctggagtggcccgaggcctggagacagcagctggtggacaagcacagcaccggcggcgtgggcgacaaggtgagcctggtgctggcccccgccctggccgcctgcggctgcaaggtgcccatgatcagcggcagaggcctgggccacaccggcggcaccctggacaagctggagagcatccccggcttcaacgtgatccagagccccgagcagatgcaggtgctgctggaccaggccggctgctgcatcgtgggccagagcgagcagctggtgcccgccgacggcatcctgtacgccgccagagacgtgaccgccaccgtggacagcctgcccctgatcaccgccagcatcctgagcaagaagctggtggagggcctgagcgccctggtggtggacgtgaagttcggcggcgccgccgtgttccccaaccaggagcaggccagagagctggccaagaccctggtgggcgtgggcgccagcctgggcctgagagtggccgccgccctgaccgccatggacaagcccctgggcagatgcgtgggccacgccctggaggtggaggaggccctgctgtgcatggacggcgccggcccccccgacctgagagacctggtgaccaccctgggcggcgccctgctgtggctgagcggccacgccggcacccaggcccagggcgccgccagagtggccgccgccctggacgacggcagcgccctgggcagattcgagagaatgctggccgcccagggcgtggaccccggcctggccagagccctgtgcagcggcagccccgccgagagaagacagctgctgcccagagccagagagcaggaggagctgctggcccccgccgacggcaccgtggagctggtgagagccctgcccctggccctggtgctgcacgagctgggcgccggcagaagcagagccggcgagcccctgagactgggcgtgggcgccgagctgctggtggacgtgggccagagactgagaagaggcaccccctggctgagagtgcacagagacggccccgccctgagcggcccccagagcagagccctgcaggaggccctggtgctgagcgacagagcccccttcgccgcccccagccccttcgccgagctggtgctgcccccccagcagtag

SEQ ID NO: 13177 - DNA, 1449 bp, Artificial Sequence; identical to SEQ ID NO: 13176
  Description of Artificial Sequence: Synthetic coding sequence

SEQ ID NO: 13178 - DNA, 1449 bp, Artificial Sequence; identical to SEQ ID NO: 13176
  Description of Artificial Sequence: Synthetic coding sequence

SEQ ID NO: 13179 - DNA, 1233 bp, Artificial Sequence
  Description of Artificial Sequence: Synthetic coding sequence
atggaggccgagaacgccggcagctacagcctgcagcaggcccaggccttctacaccttccccttccagcagctgatggccgaggcccccaacatggccgtggtgaacgagcagcagatgcccgaggaggtgcccgcccccgcccccgcccaggagcccgtgcaggaggcccccaagggcagaaagagaaagcccagaaccaccgagcccaagcagcccgtggagcccaagaagcccgtggagagcaagaagagcggcaagagcgccaagagcaaggagaagcaggagaagatcaccgacaccttcaaggtgaagagaaaggtggacagattcaacggcgtgagcgaggccgagctgctgaccaagaccctgcccgacatcctgaccttcaacctggacatcgtgatcatcggcatcaaccccggcctgatggccgcctacaagggccaccactaccccggccccggcaaccacttctggaagtgcctgttcatgagcggcctgagcgaggtgcagctgaaccacatggacgaccacaccctgcccggcaagtacggcatcggcttcaccaacatggtggagagaaccacccccggcagcaaggacctgagcagcaaggagttcagagagggcggcagaatcctggtgcagaagctgcagaagtaccagcccagaatcgccgtgttcaacggcaagtgcatctacgagatcttcagcaaggaggtgttcggcgtgaaggtgaagaacctggagttcggcctgcagccccacaagatccccgacaccgagaccctgtgctacgtgatgcccagcagcagcgccagatgcgcccagttccccagagcccaggacaaggtgcactactacatcaagctgaaggacctgagagaccagctgaagggcatcgagagaaacatggacgtgcaggaggtgcagtacaccttcgacctgcagctggcccaggaggacgccaagaagatggccgtgaaggaggagaagtacgaccccggctacgaggccgcctacggcggcgcctacggcgagaacccctgcagcagcgagccctgcggcttcagcagcaacggcctgatcgagagcgtggagctgagaggcgagagcgccttcagcggcatccccaacggccagtggatgacccagagcttcaccgaccagatccccagcttcagcaaccactgcggcacccaggagcaggaggaggagagccacgcctag

SEQ ID NO: 13180 - DNA, 621 bp, Artificial Sequence
  Description of Artificial Sequence: Synthetic coding sequence
atgatcaccctgtaccagggcagcatggtgctggacctgcccacctggtggaagggccccagacccgccgccaagatcagccccggcatctacgagatcttcagcaaggaggtgttcggcgtgaaggtgaagaacctggagttcggcctgcagccccacaagatccccgacaccgagaccctgtgctacgtgatgcccagcagcagcgccagatgcgcccagttccccagagcccaggacaaggtgcactactacatcaagctgaaggacctgagagaccagctgaagggcatcgagagaaacatggacgtgcaggaggtgcagtacaccttcgacctgcagctggcccaggaggacgccaagaagatggccgtgaaggaggagaagtacgaccccggctacgaggccgcctacggcggcgcctacggcgagaacccctgcagcagcgagccctgcggcttcagcagcaacggcctgatcgagagcgtggagctgagaggcgagagcgccttcagcggcatccccaacggccagtggatgacccagagcttcaccgaccagatccccagcttcagcaaccactgcggcacccaggagcaggaggaggagagccacgcctag

SEQ ID NO: 13181 - DNA, 3294 bp, Artificial Sequence
  Description of Artificial Sequence: Synthetic coding sequence
atgagcagctgcagaagcctgtgctgcggcgacatcagccagagcgccgtgctgttcctgtgccagggcaccctggccatgctggactggcagaacggcagcatgggcagaagcggcgaggccctgctgctggacaccgcccacgtgctgttcaccctgagcagccagatcaaggagcccaccctggagatgttcctgagcagaatcctggccagctggaccaacagcgccatccaggtgctggagagcagcagccccagcctgaccgacagcctgaacggcaacagcagcatcgtgggcagactgctggagtacgtgtacacccactgggagcaccccctggacgccctgagacaccagaccaagatcatgttcaagaacctgctgcagatgcacagactgaccgtggagggcgccgacttcgtgcccgaccccttcttcgtggagctgaccgagagcctgctgagactggagtggcacatcaagggcaagtacacctgcctgggctgcctggtggagtgcatcggcgtggagcacatcctggccatcgacaagaccatccccagccagatcctggaggtgatgggcgaccagagcctggtgccctacgccagcgacctgctggagaccatgttcagaaaccacaagagccacctgaagagccagaccgccgagagcagctggatcgaccagtggcacgagacctgggtgagccccctgctgttcatcctgtgcgagggcaacctggaccagaagagctacgtgatcgactactacctgcccaagctgctgagctacagccccgagagcctgcagtacatggtgaagatcctgcagaccagcatcgacgccaagaccggccaggagcagagcttccccagcctgggcagctgcaacagcagaggcgccctgggcgccctgatggcctgcctgagaatcgccagagcccacggccacctgcagagcgccaccgacacctgggagaacctggtgagcgacgccagaatcaagcagggcctgatccaccagcactgccaggtgagaatcgacaccctgggcctgctgtgcgagagcaacagaagcaccgagatcgtgagcatggaggagatgcagtggatccagttcttcatcacctacaacctgaacagccagagccccggcgtgagacagcagatctgcagcctgctgaagaagctgttctgcagaatccaggagagcagccaggtgctgtacaagctggagcagagcaagagcaagagagagcccgagaacgagctgaccaagcagcaccccagcgtgagcctgcagcagtacaagaacttcatgagcagcatctgcaacagcctgttcgaggccctgttccccggcagcagctacagcaccagattcagcgccctgaccatcctgggcagcatcgccgaggtgttccacgtgcccgagggcagaatctacaccgtgtaccagctgagccacgacatcgacgtgggcagattccagaccctgatggagtgcttcaccagcaccttcgaggacgtgaagatcctggccttcgacctgctgatgaagctgagcaagaccgccgtgcacttccaggacagcggcaagctgcagggcctgttccaggccgccctggagctgagcaccagcaccaagccctacgactgcgtgaccgccagctacctgctgaacttcctgatctggcaggacgccctgcccagcagcctgagcgcctacctgacccagcaggtggcctgcgacaacggcgacagacccgccgccgtggtggagagaaacaccctgatggtgatcaagtgcctgatggagaacctggaggaggaggtgagccaggccgagaacagcctgctgcaggccgccgccgccttccccatgtacggcagagtgcactgcatcaccggcgccctgcagaagctgagcctgaacagcctgcagctggtgagcgagtggagacccgtggtggagaagctgctgctgatgagctacagactgagcaccgtggtgagccccgtgatccagagcagcagccccgagggcctgatccccatggacaccgacagcgagagcgccagcagactgcagatgatcctgaacgagatccagcccagagacaccaacgactacttcaaccaggccaagatcctgaaggagcacgacagcttcgacatgaaggacctgaacgccagcgtggtgaacatcgacaccagcaccgagatcaagggcaaggaggtgaagacctgcgacgtgaccgcccagatggtgctggtgtgctgctggagaagcatgaaggaggtggccctgctgctgggcatgctgtgccagctgctgcccatgcagcccgtgcccgagagcagcgacggcctgctgaccgtggagcaggtgaaggagatcggcgactacttcaagcagcacctgctgcagagcagacacagaggcgccttcgagctggcctacaccggcttcgtgaagctgaccgaggtgctgaacagatgccccaacgtgagcctgcagaagctgcccgagcagtggctgtggagcgtgctggaggagatcaagtgcagcgaccccagcagcaagctgtgcgccaccagaagaagcgccggcatccccttctacatccaggccctgctggccagcgagcccaagaagggcagaatggacctgctgaagatcaccatgaaggagctgatcagcctggccggccccaccgacgacatccagagcaccgtgccccaggtgcacgccctgaacatcctgagagccctgttcagagacaccagactgggcgagaacatcatcccctacgtggccgacggcgccaaggccgccatcctgggcttcaccagccccgtgtgggccgtgagaaacagcagcaccctgctgttcagcgccctgatcaccagaatcttcggcgtgaagagagccaaggacgagcacagcaagaccaacagaatgaccggcagagagttcttcagcagattccccgagctgtaccccttcctgctgaagcagctggagaccgtggccaacaccgtggacagcgacatgggcgagcccaacagacaccccagcatgttcctgctgctgctggtgctggagagactgtacgccagccccatggacggcaccagcagcgccctgagcatgggccccttcgtgcccttcatcatgagagtgctgctgtgctgccccggctggagcgccgtggccagaagccagctgaccgccaccagcaccagctgggtgcaggccatcctgctgccccagccccccgagtag

SEQ ID NO: 13182 - DNA, 5643 bp, Artificial Sequence
  Description of Artificial Sequence: Synthetic coding sequence
atgggcgtgaagaagaagaaggagatgcaggtggccgccctgaccatctgccaccaggacctggagaccctgaagagcttcgccgacgtggagggcaagaacctggccagcctgctgctgcactgcgtgcagctgaccgacggcgtgagccagatccactacatcaagcagatcgtgcccctgctggagaaggccgacaagaacggcatgtgcgaccccaccatccagagctgcctggacatcctggccggcatctacctgagcctgagcctgaagaaccccctgaagaaggtgctggccagcagcctgaacagcctgcccgacttcttcctgcccgaggccatgcacagattcaccagcagactgcaggaggagctgaacaccaccgacctgtacagctacagaaaggtgaccgacaacatcagcagctgcatggagaacttcaacctgggcagagccagcgtgaacaacctgctgaagaacgtgctgcacttcctgcagaagagcctgatcgagatcctggaggagaacagaaagtgcgccggcaaccacatcatccagacccagctgatgaacgacctgctggtgggcatcagagtgagcatgatgctggtgcagaaggtgcaggacttccagggcaacctgtggaagaccagcgacagccccatctggcagaacatgtgcggcctgctgagcatcttcaccaaggtgctgagcgacgacgacctgctgcagaccgtgcagagcaccagcggcctggccatcatcctgttcatcaagaccatgttccaccccagcgagaagatcccccacctgatcagcagcgtgctgctgagaagcgtggactgcaccagcgtgcccgagtggttcatgagcagctgcagaagcctgtgctgcggcgacatcagccagagcgccgtgctgttcctgtgccagggcaccctggccatgctggactggcagaacggcagcatgggcagaagcggcgaggccctgctgctggacaccgcccacgtgctgttcaccctgagcagccagatcaaggagcccaccctggagatgttcctgagcagaatcctggccagctggaccaacagcgccatccaggtgctggagagcagcagccccagcctgaccgacagcctgaacggcaacagcagcatcgtgggcagactgctggagtacgtgtacacccactgggagcaccccctggacgccctgagacaccagaccaagatcatgttcaagaacctgctgcagatgcacagactgaccgtggagggcgccgacttcgtgcccgaccccttcttcgtggagctgaccgagagcctgctgagactggagtggcacatcaagggcaagtacacctgcctgggctgcctggtggagtgcatcggcgtggagcacatcctggccatcgacaagaccatccccagccagatcctggaggtgatgggcgaccagagcctggtgccctacgccagcgacctgctggagaccatgttcagaaaccacaagagccacctgaagagccagaccgccgagagcagctggatcgaccagtggcacgagacctgggtgagccccctgctgttcatcctgtgcgagggcaacctggaccagaagagctacgtgatcgactactacctgcccaagctgctgagctacagccccgagagcctgcagtacatggtgaagatcctgcagaccagcatcgacgccaagaccggccaggagcagagcttccccagcctgggcagctgcaacagcagaggcgccctgggcgccctgatggcctgcctgagaatcgccagagcccacggccacctgcagagcgccaccgacacctgggagaacctggtgagcgacgccagaatcaagcagggcctgatccaccagcactgccaggtgagaatcgacaccctgggcctgctgtgcgagagcaacagaagcaccgagatcgtgagcatggaggagatgcagtggatccagttcttcatcacctacaacctgaacagccagagccccggcgtgagacagcagatctgcagcctgctgaagaagaagctgttctgcagaatccaggagagcagccaggtgctgtacaagctggagcagagcaagagcaagagagagcccgagaacgagctgaccaagcagcaccccagcgtgagcctgcagcagtacaagaacttcatgagcagcatctgcaacagcctgttcgaggccctgttccccggcagcagctacagcaccagattcagcgccctgaccatcctgggcagcatcgccgaggtgttccacgtgcccgagggcagaatctacaccgtgtaccagctgagccacgacatcgacgtgggcagattccagaccctgatggagtgcttcaccagcaccttcgaggacgtgaagatcctggccttcgacctgctgatgaagctgagcaagaccgccgtgcacttccaggacagcggcaagctgcagggcctgttccaggccgccctggagctgagcaccagcaccaagccctacgactgcgtgaccgccagctacctgctgaacttcctgatctggcaggacgccctgcccagcagcctgagcgcctacctgacccagcaggtggcctgcgacaacggcgacagacccgccgccgtggtggagagaaacaccctgatggtgatcaagtgcctgatggagaacctggaggaggaggtgagccaggccgagaacagcctgctgcaggccgccgccgccttccccatgtacggcagagtgcactgcatcaccggcgccctgcagaagctgagcctgaacagcctgcagctggtgagcgagtggagacccgtggtggagaagctgctgctgatgagctacagactgagcaccgtggtgagccccgtgatccagagcagcagccccgagggcctgatccccatggacaccgacagcgagagcgccagcagactgcagatgatcctgaacgagatccagcccagagacaccaacgactacttcaaccaggccaagatcctgaaggagcacgacagcttcgacatgaaggacctgaacgccagcgtggtgaacatcgacaccagcaccgagatcaagggcaaggaggtgaagacctgcgacgtgaccgcccagatggtgctggtgtgctgctggagaagcatgaaggaggtggccctgctgctgggcatgctgtgccagctgctgcccatgcagcccgtgcccgagagcagcgacggcctgctgaccgtggagcaggtgaaggagatcggcgactacttcaagcagcacctgctgcagagcagacacagaggcgccttcgagctggcctacaccggcttcgtgaagctgaccgaggtgctgaacagatgccccaacgtgagcctgcagaagctgcccgagcagtggctgtggagcgtgctggaggagatcaagtgcagcgaccccagcagcaagctgtgcgccaccagaagaagcgccggcatccccttctacatccaggccctgctggccagcgagcccaagaagggcagaatggacctgctgaagatcaccatgaaggagctgatcagcctggccggccccaccgacgacatccagagcaccgtgccccaggtgcacgccctgaacatcctgagagccctgttcagagacaccagactgggcgagaacatcatcccctacgtggccgacggcgccaaggccgccatcctgggcttcaccagccccgtgtgggccgtgagaaacagcagcaccctgctgttcagcgccctgatcaccagaatcttcggcgtgaagagagccaaggacgagcacagcaagaccaacagatgcggccacagccccgtgtaccacagcagagagatggccgccagagccctggtgcccttcgtgatgatcgaccacatccccaacaccatcagaaccctgctgagcaccctgcccagctgcaccgaccagtgcttcagacagaaccacatccacggcaccctgctgcaggtgttccacctgctgcaggcctacagcgacagcaagcacggcaccaacagcgacttccagcacgagctgaccgacatcaccgtgtgcaccaaggccaagctgtggctggccaagagacagaacccctgcctggtgaccagagccgtgtacatcgacatcctgttcctgctgacctgctgcctgaacagaagcgccaaggacaaccagcccgtgctggagagcctgggcttctgggaggaggtgagaggcatcatcagcggcagcgagctgatcaccggcttcccctgggccttcaaggtgcccggcctgccccagtacctgcagagcctgaccagactggccatcgccgccgtgtgggccgccgccgccaagagcggcgagagagagaccaacgtgcccatcagcttcagccagctgctggagagcgccttccccgaggtgagaagcctgaccctggaggccctgctggagaagttcctggccgccgccagcggcctgggcgagaagggcgtgccccccctgctgtgcaacatgggcgagaagttcctgctgctggccatgaaggagaaccaccccgagtgcttctgcaagatcctgaagatcctgcactgcatggaccccggcgagtggctgccccagaccgagcactgcgtgcacctgacccccaaggagttcctgatctggaccatggacatcgccagcaacgagagaagcgagatccagagcgtggccctgagactggccagcaaggtgatcagccaccacatgcagacctgcgtggagaacagagagctgatcgccgccgagctgaagcagtgggtgcagctggtgatcctgagctgcgaggaccacctgcccaccgagagcagactggccgtggtggaggtgctgaccagcaccacccccctgttcctgaccaacccccaccccatcctggagctgcaggacaccctggccctgtggaagtgcgtgctgaccctgctgcagagcgaggagcaggccgtgagagacgccgccaccgagaccgtgaccaccgccatgagccaggagaacacctgccagagcaccgagttcgccttctgccaggtggacgccagcatcgccctggccctggccctggccgtgctgtgcgacctgctgcagcagtgggaccagctggcccccggcctgcccatcctgctgggctggctgctgggcgagagcgacgacctggtggcctgcgtggagagcatgcaccaggtggaggaggactacctgttcgagaaggccgaggtgaacttctgggccgagaccctgatcttcgtgaagtacctgtgcaagcacctgttctgcctgctgagcaagagcggctggagaccccccagccccgagatgctgtgccacctgcagagaatggtgagcgagcagtgccacctgctgagccagttcttcagagagctgccccccgccgccgagttcgtgaagaccgtggagttcaccagactgagaatccaggaggagagaaccctggcctgcctgagactgctggccttcctggagggcaaggagggcgaggacaccctggtgctgagcgtgtgggacagctacgccgagagcagacagctgaccctgcccagaaccgaggccgcctgctag

SEQ ID NO: 13183 - DNA, 5862 bp, Artificial Sequence
  Description of Artificial Sequence: Synthetic coding sequence
atgggcgtgaagaagaagaaggagatgcaggtggccgccctgaccatctgccaccaggacctggagaccctgaagagcttcgccgacgtggagggcaagaacctggccagcctgctgctgcactgcgtgcagctgaccgacggcgtgagccagatccactacatcaagcagatcgtgcccctgctggagaaggccgacaagaacggcatgtgcgaccccaccatccagagctgcctggacatcctggccggcatctacctgagcctgagcctgaagaaccccctgaagaaggtgctggccagcagcctgaacagcctgcccgacttcttcctgcccgaggccatgcacagattcaccagcagactgcaggaggagctgaacaccaccgacctgtacagctacagaaaggtgaccgacaacatcagcagctgcatggagaacttcaacctgggcagagccagcgtgaacaacctgctgaagaacgtgctgcacttcctgcagaagagcctgatcgagatcctggaggagaacagaaagtgcgccggcaaccacatcatccagacccagctgatgaacgacctgctggtgggcatcagagtgagcatgatgctggtgcagaaggtgcaggacttccagggcaacctgtggaagaccagcgacagccccatctggcagaacatgtgcggcctgctgagcatcttcaccaaggtgctgagcgacgacgacctgctgcagaccgtgcagagcaccagcggcctggccatcatcctgttcatcaagaccatgttccaccccagcgagaagatcccccacctgatcagcagcgtgctgctgagaagcgtggactgcaccagcgtgcccgagtggttcatgagcagctgcagaagcctgtgctgcggcgacatcagccagagcgccgtgctgttcctgtgccagggcaccctggccatgctggactggcagaacggcagcatgggcagaagcggcgaggccctgctgctggacaccgcccacgtgctgttcaccctgagcagccagatcaaggagcccaccctggagatgttcctgagcagaatcctggccagctggaccaacagcgccatccaggtgctggagagcagcagccccagcctgaccgacagcctgaacggcaacagcagcatcgtgggcagactgctggagtacgtgtacacccactgggagcaccccctggacgccctgagacaccagaccaagatcatgttcaagaacctgctgcagatgcacagactgaccgtggagggcgccgacttcgtgcccgaccccttcttcgtggagctgaccgagagcctgctgagactggagtggcacatcaagggcaagtacacctgcctgggctgcctggtggagtgcatcggcgtggagcacatcctggccatcgacaagaccatccccagccagatcctggaggtgatgggcgaccagagcctggtgccctacgccagcgacctgctggagaccatgttcagaaaccacaagagccacctgaagagccagaccgccgagagcagctggatcgaccagtggcacgagacctgggtgagccccctgctgttcatcctgtgcgagggcaacctggaccagaagagctacgtgatcgactactacctgcccaagctgctgagctacagccccgagagcctgcagtacatggtgaagatcctgcagaccagcatcgacgccaagaccggccaggagcagagcttccccagcctgggcagctgcaacagcagaggcgccctgggcgccctgatggcctgcctgagaatcgccagagcccacggccacctgcagagcgccaccgacacctgggagaacctggtgagcgacgccagaatcaagcagggcctgatccaccagcactgccaggtgagaatcgacaccctgggcctgctgtgcgagagcaacagaagcaccgagatcgtgagcatggaggagatgcagtggatccagttcttcatcacctacaacctgaacagccagagccccggcgtgagacagcagatctgcagcctgctgaagaagctgttctgcagaatccaggagagcagccaggtgctgtacaagctggagcagagcaagagcaagagagagcccgagaacgagctgaccaagcagcaccccagcgtgagcctgcagcagtacaagaacttcatgagcagcatctgcaacagcctgttcgaggccctgttccccggcagcagctacagcaccagattcagcgccctgaccatcctgggcagcatcgccgaggtgttccacgtgcccgagggcagaatctacaccgtgtaccagctgagccacgacatcgacgtgggcagattccagaccctgatggagtgcttcaccagcaccttcgaggacgtgaagatcctggccttcgacctgctgatgaagctgagcaagaccgccgtgcacttccaggacagcggcaagctgcagggcctgttccaggccgccctggagctgagcaccagcaccaagccctacgactgcgtgaccgccagctacctgctgaacttcctgatctggcaggacgccctgcccagcagcctgagcgcctacctgacccagcaggtggcctgcgacaacggcgacagacccgccgccgtggtggagagaaacaccctgatggtgatcaagtgcctgatggagaacctggaggaggaggtgagccaggccgagaacagcctgctgcaggccgccgccgccttccccatgtacggcagagtgcactgcatcaccggcgccctgcagaagctgagcctgaacagcctgcagctggtgagcgagtggagacccgtggtggagaagctgctgctgatgagctacagactgagcaccgtggtgagccccgtgatccagagcagcagccccgagggcctgatccccatggacaccgacagcgagagcgccagcagactgcagatgatcctgaacgagatccagcccagagacaccaacgactacttcaaccaggccaagatcctgaaggagcacgacagcttcgacatgaaggacctgaacgccagcgtggtgaacatcgacaccagcaccgagatcaagggcaaggaggtgaagacctgcgacgtgaccgcccagatggtgctggtgtgctgctggagaagcatgaaggaggtggccctgctgctgggcatgctgtgccagctgctgcccatgcagcccgtgcccgagagcagcgacggcctgctgaccgtggagcaggtgaaggagatcggcgactacttcaagcagcacctgctgcagagcagacacagaggcgccttcgagctggcctacaccggcttcgtgaagctgaccgaggtgctgaacagatgccccaacgtgagcctgcagaagctgcccgagcagtggctgtggagcgtgctggaggagatcaagtgcagcgaccccagcagcaagctgtgcgccaccagaagaagcgccggcatccccttctacatccaggccctgctggccagcgagcccaagaagggcagaatggacctgctgaagatcaccatgaaggagctgatcagcctggccggccccaccgacgacatccagagcaccgtgccccaggtgcacgccctgaacatcctgagagccctgttcagagacaccagactgggcgagaacatcatcccctacgtggccgacggcgccaaggccgccatcctgggcttcaccagccccgtgtgggccgtgagaaacagcagcaccctgctgttcagcgccctgatcaccagaatcttcggcgtgaagagagccaaggacgagcacagcaagaccaacagaatgaccggcagagagttcttcagcagattccccgagctgtaccccttcctgctgaagcagctggagaccgtggccaacaccgtggacagcgacatgggcgagcccaacagacaccccagcatgttcctgctgctgctggtgctggagagactgtacgccagccccatggacggcaccagcagcgccctgagcatgggccccttcgtgcccttcatcatgagatgcggccacagccccgtgtaccacagcagagagatggccgccagagccctggtgcccttcgtgatgatcgaccacatccccaacaccatcagaaccctgctgagcaccctgcccagctgcaccgaccagtgcttcagacagaaccacatccacggcaccctgctgcaggtgttccacctgctgcaggcctacagcgacagcaagcacggcaccaacagcgacttccagcacgagctgaccgacatcaccgtgtgcaccaaggccaagctgtggctggccaagagacagaacccctgcctggtgaccagagccgtgtacatcgacatcctgttcctgctgacctgctgcctgaacagaagcgccaaggacaaccagcccgtgctggagagcctgggcttctgggaggaggtgagaggcatcatcagcggcagcgagctgatcaccggcttcccctgggccttcaaggtgcccggcctgccccagtacctgcagagcctgaccagactggccatcgccgccgtgtgggccgccgccgccaagagcggcgagagagagaccaacgtgcccatcagcttcagccagctgctggagagcgccttccccgaggtgagaagcctgaccctggaggccctgctggagaagttcctggccgccgccagcggcctgggcgagaagggcgtgccccccctgctgtgcaacatgggcgagaagttcctgctgctggccatgaaggagaaccaccccgagtgcttctgcaagatcctgaagatcctgcactgcatggaccccggcgagtggctgccccagaccgagcactgcgtgcacctgacccccaaggagttcctgatctggaccatggacatcgccagcaacgagagaagcgagatccagagcgtggccctgagactggccagcaaggtgatcagccaccacatgcagacctgcgtggagaacagagagctgatcgccgccgagctgaagcagtgggtgcagctggtgatcctgagctgcgaggaccacctgcccaccgagagcagactggccgtggtggaggtgctgaccagcaccacccccctgttcctgaccaacccccaccccatcctggagctgcaggacaccctggccctgtggaagtgcgtgctgaccctgctgcagagcgaggagcaggccgtgagagacgccgccaccgagaccgtgaccaccgccatgagccaggagaacacctgccagagcaccgagttcgccttctgccaggtggacgccagcatcgccctggccctggccctggccgtgctgtgcgacctgctgcagcagtgggaccagctggcccccggcctgcccatcctgctgggctggctgctgggcgagagcgacgacctggtggcctgcgtggagagcatgcaccaggtggaggaggactacctgttcgagaaggccgaggtgaacttctgggccgagaccctgatcttcgtgaagtacctgtgcaagcacctgttctgcctgctgagcaagagcggctggagaccccccagccccgagatgctgtgccacctgcagagaatggtgagcgagcagtgccacctgctgagccagttcttcagagagctgccccccgccgccgagttcgtgaagaccgtggagttcaccagactgagaatccaggaggagagaaccctggcctgcctgagactgctggccttcctggagggcaaggagggcgaggacaccctggtgctgagcgtgtgggacagctacgccgagagcagacagctgaccctgcccagaaccgaggccgcctgctag

SEQ ID NO: 13184 - DNA, 5862 bp, Artificial Sequence; identical to SEQ ID NO: 13183
  Description of Artificial Sequence: Synthetic coding sequence

SEQ ID NO: 13185 - DNA, 4905 bp, Artificial Sequence
  Description of Artificial Sequence: Synthetic coding sequence
atgagcagctgcagaagcctgtgctgcggcgacatcagccagagcgccgtgctgttcctgtgccagggcaccctggccatgctggactggcagaacggcagcatgggcagaagcggcgaggccctgctgctggacaccgcccacgtgctgttcaccctgagcagccagatcaaggagcccaccctggagatgttcctgagcagaatcctggccagctggaccaacagcgccatccaggtgctggagagcagcagccccagcctgaccgacagcctgaacggcaacagcagcatcgtgggcagactgctggagtacgtgtacacccactgggagcaccccctggacgccctgagacaccagaccaagatcatgttcaagaacctgctgcagatgcacagactgaccgtggagggcgccgacttcgtgcccgaccccttcttcgtggagctgaccgagagcctgctgagactggagtggcacatcaagggcaagtacacctgcctgggctgcctggtggagtgcatcggcgtggagcacatcctggccatcgacaagaccatccccagccagatcctggaggtgatgggcgaccagagcctggtgccctacgccagcgacctgctggagaccatgttcagaaaccacaagagccacctgaagagccagaccgccgagagcagctggatcgaccagtggcacgagacctgggtgagccccctgctgttcatcctgtgcgagggcaacctggaccagaagagctacgtgatcgactactacctgcccaagctgctgagctacagccccgagagcctgcagtacatggtgaagatcctgcagaccagcatcgacgccaagaccggccaggagcagagcttccccagcctgggcagctgcaacagcagaggcgccctgggcgccctgatggcctgcctgagaatcgccagagcccacggccacctgcagagcgccaccgacacctgggagaacctggtgagcgacgccagaatcaagcagggcctgatccaccagcactgccaggtgagaatcgacaccctgggcctgctgtgcgagagcaacagaagcaccgagatcgtgagcatggaggagatgcagtggatccagttcttcatcacctacaacctgaacagccagagccccggcgtgagacagcagatctgcagcctgctgaagaagctgttctgcagaatccaggagagcagccaggtgctgtacaagctggagcagagcaagagcaagagagagcccgagaacgagctgaccaagcagcaccccagcgtgagcctgcagcagtacaagaacttcatgagcagcatctgcaacagcctgttcgaggccctgttccccggcagcagctacagcaccagattcagcgccctgaccatcctgggcagcatcgccgaggtgttccacgtgcccgagggcagaatctacaccgtgtaccagctgagccacgacatcgacgtgggcagattccagaccctgatggagtgcttcaccagcaccttcgaggacgtgaagatcctggccttcgacctgctgatgaagctgagcaagaccgccgtgcacttccaggacagcggcaagctgcagggcctgttccaggccgccctggagctgagcaccagcaccaagccctacgactgcgtgaccgccagctacctgctgaacttcctgatctggcaggacgccctgcccagcagcctgagcgcctacctgacccagcaggtggcctgcgacaacggcgacagacccgccgccgtggtggagagaaacaccctgatggtgatcaagtgcctgatggagaacctggaggaggaggtgagccaggccgagaacagcctgctgcaggccgccgccgccttccccatgtacggcagagtgcactgcatcaccggcgccctgcagaagctgagcctgaacagcctgcagctggtgagcgagtggagacccgtggtggagaagctgctgctgatgagctacagactgagcaccgtggtgagccccgtgatccagagcagcagccccgagggcctgatccccatggacaccgacagcgagagcgccagcagactgcagatgatcctgaacgagatccagcccagagacaccaacgactacttcaaccaggccaagatcctgaaggagcacgacagcttcgacatgaaggacctgaacgccagcgtggtgaacatcgacaccagcaccgagatcaagggcaaggaggtgaagacctgcgacgtgaccgcccagatggtgctggtgtgctgctggagaagcatgaaggaggtggccctgctgctgggcatgctgtgccagctgctgcccatgcagcccgtgcccgagagcagcgacggcctgctgaccgtggagcaggtgaaggagatcggcgactacttcaagcagcacctgctgcagagcagacacagaggcgccttcgagctggcctacaccggcttcgtgaagctgaccgaggtgctgaacagatgccccaacgtgagcctgcagaagctgcccgagcagtggctgtggagcgtgctggaggagatcaagtgcagcgaccccagcagcaagctgtgcgccaccagaagaagcgccggcatccccttctacatccaggccctgctggccagcgagcccaagaagggcagaatggacctgctgaagatcaccatgaaggagctgatcagcctggccggccccaccgacgacatccagagcaccgtgccccaggtgcacgccctgaacatcctgagagccctgttcagagacaccagactgggcgagaacatcatcccctacgtggccgacggcgccaaggccgccatcctgggcttcaccagccccgtgtgggccagccagatgaccggcagagagttcttcagcagattccccgagctgtaccccttcctgctgaagcagctggagaccgtggccaacaccgtggacagcgacatgggcgagcccaacagacaccccagcatgttcctgctgctgctggtgctggagagactgtacgccagccccatggacggcaccagcagcgccctgagcatgggccccttcgtgcccttcatcatgagatgcggccacagccccgtgtaccacagcagagagatggccgccagagccctggtgcccttcgtgatgatcgaccacatccccaacaccatcagaaccctgctgagcaccctgcccagctgcaccgaccagtgcttcagacagaaccacatccacggcaccctgctgcaggtgttccacctgctgcaggcctacagcgacagcaagcacggcaccaacagcgacttccagcacgagctgaccgacatcaccgtgtgcaccaaggccaagctgtggctggccaagagacagaacccctgcctggtgaccagagccgtgtacatcgacatcctgttcctgctgacctgctgcctgaacagaagcgccaaggacaaccagcccgtgctggagagcctgggcttctgggaggaggtgagaggcatcatcagcggcagcgagctgatcaccggcttcccctgggccttcaaggtgcccggcctgccccagtacctgcagagcctgaccagactggccatcgccgccgtgtgggccgccgccgccaagagcggcgagagagagaccaacgtgcccatcagcttcagccagctgctggagagcgccttccccgaggtgagaagcctgaccctggaggccctgctggagaagttcctggccgccgccagcggcctgggcgagaagggcgtgccccccctgctgtgcaacatgggcgagaagttcctgctgctggccatgaaggagaaccaccccgagtgcttctgcaagatcctgaagatcctgcactgcatggaccccggcgagtggctgccccagaccgagcactgcgtgcacctgacccccaaggagttcctgatctggaccatggacatcgccagcaacgagagaagcgagatccagagcgtggccctgagactggccagcaaggtgatcagccaccacatgcagacctgcgtggagaacagagagctgatcgccgccgagctgaagcagtgggtgcagctggtgatcctgagctgcgaggaccacctgcccaccgagagcagactggccgtggtggaggtgctgaccagcaccacccccctgttcctgaccaacccccaccccatcctggagctgcaggacaccctggccctgtggaagtgcgtgctgaccctgctgcagagcgaggagcaggccgtgagagacgccgccaccgagaccgtgaccaccgccatgagccaggagaacacctgccagagcaccgagttcgccttctgccaggtggacgccagcatcgccctggccctggccctggccgtgctgtgcgacctgctgcagcagtgggaccagctggcccccggcctgcccatcctgctgggctggctgctgggcgagagcgacgacctggtggcctgcgtggagagcatgcaccaggtggaggaggactacctgttcgagaaggccgaggtgaacttctgggccgagaccctgatcttcgtgaagtacctgtgcaagcacctgttctgcctgctgagcaagagcggctggagaccccccagccccgagatgctgtgccacctgcagagaatggtgagcgagcagtgccacctgctgagccagttcttcagagagctgccccccgccgccgagttcgtgaagaccgtggagttcaccagactgagaatccaggaggagagaaccctggcctgcctgagactgctggccttcctggagggcaaggagggcgaggacaccctggtgctgagcgtgtgggacagctacgccgagagcagacagctgaccctgcccagaaccgaggccgcctgctag

SEQ ID NO: 13186 - DNA, 2685 bp, Artificial Sequence
  Description of Artificial Sequence: Synthetic coding sequence
atgggcgtgaagaagaagaaggagatgcaggtggccgccctgaccatctgccaccaggacctggagaccctgaagagcttcgccgacgtggagggcaagaacctggccagcctgctgctgcactgcgtgcagctgaccgacggcgtgagccagatccactacatcaagcagatcgtgcccctgctggagaaggccgacaagaacggcatgtgcgaccccaccatccagagctgcctggacatcctggccggcatctacctgagcctgagcctgaagaaccccctgaagaaggtgctggccagcagcctgaacagcctgcccgacttcttcctgcccgaggccatgcacagattcaccagcagactgcaggaggagctgaacaccaccgacctgtacagctacagaaaggtgaccgacaacatcagcagctgcatggagaacttcaacctgggcagagccagcgtgaacaacctgctgaagaacgtgctgcacttcctgcagaagagcctgatcgagatcctggaggagaacagaaagtgcgccggcaaccacatcatccagacccagctgatgaacgacctgctggtgggcatcagagtgagcatgatgctggtgcagaaggtgcaggacttccagggcaacctgtggaagaccagcgacagccccatctggcagaacatgtgcggcctgctgagcatcttcaccaaggtgctgagcgacgacgacctgctgcagaccgtgcagagcaccagcggcctggccatcatcctgttcatcaagaccatgttccaccccagcgagaagatcccccacctgatcagcagcgtgctgctgagaagcgtggactgcaccagcgtgcccgagtggttcatgagcagctgcagaagcctgtgctgcggcgacatcagccagagcgccgtgctgttcctgtgccagggcaccctggccatgctggactggcagaacggcagcatgggcagaagcggcgaggccctgctgctggacaccgcccacgtgctgttcaccctgagcagccagatcaaggagcccaccctggagatgttcctgagcagaatcctggccagctggaccaacagcgccatccaggtgctggagagcagcagccccagcctgaccgacagcctgaacggcaacagcagcatcgtgggcagactgctggagtacgtgtacacccactgggagcaccccctggacgccctgagacaccagaccaagatcatgttcaagaacctgctgcagatgcacagactgaccgtggagggcgccgacttcgtgcccgaccccttcttcgtggagctgaccgagagcctgctgagactggagtggcacatcaagggcaagtacacctgcctgggctgcctggtggagtgcatcggcgtggagcacatcctggccatcgacaagaccatccccagccagatcctggaggtgatgggcgaccagagcctggtgccctacgccagcgacctgctggagaccatgttcagaaaccacaagagccacctgaagagccagaccgccgagagcagctggatcgaccagtggcacgagacctgggtgagccccctgctgttcatcctgtgcgagggcaacctggaccagaagagctacgtgatcgactactacctgcccaagctgctgagctacagccccgagagcctgcagtacatggtgaagatcctgcagaccagcatcgacgccaagaccggccaggagcagagcttccccagcctgggcagctgcaacagcagaggcgccctgggcgccctgatggcctgcctgagaatcgccagagcccacggccacctgcagagcgccaccgacacctgggagaacctggtgagcgacgccagaatcaagcagggcctgatccaccagcactgccaggtgagaatcgacaccctgggcctgctgtgcgagagcaacagaagcaccgagatcgtgagcatggaggagatgcagtggatccagttcttcatcacctacaacctgaacagccagagccccggcgtgagacagcagatctgcagcctgctgaagaagctgttctgcagaatccaggagagcagccaggtgctgtacaagctggagcagagcaagagcaagagagagcccgagaacgagctgaccaagcagcaccccagcgtgagcctgcagcagtacaagaacttcatgagcagcatctgcaacagcctgttcgaggccctgttccccggcagcagctacagcaccagattcagcgccctgaccatcctgggcagcatcgccgaggtgttccacgtgcccgagggcagaatctacaccgtgtaccagctgagccacgacatcgacgtgggcagattccagaccctgatggagtgcttcaccagcaccttcgaggacgtgaagatcctggccttcgacctgctgatgaagctgagcaagaccgccgtgcacttccaggacagcggcaagctgcagggcctgttccaggccgccctggagctgagcaccagcaccaagccctacgactgcgtgaccgccagctacctgctgaacttcctgatctggcaggacgccctgcccagcagcctgagcgcctacctgacccagcaggtggcctgcgacaacggcgacagacccgccgccgtggtggagagaaacaccctgatgggcctgtactag

SEQ ID NO: 13187 - DNA, 2268 bp, Artificial Sequence
  Description of Artificial Sequence: Synthetic coding sequence
atgagcggcaccaacctggacggcaacgacgagttcgacgagcagctgagaatgcaggagctgtacggcgacggcaaggacggcgacacccagaccgacgccggcggcgagcccgacagcctgggccagcagcccaccgacaccccctacgagtgggacctggacaagaaggcctggttccccaagatcaccgaggacttcatcgccacctaccaggccaactacggcttcagcaacgacggcgccagcagcagcaccgccaacgtggaggacgtgcacgccagaaccgccgaggagcccccccaggagaaggcccccgagcccaccgacgccagaaagaagggcgagaagagaaaggccgagagcggctggttccacgtggaggaggacagaaacaccaacgtgtacgtgagcggcctgccccccgacatcaccgtggacgagttcatccagctgatgagcaagttcggcatcatcatgagagacccccagaccgaggagttcaaggtgaagctgtacaaggacaaccagggcaacctgaagggcgacggcctgtgctgctacctgaagagagagagcgtggagctggccctgaagctgctggacgaggacgagatcagaggctacaagctgcacgtggaggtggccaagttccagctgaagggcgagtacgacgccagcaagaagaagaagaagtgcaaggactacaagaagaagctgagcatgcagcagaagcagctggactggagacccgagagaagagccggccccagcagaatgagacacgagagagtggtgatcatcaagaacatgttccaccccatggacttcgaggacgaccccctggtgctgaacgagatcagagaggacctgagagtggagtgcagcaagttcggccagatcagaaagctgctgctgttcgacagacaccccgacggcgtggccagcgtgagcttcagagaccccgaggaggccgactactgcatccagaccctggacggcagatggttcggcggcagacagatcaccgcccaggcctgggacggcaccaccgactaccaggtggaggagaccagcagagagagagaggagagactgagaggctgggaggccttcctgaacgcccccgaggccaacagaggcctgagaagaagcgacagcgtgagcgccagcgagagagccggccccagcagagccagacacttcagcgagcaccccagcaccagcaagatgaacgcccaggagaccgccaccggcatggccttcgaggagcccatcgacgagaagaagttcgagaagaccgaggacggcggcgagttcgaggagggcgccagcgagaacaacgccaaggagagcagccccgagaaggaggccgaggagggctgccccgagaaggagagcgaggagggctgccccaagagaggcttcgagggcagctgcagccagaaggagagcgaggagggcaaccccgtgagaggcagcgaggaggacagccccaagaaggagagcaagaagaagaccctgaagaacgactgcgaggagaacggcctggccaaggagagcgaggacgacctgaacaaggagagcgaggaggaggtgggccccaccaaggagagcgaggaggacgacagcgagaaggagagcgacgaggactgcagcgagaagcagagcgaggacggcagcgagagagagttcgaggagaacggcctggagaaggacctggacgaggagggcagcgagaaggagctgcacgagaacgtgctggacaaggagctggaggagaacgacagcgagaacagcgagttcgaggacgacggcagcgagaaggtgctggacgaggagggcagcgagagagagttcgacgaggacagcgacgagaaggaggaggaggaggacacctacgagaaggtgttcgacgacgagagcgacgagaaggaggacgaggagtacgccgacgagaagggcctggaggccgccgacaagaaggccgaggagggcgacgccgacgagaagctgttcgaggagagcgacgacaaggaggacgaggacgccgacggcaaggaggtggaggacgccgacgagaagctgttcgaggacgacgacagcaacgagaagctgttcgacgaggaggaggacagcagcgagaagctgttcgacgacagcgacgagagaggcaccctgggcggcttcggcagcgtggaggagggccccctgagcaccggcagcagcttcatcctgagcagcgacgacgacgacgacgacatctag

SEQ ID NO: 13188 - DNA, 432 bp, Artificial Sequence
  Description of Artificial Sequence: Synthetic coding sequence
atgaccaagatgtacaagggcttccaggccctgggcgacgccgccgacatcagattcgtgtacacccccgccatggagagcgtgtgcggctacttccacagaagccacaacagaagcgaggagttcctgatcgccggcaagctgcaggacggcctgctgcacatcaccacctgcagcttcgtggccccctggaacagcctgagcctggcccagagaagaggcttcaccaagacctacaccgtgggctgcgaggagtgcaccgtgttcccctgcctgagcatcccctgcaagctgcagagcggcacccactgcctgtggaccgaccagctgctgcagggcagcgagaagggcttccagagcagacacctggcctgcctgcccagagagcccggcctgtgcacctggcagagcctgagaagccagatcgcctag

SEQ ID NO: 13189 - DNA, 786 bp, Artificial Sequence
  Description of Artificial Sequence: Synthetic coding sequence
atgcccctgaccagcggcagcagcaccccccccccctggagagtgagcgccgacaccagcaccggccccaccaccgccgccagaagcttcagcctgctggtgagacacagacccagagccctgtgccacaccaaccagagcctgggcagaggcctggccaccaccagaggcagaggcagcgacggcaacggccccaccggcaacggcgaccaccccaacttcagcctgagcgagggcagagccttcggcagcctggccgcccagcccatcaccagctgcctgagcgtgcccgccccccccttcagcctgggcaagctgcaggacggcctgctgcacatcaccacctgcagcttcgtggccccctggaacagcctgagcctggcccagagaagaggcttcaccaagacctacaccgtgggctgcgaggagtgcaccgtgagcgcctggaccctgaccagcaacggcagaagcttccccggccccttccccaagagctgggcctgcttcctgctgcccctggccatcctgtgcccctgcggctgcagccccaccctgagagccgtgcccgacctgagctgctacttccccaagcccgagaccgcccccctgcagatcctggccgcccccttcccctgcgtgcagtacagagtgatcacctgccccagcctggtgcccctgatcctgccctgcgactacagcgtgatccccctgcccgtgcccgagccccccggcctgttcctgggcagccccgagtgcagccccagaacccagagcgccgtgccctag

SEQ ID NO: 13190 - DNA, 291 bp, Artificial Sequence
  Description of Artificial Sequence: Synthetic coding sequence
atgcccgtgtacagcgcctggcccgccgagcccaccatggcccccttcgagcccctggccagcggcatcctgctgctgctgtggctgatcgcccccagcagagcctgcacctgcgtgcccccccacccccagaccgccttctgcaacagcgacctggtgatcagagccaagttcgtgggcacccccgaggtgaaccagaccaccctgtaccagagatacgagatcaagatgaccaagatgtacaagggcttccaggccctgggcgacgccgccgacatcagattcgtgtag

SEQ ID NO: 13191 - DNA, 498 bp, Artificial Sequence
  Description of Artificial Sequence: Synthetic coding sequence
tgacccagagccctgtgccacaccaaccagagcctgggcagaggcctggccaccaccagaggcagaggcagcgacggcaacggccccaccggcaacggcgaccaccccaacttcagcctgagcgagggcagagccttcggcagcctggccgcccagcccatcaccagctgcctgagcgtgcccgccccccccttcagcctgggcaagctgcaggacggcctgctgcacatcaccacctgcagcttcgtggccccctggaacagcctgagcctggcccagagaagaggcttcaccaagacctacaccgtgggctgcgaggagtgcaccgtgttcccctgcctgagcatcccctgcaagctgcagagcggcacccactgcctgtggaccgaccagctgctgcagggcagcgagaagggcttccagagcagacacctggcctgcctgcccagagagcccggcctgtgcacctggcagagcctgagaagccagatcgcctag

SEQ ID NO: 13192 - DNA, 411 bp, Artificial Sequence
  Description of Artificial Sequence: Synthetic coding sequence
atggcccccttcgagcccctggccagcggcatcctgctgctgctgtggctgatcgcccccagcagagcctgcacctgcgtgcccccccacccccagaccgccttctgcaacagcgacctggtgatcagagccaagttcgtgggcacccccgaggtgaaccagaccaccctgtaccagagatacgagatcaagatgaccaagatgtacaagggcttccaggccctgggcgacgccgccgacatcagattcgtgtacacccccgccatggagagcgtgtgcggctacttccacagaagccacaacagaagcgaggagttcctgatcgccggcgaggcccccagccccagacccgtgccccaccagcccgtgcccggcgccagacccagcaaccacgagggcgccagactgtag

SEQ ID NO: 13193 - DNA, 663 bp, Artificial Sequence
  Description of Artificial Sequence: Synthetic coding sequence
atgggcgccgccgccagaaccctgagactggccctgggcctgctgctgctggccaccctgctgagacccgccgacgcctgcagctgcagccccgtgcacccccagcaggccttctgcaacgccgacgtggtgatcagagccaaggccgtgagcgagaaggaggtggacagcggcaacgacatctacggcaaccccatcaagagaatccagtacgagatcaagcagatcaagatgttcaagggccccgagaaggacatcgagttcatctacaccgcccccagcagcgccgtgtgcggcgtgagcctggacgtgggcggcaagaaggagtacctgatcgccggcaaggccgagggcgacggcaagatgcacatcaccctgtgcgacttcatcgtgccctgggacaccctgagcaccacccagaagaagagcctgaaccacagataccagatgggctgcgagtgcaagatcaccagatgccccatgatcccctgctacatcagcagccccgacgagtgcctgtggatggactgggtgaccgagaagaacatcaacggccaccaggccaagttcttcgcctgcatcaagagaagcgacggcagctgcgcctggtacagaggcgccgccccccccaagcaggagttcctggacatcgaggacccctag

SEQ ID NO: 13194 - DNA, 432 bp, Artificial Sequence
  Description of Artificial Sequence: Synthetic coding sequence
atgttcaagggccccgagaaggacatcgagttcatctacaccgcccccagcagcgccgtgtgcggcgtgagcctggacgtgggcggcaagaaggagtacctgatcgccggcaaggccgagggcgacggcaagatgcacatcaccctgtgcgacttcatcgtgccctgggacaccctgagcaccacccagaagaagagcctgaaccacagataccagatgggctgcgagtgcaagatcaccagatgccccatgatcccctgctacatcagcagccccgacgagtgcctgtggatggactgggtgaccgagaagaacatcaacggccaccaggccaagttcttcgcctgcatcaagagaagcgacggcagctgcgcctggtacagaggcgccgccccccccaagcaggagttcctggacatcgaggacccctag

SEQ ID NO: 13195 - DNA, 636 bp, Artificial Sequence
  Description of Artificial Sequence: Synthetic coding sequence
atgaccccctggctgggcctgatcgtgctgctgggcagctggagcctgggcgactggggcgccgaggcctgcacctgcagccccagccacccccaggacgccttctgcaacagcgacatcgtgatcagagccaaggtggtgggcaagaagctggtgaaggagggccccttcggcaccctggtgtacaccatcaagcagatgaagatgtacagaggcttcaccaagatgccccacgtgcagtacatccacaccgaggccagcgagagcctgtgcggcctgaagctggaggtgaacaagtaccagtacctgctgaccggcagagtgtacgacggcaagatgtacaccggcctgtgcaacttcgtggagagatgggaccagctgaccctgagccagagaaagggcctgaactacagataccacctgggctgcaactgcaagatcaagagctgctactacctgccctgcttcgtgaccagcaagaacgagtgcctgtggaccgacatgctgagcaacttcggctaccccggctaccagagcaagcactacgcctgcatcagacagaagggcggctactgcagctggtacagaggctgggccccccccgacaagagcatcatcaacgccaccgacccctag

SEQ ID NO: 13196 - DNA, 438 bp, Artificial Sequence
  Description of Artificial Sequence: Synthetic coding sequence
atgaagatgtacagaggcttcaccaagatgccccacgtgcagtacatccacaccgaggccagcgagagcctgtgcggcctgaagctggaggtgaacaagtaccagtacctgctgaccggcagagtgtacgacggcaagatgtacaccggcctgtgcaacttcgtggagagatgggaccagctgaccctgagccagagaaagggcctgaactacagataccacctgggctgcaactgcaagatcaagagctgctactacctgccctgcttcgtgaccagcaagaacgagtgcctgtggaccgacatgctgagcaacttcggctaccccggctaccagagcaagcactacgcctgcatcagacagaagggcggctactgcagctggtacagaggctgggccccccccgacaagagcatcatcaacgccaccgacccctag

SEQ ID NO: 13197 - DNA, 675 bp, Artificial Sequence
  Description of Artificial Sequence: Synthetic coding sequence
atgcccggcagccccagacccgcccccagctgggtgctgctgctgagactgctggccctgctgagaccccccggcctgggcgaggcctgcagctgcgcccccgcccacccccagcagcacatctgccacagcgccctggtgatcagagccaagatcagcagcgagaaggtggtgcccgccagcgccgaccccgccgacaccgagaagatgctgagatacgagatcaagcagatcaagatgttcaagggcttcgagaaggtgaaggacgtgcagtacatctacacccccttcgacagcagcctgtgcggcgtgaagctggaggccaacagccagaagcagtacctgctgaccggccaggtgctgagcgacggcaaggtgttcatccacctgtgcaactacatcgagccctgggaggacctgagcctggtgcagagagagagcctgaaccaccactaccacctgaactgcggctgccagatcaccacctgctacaccgtgccctgcaccatcagcgcccccaacgagtgcctgtggaccgactggctgctggagagaaagctgtacggctaccaggcccagcactacgtgtgcatgaagcacgtggacggcacctgcagctggtacagaggccacctgcccctgagaaaggagttcgtggacatcgtgcagccctag

SEQ ID NO: 13198 - DNA, 1164 bp, Artificial Sequence
  Description of Artificial Sequence: Synthetic coding sequence
atggtgcactgcagctgcgtgctgttcagaaagtacggcaacttcatcgacaagctgagactgttcaccagaggcggcagcggcggcatgggctaccccagactgggcggcgagggcggcaagggcggcgacgtgtgggtggtggcccagaacagaatgaccctgaagcagctgaaggacagataccccagaaagagattcgtggccggcgtgggcgccaacagcaagatcagcgccctgaagggcagcaagggcaaggactgcgagatccccgtgcccgtgggcatcagcgtgaccgacgagaacggcaagatcatcggcgagctgaacaaggagaacgacagaatcctggtggcccagggcggcctgggcggcaagctgctgaccaacttcctgcccctgaagggccagaagagaatcatccacctggacctgaagctgatcgccgacgtgggcctggtgggcttccccaacgccggcaagagcagcctgctgagctgcgtgagccacgccaagcccgccatcgccgactacgccttcaccaccctgaagcccgagctgggcaagatcatgtacagcgacttcaagcagatcagcgtggccgacctgcccggcctgatcgagggcgcccacatgaacaagggcatgggccacaagttcctgaagcacatcgagagaaccagacagctgctgttcgtggtggacatcagcggcttccagctgagcagccacacccagtacagaaccgccttcgagaccatcatcctgctgaccaaggagctggagctgtacaaggaggagctgcagaccaagcccgccctgctggccgtgaacaagatggacctgcccgacgcccaggacaagttccacgagctgatgagccagctgcagaaccccaaggacttcctgcacctgttcgagaagaacatgatccccgagagaaccgtggagttccagcacatcatccccatcagcgccgtgaccggcgagggcatcgaggagctgaagaactgcatcagaaagagcctggacgagcaggccaaccaggagaacgacgccctgcacaagaagcagctgctgaacctgtggatcagcgacaccatgagcagcaccgagccccccagcaagcacgccgtgaccaccagcaagatggacatcatctag

SEQ ID NO: 13199 - DNA, 375 bp, Artificial Sequence
  Description of Artificial Sequence: Synthetic coding sequence
atggaccccgccagacccctgggcctgagcatcctgctgctgttcctgaccgaggccgccctgggcgacgccgcccaggagcccaccggcaacaacgccgagatctgcctgctgcccctggactacggcccctgcagagccctgctgctgagatactactacgacagatacacccagagctgcagacagttcctgtacggcggctgcgagggcaacgccaacaacttctacacctgggaggcctgcgacgacgcctgctggagaatcgagaaggtgcccaagctgagcagcatgaccagcctgaagaagaagaagaagatgcccaagctgagattcgccagcagaatcagaaagatcagaaagaagcagttctag

SEQ ID NO: 13200 - DNA, 1506 bp, Artificial Sequence
  Description of Artificial Sequence: Synthetic coding sequence
atggccgccgccagcgtgaccccccccggcagcctggagctgctgcagcccggcttcagcaagaccctgctgggcaccaagctggaggccaagtacctgtgcagcgcctgcagaaacgtgctgagaagacccttccaggcccagtgcggccacagatactgcagcttctgcctggccagcatcctgagcagcggcccccagaactgcgccgcctgcgtgcacgagggcatctacgaggagggcatcagcatcctggagagcagcagcgccttccccgacaacgccgccagaagagaggtggagagcctgcccgccgtgtgccccagcgacggctgcacctggaagggcaccctgaaggagtacgagagctgccacgagggcagatgccccctgatgctgaccgagtgccccgcctgcaagggcctggtgagactgggcgagaaggagagacacctggagcacgagtgccccgagagaagcctgagctgcagacactgcagagccccctgctgcggcgccgacgtgaaggcccaccacgaggtgtgccccaagttccccctgacctgcgacggctgcggcaagaagaagatccccagagagaagttccaggaccacgtgaagacctgcggcaagtgcagagtgccctgcagattccacgccatcggctgcctggagaccgtggagggcgagaagcagcaggagcacgaggtgcagtggctgagagagcacctggccatgctgctgagcagcgtgctggaggccaagcccctgctgggcgaccagagccacgccggcagcgagctgctgcagagatgcgagagcctggagaagaagaccgccaccttcgagaacatcgtgtgcgtgctgaacagagaggtggagagagtggccatgaccgccgaggcctgcagcagacagcacagactggaccaggacaagatcgaggccctgagcagcaaggtgcagcagctggagagaagcatcggcctgaaggacctggccatggccgacctggagcagaaggtgctggagatggaggccagcacctacgacggcgtgttcatctggaagatcagcgacttcgccagaaagagacaggaggccgtggccggcagaatccccgccatcttcagccccgccttctacaccagcagatacggctacaagatgtgcctgagaatctacctgaacggcgacggcaccggcagaggcacccacctgagcctgttcttcgtggtgatgaagggccccaacgacgccctgctgagatggcccttcaaccagaaggtgaccctgatgctgctggaccagaacaacagagagcacgtgatcgacgccttcagacccgacgtgaccagcagcagcttccagagacccgtgaacgacatgaacatcgccagcggctgccccctgttctgccccgtgagcaagatggaggccaagaacagctacgtgagagacgacgccatcttcatcaaggccatcgtggacctgaccggcctgtag

SEQ ID NO: 13201 - DNA, 1662 bp, Artificial Sequence
  Description of Artificial Sequence: Synthetic coding sequence
atggccgccgccagcgtgaccccccccggcagcctggagctgctgcagcccggcttcagcaagaccctgctgggcaccaagctggaggccaagtacctgtgcagcgcctgcagaaacgtgctgagaagacccttccaggcccagtgcggccacagatactgcagcttctgcctggccagcatcctgagcagcggcccccagaactgcgccgcctgcgtgcacgagggcatctacgaggagggcatcagcatcctggagagcagcagcgccttccccgacaacgccgccagaagagaggtggagagcctgcccgccgtgtgccccagcgacggctgcacctggaagggcaccctgaaggagtacgaggtgaagatgcccgcctgcggcatggtgaccgaggcccccgccgtgggcagcagacccagaagccccagcagctacgacctggtgctgcacgtgcccctgaccggcgccgaggcctgcctgatgagcgtggaggaggagaccgagctgctgctgagaagctgccacgagggcagatgccccctgatgctgaccgagtgccccgcctgcaagggcctggtgagactgggcgagaaggagagacacctggagcacgagtgccccgagagaagcctgagctgcagacactgcagagccccctgctgcggcgccgacgtgaaggcccaccacgaggtgtgccccaagttccccctgacctgcgacggctgcggcaagaagaagatccccagagagaagttccaggaccacgtgaagacctgcggcaagtgcagagtgccctgcagattccacgccatcggctgcctggagaccgtggagggcgagaagcagcaggagcacgaggtgcagtggctgagagagcacctggccatgctgctgagcagcgtgctggaggccaagcccctgctgggcgaccagagccacgccggcagcgagctgctgcagagatgcgagagcctggagaagaagaccgccaccttcgagaacatcgtgtgcgtgctgaacagagaggtggagagagtggccatgaccgccgaggcctgcagcagacagcacagactggaccaggacaagatcgaggccctgagcagcaaggtgcagcagctggagagaagcatcggcctgaaggacctggccatggccgacctggagcagaaggtgctggagatggaggccagcacctacgacggcgtgttcatctggaagatcagcgacttcgccagaaagagacaggaggccgtggccggcagaatccccgccatcttcagccccgccttctacaccagcagatacggctacaagatgtgcctgagaatctacctgaacggcgacggcaccggcagaggcacccacctgagcctgttcttcgtggtgatgaagggccccaacgacgccctgctgagatggcccttcaaccagaaggtgaccctgatgctgctggaccagaacaacagagagcacgtgatcgacgccttcagacccgacgtgaccagcagcagcttccagagacccgtgaacgacatgaacatcgccagcggctgccccctgttctgccccgtgagcaagatggaggccaagaacagctacgtgagagacgacgccatcttcatcaaggccatcgtggacctgaccggcctgtag

SEQ ID NO: 13202 - DNA, 1269 bp, Artificial Sequence
  Description of Artificial Sequence: Synthetic coding sequence
atggccgccgccagcgtgaccccccccggcagcctggagctgctgcagcccggcttcagcaagaccctgctgggcaccaagctggaggccaagtacctgtgcagcgcctgcagaaacgtgctgagaagacccttccaggcccagtgcggccacagatactgcagcttctgcctggccagcatcctgagcagcggcccccagaactgcgccgcctgcgtgcacgagggcatctacgaggagggcatcagcatcctggagagcagcagcgccttccccgacaacgccgccagaagagaggtggagagcctgcccgccgtgtgccccagcgacggctgcacctggaagggcaccctgaaggagtacgaggtgaagatgcccgcctgcggcatggtgaccgaggcccccgccgtgggcagcagacccagaagccccagcagctacgacctggtgctgcacgtgcccctgaccggcgccgaggcctgcctgatgagcgtggaggaggagaccgagctgctgctgagaagctgccacgagggcagatgccccctgatgctgaccgagtgccccgcctgcaagggcctggtgagactgggcgagaaggagagacacctggagcacgagtgccccgagagaagcctgagctgcagacactgcagagccccctgctgcggcgccgacgtgaagagactggaccaggacaagatcgaggccctgagcagcaaggtgcagcagctggagagaagcatcggcctgaaggacctggccatggccgacctggagcagaaggtgctggagatggaggccagcacctacgacggcgtgttcatctggaagatcagcgacttcgccagaaagagacaggaggccgtggccggcagaatccccgccatcttcagccccgccttctacaccagcagatacggctacaagatgtgcctgagaatctacctgaacggcgacggcaccggcagaggcacccacctgagcctgttcttcgtggtgatgaagggccccaacgacgccctgctgagatggcccttcaaccagaaggtgaccctgatgctgctggaccagaacaacagagagcacgtgatcgacgccttcagacccgacgtgaccagcagcagcttccagagacccgtgaacgacatgaacatcgccagcggctgccccctgttctgccccgtgagcaagatggaggccaagaacagctacgtgagagacgacgccatcttcatcaaggccatcgtggacctgaccggcctgtag

SEQ ID NO: 13203 - DNA, 366 bp, Artificial Sequence
  Description of Artificial Sequence: Synthetic coding sequence
atggccgccgccagcgtgaccccccccggcagcctggagctgctgcagcccggcttcagcaagaccctgctgggcaccaagctggaggccaagtacctgtgcagcgcctgcagaaacgtgctgagaagacccttccaggcccagtgcggccacagatactgcagcttctgcctggccagcatcctgagcagcggcccccagaactgcgccgcctgcgtgcacgagggcatctacgaggagggcatcagcatcctggagagcagcagcgccttccccgacaacgccgccagaagagaggtggagagcctgcccgccgtgtgccccagcgacggctgcacctggaagggcaccctgaaggagtactag

SEQ ID NO: 13204 - DNA, 519 bp, Artificial Sequence
  Description of Artificial Sequence: Synthetic coding sequence
atggccgccgccagcgtgaccccccccggcagcctggagctgctgcagcccggcttcagcaagaccctgctgggcaccaagctggaggccaagtacctgtgcagcgcctgcagaaacgtgctgagaagacccttccaggcccagtgcggccacagatactgcagcttctgcctggccagcatcctgagcagcggcccccagaactgcgccgcctgcgtgcacgagggcatctacgaggagggcatcagcatcctggagagcagcagcgccttccccgacaacgccgccagaagagaggtggagagcctgcccgccgtgtgccccagcgacggctgcacctggaagggcaccctgaaggagtacgagagctgccacgagggcagatgccccctgatgctgaccgagtgccccgcctgcaagggcctggtgagactgggcgagaaggagagacacctggagcacgagtgccccgagagaagcctgagctgcagacactgcagagccccctgctgcggctag

SEQ ID NO: 13205 - DNA, 582 bp, Artificial Sequence
  Description of Artificial Sequence: Synthetic coding sequence
atggccgccgccagcgtgaccccccccggcagcctggagctgctgcagcccggcttcagcaagaccctgctgggcaccaagctggaggccaagtacctgtgcagcgcctgcagaaacgtgctgagaagacccttccaggcccagtgcggccacagatactgcagcttctgcctggccagcatcctgagcagcggcccccagaactgcgccgcctgcgtgcacgagggcatctacgaggagggcatcagcatcctggagagcagcagcgccttccccgacaacgccgccagaagagaggtggagagcctgcccgccgtgtgccccagcgacggctgcacctggaagggcaccctgaaggagtacgagagctgccacgagggcagatgccccctgatgctgaccgagtgccccgcctgcaagggcctggtgagactgggcgagaaggagagacacctggagcacgagtgccccgagagaagcctgagctgcagacactgcagagccccctgctgcggcgccgacgtgaaggcccaccacgaggtgtgccccaagttccccctgacctgcgacggctgcggctag

SEQ ID NO: 13206 - DNA, 1503 bp, Artificial Sequence
  Description of Artificial Sequence: Synthetic coding sequence
gtggccggcagagccctgagcagcggcagagccgccaccgtgggcgccctgttcgccggcgtgaccgccctgatggccgccgccagcgtgaccccccccggcagcctggagctgctgcagcccggcttcagcaagaccctgctgggcaccaagctggaggccaagtacctgtgcagcgcctgcagaaacgtgctgagaagacccttccaggcccagtgcggccacagatactgcagcttctgcctggccagcatcctgagcagcggcccccagaactgcgccgcctgcgtgcacgagggcatctacgaggagggcatcagcatcctggagagcagcagcgccttccccgacaacgccgccagaagagaggtggagagcctgcccgccgtgtgccccagcgacggctgcacctggaagggcaccctgaaggagtacgagagctgccacgagggcagatgccccctgatgctgaccgagtgccccgcctgcaagggcctggtgagactgggcgagaaggagagacacctggagcacgagtgccccgagagaagcctgagctgcagacactgcagagccccctgctgcggcgccgacgtgaagttccaggaccacgtgaagacctgcggcaagtgcagagtgccctgcagattccacgccatcggctgcctggagaccgtggagggcgagaagcagcaggagcacgaggtgcagtggctgagagagcacctggccatgctgctgagcagcgtgctggaggccaagcccctgctgggcgaccagagccacgccggcagcgagctgctgcagagatgcgagagcctggagaagaagaccgccaccttcgagaacatcgtgtgcgtgctgaacagagaggtggagagagtggccatgaccgccgaggcctgcagcagacagcacagactggaccaggacaagatcgaggccctgagcagcaaggtgcagcagctggagagaagcatcggcctgaaggacctggccatggccgacctggagcagaaggtgctggagatggaggccagcacctacgacggcgtgttcatctggaagatcagcgacttcgccagaaagagacaggaggccgtggccggcagaatccccgccatcttcagccccgccttctacaccagcagatacggctacaagatgtgcctgagaatctacctgaacggcgacggcaccggcagaggcacccacctgagcctgttcttcgtggtgatgaagggccccaacgacgccctgctgagatggcccttcaaccagaaggtgaccctgatgctgctggaccagaacaacagagagcacgtgatcgacgccttcagacccgacgtgaccagcagcagcttccagagacccgtgaacgacatgaacatcgccagcggctgccccctgttctgccccgtgagcaagatggaggccaagaacagctacgtgagagacgacgccatcttcatcaaggccatcgtggacctgaccggcctgtag

SEQ ID NO: 13207 - DNA, 1506 bp, Artificial Sequence; identical to SEQ ID NO: 13200
  Description of Artificial Sequence: Synthetic coding sequence

SEQ ID NO: 13208 - DNA, 1632 bp, Artificial Sequence
  Description of Artificial Sequence: Synthetic coding sequence
atggagagcagcaagaagatggacagccccggcgccctgcagaccaacccccccctgaagctgcacaccgacagaagcgccggcacccccgtgttcgtgcccgagcagggcggctacaaggagaagttcgtgaagaccgtggaggacaagtacaagtgcgagaagtgccacctggtgctgtgcagccccaagcagaccgagtgcggccacagattctgcgagagctgcatggccgccctgctgagcagcagcagccccaagtgcaccgcctgccaggagagcatcgtgaaggacaaggtgttcaaggacaactgctgcaagagagagatcctggccctgcagatctactgcagaaacgagagcagaggctgcgccgagcagctgatgctgggccacctgctggtgcacctgaagaacgactgccacttcgaggagctgccctgcgtgagacccgactgcaaggagaaggtgctgagaaaggacctgagagaccacgtggagaaggcctgcaagtacagagaggccacctgcagccactgcaagagccaggtgcccatgatcgccctgcagaagcacgaggacaccgactgcccctgcgtggtggtgagctgcccccacaagtgcagcgtgcagaccctgctgagaagcgagggcaccaaccagcagatcaaggcccacgaggccagcagcgccgtgcagcacgtgaacctgctgaaggagtggagcaacagcctggagaagaaggtgagcctgctgcagaacgagagcgtggagaagaacaagagcatccagagcctgcacaaccagatctgcagcttcgagatcgagatcgagagacagaaggagatgctgagaaacaacgagagcaagatcctgcacctgcagagagtgatcgacagccaggccgagaagctgaaggagctggacaaggagatcagacccttcagacagaactgggaggaggccgacagcatgaagagcagcgtggagagcctgcagaacagagtgaccgagctggagagcgtggacaagagcgccggccaggtggccagaaacaccggcctgctggagagccagctgagcagacacgaccagatgctgagcgtgcacgacatcagactggccgacatggacctgagattccaggtgctggagaccgccagctacaacggcgtgctgatctggaagatcagagactacaagagaagaaagcaggaggccgtgatgggcaagaccctgagcctgtacagccagcccttctacaccggctacttcggctacaagatgtgcgccagagtgtacctgaacggcgacggcatgggcaagggcacccacctgagcctgttcttcgtgatcatgagaggcgagtacgacgccctgctgccctggcccttcaagcagaaggtgaccctgatgctgatggaccagggcagcagcagaagacacctgggcgacgccttcaagcccgaccccaacagcagcagcttcaagaagcccaccggcgagatgaacatcgccagcggctgccccgtgttcgtggcccagaccgtgctggagaacggcacctacatcaaggacgacaccatcttcatcaaggtgatcgtggacaccagcgacctgcccgacccctag

SEQ ID NO: 13209 - DNA, 1632 bp, Artificial Sequence; identical to SEQ ID NO: 13208
  Description of Artificial Sequence: Synthetic coding sequence

SEQ ID NO: 13210 - DNA, 1707 bp, Artificial Sequence
  Description of Artificial Sequence: Synthetic coding sequence
atggagagcagcaagaagatggacagccccggcgccctgcagaccaacccccccctgaagctgcacaccgacagaagcgccggcacccccgtgttcgtgcccgagcagggcggctacaaggagaagttcgtgaagaccgtggaggacaagtacaagtgcgagaagtgccacctggtgctgtgcagccccaagcagaccgagtgcggccacagattctgcgagagctgcatggccgccctgctgagcagcagcagccccaagtgcaccgcctgccaggagagcatcgtgaaggacaaggtgttcaaggacaactgctgcaagagagagatcctggccctgcagatctactgcagaaacgagagcagaggctgcgccgagcagctgatgctgggccacctgctggtgcacctgaagaacgactgccacttcgaggagctgccctgcgtgagacccgactgcaaggagaaggtgctgagaaaggacctgagagaccacgtggagaaggcctgcaagtacagagaggccacctgcagccactgcaagagccaggtgcccatgatcgccctgcagaagcacgaggacaccgactgcccctgcgtggtggtgagctgcccccacaagtgcagcgtgcagaccctgctgagaagcgagctgagcgcccacctgagcgagtgcgtgaacgcccccagcacctgcagcttcaagagatacggctgcgtgttccagggcaccaaccagcagatcaaggcccacgaggccagcagcgccgtgcagcacgtgaacctgctgaaggagtggagcaacagcctggagaagaaggtgagcctgctgcagaacgagagcgtggagaagaacaagagcatccagagcctgcacaaccagatctgcagcttcgagatcgagatcgagagacagaaggagatgctgagaaacaacgagagcaagatcctgcacctgcagagagtgatcgacagccaggccgagaagctgaaggagctggacaaggagatcagacccttcagacagaactgggaggaggccgacagcatgaagagcagcgtggagagcctgcagaacagagtgaccgagctggagagcgtggacaagagcgccggccaggtggccagaaacaccggcctgctggagagccagctgagcagacacgaccagatgctgagcgtgcacgacatcagactggccgacatggacctgagattccaggtgctggagaccgccagctacaacggcgtgctgatctggaagatcagagactacaagagaagaaagcaggaggccgtgatgggcaagaccctgagcctgtacagccagcccttctacaccggctacttcggctacaagatgtgcgccagagtgtacctgaacggcgacggcatgggcaagggcacccacctgagcctgttcttcgtgatcatgagaggcgagtacgacgccctgctgccctggcccttcaagcagaaggtgaccctgatgctgatggaccagggcagcagcagaagacacctgggcgacgccttcaagcccgaccccaacagcagcagcttcaagaagcccaccggcgagatgaacatcgccagcggctgccccgtgttcgtggcccagaccgtgctggagaacggcacctacatcaaggacgacaccatcttcatcaaggtgatcgtggacaccagcgacctgcccgacccctag

SEQ ID NO: 13211 - DNA, 1458 bp, Artificial Sequence
  Description of Artificial Sequence: Synthetic coding sequence
atggagagcagcaagaagatggacagccccggcgccctgcagaccaacccccccctgaagctgcacaccgacagaagcgccggcacccccgtgttcgtgcccgagcagggcggctacaaggagaagttcgtgaagaccgtggaggacaagtacaagtgcgagaagtgccacctggtgctgtgcagccccaagcagaccgagtgcggccacagattctgcgagagctgcatggccgccctgctgagcagcagcagccccaagtgcaccgcctgccaggagagcatcgtgaaggacaaggtgttcaaggacaactgctgcaagagagagatcctggccctgcagatctactgcagaaacgagagcagaggctgcgccgagcagctgatgctgggccacctgctggtgcacctgaagaacgactgccacttcgaggagctgccctgcgtgagacccgactgcaaggagaaggtgctgagaaaggacctgagagaccacgtggagaaggcctgcaagtacagagaggccacctgcagccactgcaagagccaggtgcccatgatcgccctgcaggtgagcctgctgcagaacgagagcgtggagaagaacaagagcatccagagcctgcacaaccagatctgcagcttcgagatcgagatcgagagacagaaggagatgctgagaaacaacgagagcaagatcctgcacctgcagagagtgatcgacagccaggccgagaagctgaaggagctggacaaggagatcagacccttcagacagaactgggaggaggccgacagcatgaagagcagcgtggagagcctgcagaacagagtgaccgagctggagagcgtggacaagagcgccggccaggtggccagaaacaccggcctgctggagagccagctgagcagacacgaccagatgctgagcgtgcacgacatcagactggccgacatggacctgagattccaggtgctggagaccgccagctacaacggcgtgctgatctggaagatcagagactacaagagaagaaagcaggaggccgtgatgggcaagaccctgagcctgtacagccagcccttctacaccggctacttcggctacaagatgtgcgccagagtgtacctgaacggcgacggcatgggcaagggcacccacctgagcctgttcttcgtgatcatgagaggcgagtacgacgccctgctgccctggcccttcaagcagaaggtgaccctgatgctgatggaccagggcagcagcagaagacacctgggcgacgccttcaagcccgaccccaacagcagcagcttcaagaagcccaccggcgagatgaacatcgccagcggctgccccgtgttcgtggcccagaccgtgctggagaacggcacctacatcaaggacgacaccatcttcatcaaggtgatcgtggacaccagcgacctgcccgacccctag

SEQ ID NO: 13212 - DNA, 1707 bp, Artificial Sequence; identical to SEQ ID NO: 13210
  Description of Artificial Sequence: Synthetic coding sequence

SEQ ID NO: 13213 - DNA, 285 bp, Artificial Sequence
  Description of Artificial Sequence: Synthetic coding sequence
atggagagcagcaagaagatggacagccccggcgccctgcagaccaacccccccctgaagctgcacaccgacagaagcgccggcacccccgtgttcgtgcccgagcagggcggctacaaggagaagttcgtgaagaccgtggaggacaagtacaagtgcgagaagtgccacctggtgctgtgcagccccaagcagaccgagtgcggccacagattctgcgagagctgcatggccgccctgctgagcagcagcagccccaagtgcaccgcctgccaggagagctag

SEQ ID NO: 13214 - DNA, 939 bp, Artificial Sequence
  Description of Artificial Sequence: Synthetic coding sequence
atggccgccggccagaacggccacgaggagtgggtgggcagcgcctacctgttcgtggagagcagcctggacaaggtggtgctgagcgacgcctacgcccacccccagcagaaggtggccgtgtacagagccctgcaggccgccctggccgagagcggcggcagccccgacgtgctgcagatgctgaagatccacagaagcgacccccagctgatcgtgcagctgagattctgcggcagacagccctgcggcagattcctgagagcctacagagagggcgccctgagagccgccctgcagagaagcctggccgccgccctggcccagcacagcgtgcccctgcagctggagctgagagccggcgccgagagactggacgccctgctggccgacgaggagagatgcctgagctgcatcctggcccagcagcccgacagactgagagacgaggagctggccgagctggaggacgccctgagaaacctgaagtgcggcagcggcgccagaggcggcgacggcgaggtggccagcgcccccctgcagccccccgtgcccagcctgagcgaggtgaagcccccccccccccccccccccgcccagaccttcctgttccagggccagcccgtggtgaacagacccctgagcctgaaggaccagcagaccttcgccagaagcgtgggcctgaagtggagaaaggtgggcagaagcctgcagagaggctgcagagccctgagagaccccgccctggacagcctggcctacgagtacgagagagagggcctgtacgagcaggccttccagctgctgagaagattcgtgcaggccgagggcagaagagccaccctgcagagactggtggaggccctggaggagaacgagctgaccagcctggccgaggacctgctgggcctgaccgaccccaacggcggcctggcctag

SEQ ID NO: 13215 - DNA, 825 bp, Artificial Sequence
  Description of Artificial Sequence: Synthetic coding sequence
atggccaccaccgtgagcacccagagaggccccgtgtacatcggcgagctgccccaggacttcctgagaatcacccccacccagcagcagagacaggtgcagctggacgcccaggccgcccagcagctgcagtacggcggcgccgtgggcaccgtgggcagactgaacatcaccgtggtgcaggccaagctggccaagaactacggcatgaccagaatggacccctactgcagactgagactgggctacgccgtgtacgagacccccaccgcccacaacggcgccaagaaccccagatggaacaaggtgatccactgcaccgtgccccccggcgtggacagcttctacctggagatcttcgacgagagagccttcagcatggacgacagaatcgcctggacccacatcaccatccccgagagcctgagacagggcaaggtggaggacaagtggtacagcctgagcggcagacagggcgacgacaaggagggcatgatcaacctggtgatgagctacgccctgctgcccgccgccatggtgatgcccccccagcccgtggtgctgatgcccaccgtgtaccagcagggcgtgggctacgtgcccatcaccggcatgcccgccgtgtgcagccccggcatggtgcccgtggccctgccccccgccgccgtgaacgcccagcccagatgcagcgaggaggacctgaaggccatccaggacatgttccccaacatggaccaggaggtgatcagaagcgtgctggaggcccagagaggcaacaaggacgccgccatcaacagcctgctgcagatgggcgaggagccctag

SEQ ID NO: 13216 - DNA, 1059 bp, Artificial Sequence
  Description of Artificial Sequence: Synthetic coding sequence
cagctgagccccagccaggcccccgccggcgcccaggaggtggccagaagagtgaccgtgggcagcgccagccacggcggcagaagaagcaccatggccaccaccgtgagcacccagagaggccccgtgtacatcggcgagctgccccaggacttcctgagaatcacccccacccagcagcagagacaggtgcagctggacgcccaggccgcccagcagctgcagtacggcggcgccgtgggcaccgtgggcagactgaacatcaccgtggtgcaggccaagctggccaagaactacggcatgaccagaatggacccctactgcagactgagactgggctacgccgtgtacgagacccccaccgcccacaacggcgccaagaaccccagatggaacaaggtgatccactgcaccgtgccccccggcgtggacagcttctacctggagatcttcgacgagagagccttcagcatggacgacagaatcgcctggacccacatcaccatccccgagagcctgagacagggcaaggtggaggacaagtggtacagcctgagcggcagacagggcgacgacaaggagggcatgatcaacctggtgatgagctacgccctgctgcccgccgccatggtgatgcccccccagcccgtggtgctgatgcccaccgtgtaccagcagggcgtgggctacgtgcccatcaccggcatgcccgccgtgtgcagccccggcatggtgcccgtggccctgccccccgccgccgtgaacgcccagcccagatgcagcgaggaggacctgaaggccatccaggacatgttccccaacatggaccaggaggtgatcagaagcgtgctggaggcccagagaggcaacaaggacgccgccatccccagccacctggtgctgggcggcctgagcgccctgagctgcccctgggacgtgagactgagcttcagctgcagaagcggcaagtgcagctgctgcagagagcagctgctgctgcccggctgctggagatggtggagcgccttcagattccacagctggcacttcgtgatgtag

SEQ ID NO: 13217 - DNA, 675 bp, Artificial Sequence
  Description of Artificial Sequence: Synthetic coding sequence
atggccaccaccgtgagcacccagagaggccccgccaagctggccaagaactacggcatgaccagaatggacccctactgcagactgagactgggctacgccgtgtacgagacccccaccgcccacaacggcgccaagaaccccagatggaacaaggtgatccactgcaccgtgccccccggcgtggacagcttctacctggagatcttcgacgagagagccttcagcatggacgacagaatcgcctggacccacatcaccatccccgagagcctgagacagggcaaggtggaggacaagtggtacagcctgagcggcagacagggcgacgacaaggagggcatgatcaacctggtgatgagctacgccctgctgcccgccgccatggtgatgcccccccagcccgtggtgctgatgcccaccgtgtaccagcagggcgtgggctacgtgcccatcaccggcatgcccgccgtgtgcagccccggcatggtgcccgtggccctgccccccgccgccgtgaacgcccagcccagatgcagcgaggaggacctgaaggccatccaggacatgttccccaacatggaccaggaggtgatcagaagcgtgctggaggcccagagaggcaacaaggacgccgccatcaacagcctgctgcagatgggcgaggagccctag

SEQ ID NO: 13218 - DNA, 768 bp, Artificial Sequence
  Description of Artificial Sequence: Synthetic coding sequence
atggccagcagcaccagcctgcccgcccccggcagcagacccaagaagcccctgggcaagatggccgactggttcagacagaccctgctgaagaagcccaagaagagacccaacagccccgagagcaccagcagcgacgccagccagcccaccagccaggacagccccctgccccccagcctgagcagcgtgaccagccccagcctgccccccacccacgccagcgacagcggcagcagcagatggagcaaggactacgacgtgtgcgtgtgccacagcgaggaggacctggtggccgcccaggacctggtgagctacctggagggcagcaccgccagcctgagatgcttcctgcagctgagagacgccacccccggcggcgccatcgtgagcgagctgtgccaggccctgagcagcagccactgcagagtgctgctgatcacccccggcttcctgcaggacccctggtgcaagtaccagatgctgcaggccctgaccgaggcccccggcgccgagggctgcaccatccccctgctgagcggcctgagcagagccgcctacccccccgagctgagattcatgtactacgtggacggcagaggccccgacggcggcttcagacaggtgaaggaggccgtgatgagaagcaaccaggtgctgaagcacctgctgtaccacggcacccccgagatcggcgtgaagctggagaccgagaacccctgcagagccagcgacagccacaagtgcgacaagagatacagagagtag

SEQ ID NO: 13219 - DNA, 708 bp, Artificial Sequence
  Description of Artificial Sequence: Synthetic coding sequence
atggccagcagcaccagcctgcccgcccccggcagcagacccaagaagcccctgggcaagatggccgactggttcagacagaccctgctgaagaagcccaagaagagacccaacagccccgagagcaccagcagcgacgccagccagcccaccagccaggacagccccctgccccccagcctgagcagcgtgaccagccccagcctgccccccacccacgccagcgacagcggcagcagcagatggagcaaggactacgacgtgtgcgtgtgccacagcgaggaggacctggtggccgcccaggacctggtgagctacctggagggcagcaccgccagcctgagatgcttcctgcagctgagagacgccacccccggcggcgccatcgtgagcgagctgtgccaggccctgagcagcagccactgcagagtgctgctgatcacccccggcttcctgcaggacccctggtgcaagtaccagatgctgcaggccctgaccgaggcccccggcgccgagggctgcaccatccccctgctgagcggcctgagcagagccgcctacccccccgagctgagattcatgtactacgtggacggcagaggccccgacggcggcttcagacaggtgaaggaggccgtgatgagatgcaagctgctgcaggagggcgagggcgagagagacagcgccaccgtgagcgacctgctgtag

SEQ ID NO: 13220 - DNA, 666 bp, Artificial Sequence
  Description of Artificial Sequence: Synthetic coding sequence
atggccagcagcaccagcctgcccgcccccggcagcagacccaagaagcccctgggcaagatggccgactggttcagacagaccctgctgaagaagcccaagaagagacccaacagccccgagagcaccagcagcgacgccagccagcccaccagccaggacagccccctgccccccagcctgagcagcgtgaccagccccagcctgccccccacccacgccagcgacagcggcagcagcagatggagcaaggactacgacgtgtgcgtgtgccacagcgaggaggacctggtggccgcccaggacctggtgagctacctggagggcagcaccgccagcctgagatgcttcctgcagctgagagacgccacccccggcggcgccatcgtgagcgagctgtgccaggccctgagcagcagccactgcagagtgctgctgatcacccccggcttcctgcaggacccctggtgcaagtaccagatgctgcaggccctgaccgaggcccccggcgccgagggctgcaccatccccctgctgagcggcctgagcagagccgcctacccccccgagctgagattcatgtactacgtggacggcagaggccccgacggcggcttcagacaggtgaaggaggccgtgatgagatacctgcagaccctgagctag

SEQ ID NO: 13221 - DNA, 666 bp, Artificial Sequence; identical to SEQ ID NO: 13220
  Description of Artificial Sequence: Synthetic coding sequence

SEQ ID NO: 13222 - DNA, 666 bp, Artificial Sequence; identical to SEQ ID NO: 13220
  Description of Artificial Sequence: Synthetic coding sequence

SEQ ID NO: 13223 - DNA, 2520 bp, Artificial Sequence
  Description of Artificial Sequence: Synthetic coding sequence
atgatgagcgccagcagactggccggcaccctgatccccgccatggccttcctgagctgcgtgagacccgagagctgggagccctgcgtggaggtggtgcccaacatcacctaccagtgcatggagctgaacttctacaagatccccgacaacctgcccttcagcaccaagaacctggacctgagcttcaaccccctgagacacctgggcagctacagcttcttcagcttccccgagctgcaggtgctggacctgagcagatgcgagatccagaccatcgaggacggcgcctaccagagcctgagccacctgagcaccctgatcctgaccggcaaccccatccagagcctggccctgggcgccttcagcggcctgagcagcctgcagaagctggtggccgtggagaccaacctggccagcctggagaacttccccatcggccacctgaagaccctgaaggagctgaacgtggcccacaacctgatccagagcttcaagctgcccgagtacttcagcaacctgaccaacctggagcacctggacctgagcagcaacaagatccagagcatctactgcaccgacctgagagtgctgcaccagatgcccctgctgaacctgagcctggacctgagcctgaaccccatgaacttcatccagcccggcgccttcaaggagatcagactgcacaagctgaccctgagaaacaacttcgacagcctgaacgtgatgaagacctgcatccagggcctggccggcctggaggtgcacagactggtgctgggcgagttcagaaacgagggcaacctggagaagttcgacaagagcgccctggagggcctgtgcaacctgaccatcgaggagttcagactggcctacctggactactacctggacgacatcatcgacctgttcaactgcctgaccaacgtgagcagcttcagcctggtgagcgtgaccatcgagagagtgaaggacttcagctacaacttcggctggcagcacctggagctggtgaactgcaagttcggccagttccccaccctgaagctgaagagcctgaagagactgaccttcaccagcaacaagggcggcaacgccttcagcgaggtggacctgcccagcctggagttcctggacctgagcagaaacggcctgagcttcaagggctgctgcagccagagcgacttcggcaccaccagcctgaagtacctggacctgagcttcaacggcgtgatcaccatgagcagcaacttcctgggcctggagcagctggagcacctggacttccagcacagcaacctgaagcagatgagcgagttcagcgtgttcctgagcctgagaaacctgatctacctggacatcagccacacccacaccagagtggccttcaacggcatcttcaacggcctgagcagcctggaggtgctgaagatggccggcaacagcttccaggagaacttcctgcccgacatcttcaccgagctgagaaacctgaccttcctggacctgagccagtgccagctggagcagctgagccccaccgccttcaacagcctgagcagcctgcaggtgctgaacatgagccacaacaacttcttcagcctggacaccttcccctacaagtgcctgaacagcctgcaggtgctggactacagcctgaaccacatcatgaccagcaagaagcaggagctgcagcacttccccagcagcctggccttcctgaacctgacccagaacgacttcgcctgcacctgcgagcaccagagcttcctgcagtggatcaaggaccagagacagctgctggtggaggtggagagaatggagtgcgccacccccagcgacaagcagggcatgcccgtgctgagcctgaacatcacctgccagatgaacaagaccatcatcggcgtgagcgtgctgagcgtgctggtggtgagcgtggtggccgtgctggtgtacaagttctacttccacctgatgctgctggccggctgcatcaagtacggcagaggcgagaacatctacgacgccttcgtgatctacagcagccaggacgaggactgggtgagaaacgagctggtgaagaacctggaggagggcgtgccccccttccagctgtgcctgcactacagagacttcatccccggcgtggccatcgccgccaacatcatccacgagggcttccacaagagcagaaaggtgatcgtggtggtgagccagcacttcatccagagcagatggtgcatcttcgagtacgagatcgcccagacctggcagttcctgagcagcagagccggcatcatcttcatcgtgctgcagaaggtggagaagaccctgctgagacagcaggtggagctgtacagactgctgagcagaaacacctacctggagtgggaggacagcgtgctgggcagacacatcttctggagaagactgagaaaggccctgctggacggcaagagctggaaccccgagggcaccgtgggcaccggctgcaactggcaggaggccaccagcatctag

SEQ ID NO: 13224 - DNA, 2400 bp, Artificial Sequence
  Description of Artificial Sequence: Synthetic coding sequence
atggagctgaacttctacaagatccccgacaacctgcccttcagcaccaagaacctggacctgagcttcaaccccctgagacacctgggcagctacagcttcttcagcttccccgagctgcaggtgctggacctgagcagatgcgagatccagaccatcgaggacggcgcctaccagagcctgagccacctgagcaccctgatcctgaccggcaaccccatccagagcctggccctgggcgccttcagcggcctgagcagcctgcagaagctggtggccgtggagaccaacctggccagcctggagaacttccccatcggccacctgaagaccctgaaggagctgaacgtggcccacaacctgatccagagcttcaagctgcccgagtacttcagcaacctgaccaacctggagcacctggacctgagcagcaacaagatccagagcatctactgcaccgacctgagagtgctgcaccagatgcccctgctgaacctgagcctggacctgagcctgaaccccatgaacttcatccagcccggcgccttcaaggagatcagactgcacaagctgaccctgagaaacaacttcgacagcctgaacgtgatgaagacctgcatccagggcctggccggcctggaggtgcacagactggtgctgggcgagttcagaaacgagggcaacctggagaagttcgacaagagcgccctggagggcctgtgcaacctgaccatcgaggagttcagactggcctacctggactactacctggacgacatcatcgacctgttcaactgcctgaccaacgtgagcagcttcagcctggtgagcgtgaccatcgagagagtgaaggacttcagctacaacttcggctggcagcacctggagctggtgaactgcaagttcggccagttccccaccctgaagctgaagagcctgaagagactgaccttcaccagcaacaagggcggcaacgccttcagcgaggtggacctgcccagcctggagttcctggacctgagcagaaacggcctgagcttcaagggctgctgcagccagagcgacttcggcaccaccagcctgaagtacctggacctgagcttcaacggcgtgatcaccatgagcagcaacttcctgggcctggagcagctggagcacctggacttccagcacagcaacctgaagcagatgagcgagttcagcgtgttcctgagcctgagaaacctgatctacctggacatcagccacacccacaccagagtggccttcaacggcatcttcaacggcctgagcagcctggaggtgctgaagatggccggcaacagcttccaggagaacttcctgcccgacatcttcaccgagctgagaaacctgaccttcctggacctgagccagtgccagctggagcagctgagccccaccgccttcaacagcctgagcagcctgcaggtgctgaacatgagccacaacaacttcttcagcctggacaccttcccctacaagtgcctgaacagcctgcaggtgctggactacagcctgaaccacatcatgaccagcaagaagcaggagctgcagcacttccccagcagcctggccttcctgaacctgacccagaacgacttcgcctgcacctgcgagcaccagagcttcctgcagtggatcaaggaccagagacagctgctggtggaggtggagagaatggagtgcgccacccccagcgacaagcagggcatgcccgtgctgagcctgaacatcacctgccagatgaacaagaccatcatcggcgtgagcgtgctgagcgtgctggtggtgagcgtggtggccgtgctggtgtacaagttctacttccacctgatgctgctggccggctgcatcaagtacggcagaggcgagaacatctacgacgccttcgtgatctacagcagccaggacgaggactgggtgagaaacgagctggtgaagaacctggaggagggcgtgccccccttccagctgtgcctgcactacagagacttcatccccggcgtggccatcgccgccaacatcatccacgagggcttccacaagagcagaaaggtgatcgtggtggtgagccagcacttcatccagagcagatggtgcatcttcgagtacgagatcgcccagacctggcagttcctgagcagcagagccggcatcatcttcatcgtgctgcagaaggtggagaagaccctgctgagacagcaggtggagctgtacagactgctgagcagaaacacctacctggagtgggaggacagcgtgctgggcagacacatcttctggagaagactgagaaaggccctgctggacggcaagagctggaaccccgagggcaccgtgggcaccggctgcaactggcaggaggccaccagcatctag

SEQ ID NO: 13225 - DNA, 2577 bp, Artificial Sequence
  Description of Artificial Sequence: Synthetic coding sequence
atgggcgaccacctggacctgctgctgggcgtggtgctgatggccggccccgtgttcggcatccccagctgcagcttcgacggcagaatcgccttctacagattctgcaacctgacccaggtgccccaggtgctgaacaccaccgagagactgctgctgagcttcaactacatcagaaccgtgaccgccagcagcttccccttcctggagcagctgcagctgctggagctgggcagccagtacacccccctgaccatcgacaaggaggccttcagaaacctgcccaacctgagaatcctggacctgggcagcagcaagatctacttcctgcaccccgacgccttccagggcctgttccacctgttcgagctgagactgtacttctgcggcctgagcgacgccgtgctgaaggacggctacttcagaaacctgaaggccctgaccagactggacctgagcaagaaccagatcagaagcctgtacctgcaccccagcttcggcaagctgaacagcctgaagagcatcgacttcagcagcaaccagatcttcctggtgtgcgagcacgagctggagcccctgcagggcaagaccctgagcttcttcagcctggccgccaacagcctgtacagcagagtgagcgtggactggggcaagtgcatgaaccccttcagaaacatggtgctggagatcctggacgtgagcggcaacggctggaccgtggacatcaccggcaacttcagcaacgccatcagcaagagccaggccttcagcctgatcctggcccaccacatcatgggcgccggcttcggcttccacaacatcaaggaccccgaccagaacaccttcgccggcctggccagaagcagcgtgagacacctggacctgagccacggcttcgtgttcagcctgaacagcagagtgttcgagaccctgaaggacctgaaggtgctgaacctggcctacaacaagatcaacaagatcgccgacgaggccttctacggcctggacaacctgcaggtgctgaacctgagctacaacctgctgggcgagctgtacagcagcaacttctacggcctgcccaaggtggcctacatcgacctgcagaagaaccacatcgccatcatccaggaccagaccttcaagttcctggagaagctgcagaccctggacctgagagacaacgccctgaccaccatccacttcatccccagcatccccgacatcttcctgagcggcaacaagctggtgaccctgcccaagatcaacctgaccgccaacctgatccacctgagcgagaacagactggagaacctggacatcctgtacttcctgctgagagtgccccacctgcagatcctgatcctgaaccagaacagattcagcagctgcagcggcgaccagacccccagcgagaaccccagcctggagcagctgttcctgggcgagaacatgctgcagctggcctgggagaccgagctgtgctgggacgtgttcgagggcctgagccacctgcaggtgctgtacctgaaccacaactacctgaacagcctgccccccggcgtgttcagccacctgaccgccctgagaggcctgagcctgaacagcaacagactgaccgtgctgagccacaacgacctgcccgccaacctggagatcctggacatcagcagaaaccagctgctggcccccaaccccgacgtgttcgtgagcctgagcgtgctggacatcacccacaacaagttcatctgcgagtgcgagctgagcaccttcatcaactggctgaaccacaccaacgtgaccatcgccggcccccccgccgacatctactgcgtgtaccccgacagcttcagcggcgtgagcctgttcagcctgagcaccgagggctgcgacgaggaggaggtgctgaagagcctgaagttcagcctgttcatcgtgtgcaccgtgaccctgaccctgttcctgatgaccatcctgaccgtgaccaagttcagaggcttctgcttcatctgctacaagaccgcccagagactggtgttcaaggaccacccccagggcaccgagcccgacatgtacaagtacgacgcctacctgtgcttcagcagcaaggacttcacctgggtgcagaacgccctgctgaagcacctggacacccagtacagcgaccagaacagattcaacctgtgcttcgaggagagagacttcgtgcccggcgagaacagaatcgccaacatccaggacgccatctggaacagcagaaagatcgtgtgcctggtgagcagacacttcctgagagacggctggtgcctggaggccttcagctacgcccagggcagatgcctgagcgacctgaacagcgccctgatcatggtggtggtgggcagcctgagccagtaccagctgatgaagcaccagagcatcagaggcttcgtgcagaagcagcagtacctgagatggcccgaggacttccaggacgtgggctggttcctgcacaagctgagccagcagatcctgaagaaggagaaggagaagaagaaggacaacaacatccccctgcagaccgtggccaccatcagctag

SEQ ID NO: 13226 - DNA, 2577 bp, Artificial Sequence; identical to SEQ ID NO: 13225
  Description of Artificial Sequence: Synthetic coding sequence

SEQ ID NO: 13227 - DNA, 66 bp, Artificial Sequence
  Description of Artificial Sequence: Synthetic coding sequence
atgggcgaccacctggacctgctgctgggcgtggtgctgatggccggccccgtgttcggcatctag

SEQ ID NO: 13228 - DNA, 2577 bp, Artificial Sequence; identical to SEQ ID NO: 13225
  Description of Artificial Sequence: Synthetic coding sequence

SEQ ID NO: 13229 - DNA, 4836 bp, Artificial Sequence
  Description of Artificial Sequence: Synthetic coding sequence
caggtgagccccagccaccccgtgaacgagaacatgcaggtgaacaagatcaagaagaacgaggacgccaagaagagactgagcgtggagagaatctaccagaagaagacccagctggagcacatcctgctgagacccgacacctacatcggcagcgtggagctggtgacccagcagatgtgggtgtacgacgaggacgtgggcatcaactacagagaggtgaccttcgtgcccggcctgtacaagatcttcgacgagatcctggtgaacgccgccgacaacaagcagagagaccccaagatgagctgcatcagagtgaccatcgaccccgagaacaacctgatcagcatctggaacaacggcaagggcatccccgtggtggagcacaaggtggagaagatgtacgtgcccgccctgatcttcggccagctgctgaccagcagcaactacgacgacgacgagaagaaggtgaccggcggcagaaacggctacggcgccaagctgtgcaacatcttcagcaccaagttcaccgtggagaccgccagcagagagtacaagaagatgttcaagcagacctggatggacaacatgggcagagccggcgagatggagctgaagcccttcaacggcgaggactacacctgcatcaccttccagcccgacctgagcaagttcaagatgcagagcctggacaaggacatcgtggccctgatggtgagaagagcctacgacatcgccggcagcaccaaggacgtgaaggtgttcctgaacggcaacaagctgcccgtgaagggcttcagaagctacgtggacatgtacctgaaggacaagctggacgagaccggcaacagcctgaaggtgatccacgagcaggtgaaccacagatgggaggtgtgcctgaccatgagcgagaagggcttccagcagatcagcttcgtgaacagcatcgccaccagcaagggcggcagacacgtggactacgtggccgaccagatcgtgaccaagctggtggacgtggtgaagaagaagaacaagggcggcgtggccgtgaaggcccaccagagactggagtgcagcggcaccatcagcgcccactgcaacctgagactgctgggcttcagcgacagcctggccagcgccagcagagtggccgagatcaccgacatgcaccaccacatccagctgatcttcgtgttcctgatcgagatgggcttctaccacgtgggccaggccggcctggagctgctggccagcctggacccccccagcagcgccagctgcgtgagccactgcacccagctgttcgtgagcaacttcatctacctgttcctgatcttcctgagaagaagcttcaccttcgtgacccaggccggcgtgcagtgcaccatcagccccaccagcagcagcgtgctggcccagttcttcgagagcttcctgttcgtggccatcggctgcggcatcgtggagagcatcctgaactgggtgaagttcaaggcccaggtgcagctgaacaagaagtgcagcgccgtgaagcacaacagaatcaagggcatccccaagctggacgacgccaacgacgccggcggcagaaacagcaccgagtgcaccctgatcctgaccgagggcgacagcgccaagaccctggccgtgagcggcctgggcgtggtgggcagagacaagtacggcgtgttccccctgagaggcaagatcctgaacgtgagagaggccagccacaagcagatcatggagaacgccgagatcaacaacatcatcaagatcgtgggcctgcagtacaagaagaactacgaggacgaggacagcctgaagaccctgagatacggcaagatcatgatcatgaccgaccaggaccaggacggcagccacatcaagggcctgctgatcaacttcatccaccacaactggcccagcctgctgagacacagattcctggaggagttcatcacccccatcgtgaaggtgagcaagaacaagcaggagatggccttctacagcctgcccgagttcgaggagtggaagagcagcacccccaaccacaagaagtggaaggtgaagtactacaagggcctgggcaccagcaccagcaaggaggccaaggagtacttcgccgacatgaagagacacagaatccagttcaagtacagcggccccgaggacgacgccgccatcagcctggccttcagcaagaagcagatcgacgacagaaaggagtggctgaccaacttcatggaggacagaagacagagaaagctgctgggcctgcccgaggactacctgtacggccagaccaccacctacctgacctacaacgacttcatcaacaaggagctgatcctgttcagcaacagcgacaacgagagaagcatccccagcatggtggacggcctgaagcccggccagagaaaggtgctgttcacctgcttcaagagaaacgacaagagagaggtgaaggtggcccagctggccggcagcgtggccgagatgagcagctaccaccacggcgagatgagcctgatgatgaccatcatcaacctggcccagaacttcgtgggcagcaacaacctgaacctgctgcagcccatcggccagttcggcaccagactgcacggcggcaaggacagcgccagccccagatacatcttcaccatgctgagcagcctggccagactgctgttcccccccaaggacgaccacaccctgaagttcctgtacgacgacaaccagagagtggagcccgagtggtacatccccatcatccccatggtgctgatcaacggcgccgagggcatcggcaccggctggagctgcaagatccccaacttcgacgtgagagagatcgtgaacaacatcagaagactgatggacggcgaggagcccctgcccatgctgcccagctacaagaacttcaagggcaccatcgaggagctggcccccaaccagtacgtgatcagcggcgaggtggccatcctgaacagcaccaccatcgagatcagcgagctgcccgtgagaacctggacccagacctacaaggagcaggtgctggagcccatgctgaacggcaccgagaagaccccccccctgatcaccgactacagagagtaccacaccgacaccaccgtgaagttcgtggtgaagatgaccgaggagaagctggccgaggccgagagagtgggcctgcacaaggtgttcaagctgcagaccagcctgacctgcaacagcatggtgctgttcgaccacgtgggctgcctgaagaagtacgacaccgtgctggacatcctgagagacttcttcgagctgagactgaagtactacggcctgagaaaggagtggctgctgggcatgctgggcgccgagagcgccaagctgaacaaccaggccagattcatcctggagaagatcgacggcaagatcatcatcgagaacaagcccaagaaggagctgatcaaggtgctgatccagagaggctacgacagcgaccccgtgaaggcctggaaggaggcccagcagaaggtgcccgacgaggaggagaacgaggagagcgacaacgagaaggagaccgagaagagcgacagcgtgaccgacagcggccccaccttcaactacctgctggacatgcccctgtggtacctgaccaaggagaagaaggacgagctgtgcagactgagaaacgagaaggagcaggagctggacaccctgaagagaaagagccccagcgacctgtggaaggaggacctggccaccttcatcgaggagctggaggccgtggaggccaaggagaagcaggacgagcaggtgggcctgcccggcaagggcggcaaggccaagggcaagaagacccagatggccgaggtgctgcccagccccagaggccagagagtgatccccagaatcaccatcgagatgaaggccgaggccgagaagaagaacaagaagaagatcaagaacgagaacaccgagggcagcccccaggaggacggcgtggagctggagggcctgaagcagagactggagaagaagcagaagagagagcccggcaccaagaccaagaagcagaccaccctggccttcaagcccatcaagaagggcaagaagagaaacccctggagcgacagcgagagcgacagaagcagcgacgagagcaacttcgacgtgccccccagagagaccgagcccagaagagccgccaccaagaccaagttcaccatggacctggacagcgacgaggacttcagcgacttcgacgagaagaccgacgacgaggacttcgtgcccagcgacgccagcccccccaagaccaagaccagccccaagctgagcaacaaggagctgaagccccagaagagcgtggtgagcgacctggaggccgacgacgtgaagggcagcgtgcccctgagcagcagcccccccgccacccacttccccgacgagaccgagatcaccaaccccgtgcccaagaagaacgtgaccgtgaagaagaccgccgccaagagccagagcagcaccagcaccaccggcgccaagaagagagccgcccccaagggcaccaagagagaccccgccctgaacagcggcgtgagccagaagcccgaccccgccaagaccaagaacagaagaaagagaaagcccagcaccagcgacgacagcgacagcaacttcgagaagatcgtgagcaaggccgtgaccagcaagaagagcaagggcgagagcgacgacttccacatggacttcgacagcgccgtggcccccagagccaagagcgtgagagccaagaagcccatcaagtacctggaggagagcgacgaggacgacctgttctag

SEQ ID NO: 13230 - DNA, 4665 bp, Artificial Sequence
  Description of Artificial Sequence: Synthetic coding sequence
caggtgagccccagccaccccgtgaacgagaacatgcaggtgaacaagatcaagaagaacgaggacgccaagaagagactgagcgtggagagaatctaccagaagaagacccagctggagcacatcctgctgagacccgacacctacatcggcagcgtggagctggtgacccagcagatgtgggtgtacgacgaggacgtgggcatcaactacagagaggtgaccttcgtgcccggcctgtacaagatcttcgacgagatcctggtgaacgccgccgacaacaagcagagagaccccaagatgagctgcatcagagtgaccatcgaccccgagaacaacctgatcagcatctggaacaacggcaagggcatccccgtggtggagcacaaggtggagaagatgtacgtgcccgccctgatcttcggccagctgctgaccagcagcaactacgacgacgacgagaagaaggtgaccggcggcagaaacggctacggcgccaagctgtgcaacatcttcagcaccaagttcaccgtggagaccgccagcagagagtacaagaagatgttcaagcagacctggatggacaacatgggcagagccggcgagatggagctgaagcccttcaacggcgaggactacacctgcatcaccttccagcccgacctgagcaagttcaagatgcagagcctggacaaggacatcgtggccctgatggtgagaagagcctacgacatcgccggcagcaccaaggacgtgaaggtgttcctgaacggcaacaagctgcccgtgaagggcttcagaagctacgtggacatgtacctgaaggacaagctggacgagaccggcaacagcctgaaggtgatccacgagcaggtgaaccacagatgggaggtgtgcctgaccatgagcgagaagggcttccagcagatcagcttcgtgaacagcatcgccaccagcaagggcggcagacacgtggactacgtggccgaccagatcgtgaccaagctggtggacgtggtgaagaagaagaacaagggcggcgtggccgtgaaggcccaccaggtgaagaaccacatgtggatcttcgtgaacgccctgatcgagaaccccaccttcgacagccagaccaaggagaacatgaccctgcagcccaagagcttcggcagcacctgccagctgagcgagaagttcatcaaggccgcccacctgtacagcagattcctgatcgaccccttcttccccaacatgatccccaacatgaacctgttccaggccatcggctgcggcatcgtggagagcatcctgaactgggtgaagttcaaggcccaggtgcagctgaacaagaagtgcagcgccgtgaagcacaacagaatcaagggcatccccaagctggacgacgccaacgacgccggcggcagaaacagcaccgagtgcaccctgatcctgaccgagggcgacagcgccaagaccctggccgtgagcggcctgggcgtggtgggcagagacaagtacggcgtgttccccctgagaggcaagatcctgaacgtgagagaggccagccacaagcagatcatggagaacgccgagatcaacaacatcatcaagatcgtgggcctgcagtacaagaagaactacgaggacgaggacagcctgaagaccctgagatacggcaagatcatgatcatgaccgaccaggaccaggacggcagccacatcaagggcctgctgatcaacttcatccaccacaactggcccagcctgctgagacacagattcctggaggagttcatcacccccatcgtgaaggtgagcaagaacaagcaggagatggccttctacagcctgcccgagttcgaggagtggaagagcagcacccccaaccacaagaagtggaaggtgaagtactacaagggcctgggcaccagcaccagcaaggaggccaaggagtacttcgccgacatgaagagacacagaatccagttcaagtacagcggccccgaggacgacgccgccatcagcctggccttcagcaagaagcagatcgacgacagaaaggagtggctgaccaacttcatggaggacagaagacagagaaagctgctgggcctgcccgaggactacctgtacggccagaccaccacctacctgacctacaacgacttcatcaacaaggagctgatcctgttcagcaacagcgacaacgagagaagcatccccagcatggtggacggcctgaagcccggccagagaaaggtgctgttcacctgcttcaagagaaacgacaagagagaggtgaaggtggcccagctggccggcagcgtggccgagatgagcagctaccaccacggcgagatgagcctgatgatgaccatcatcaacctggcccagaacttcgtgggcagcaacaacctgaacctgctgcagcccatcggccagttcggcaccagactgcacggcggcaaggacagcgccagccccagatacatcttcaccatgctgagcagcctggccagactgctgttcccccccaaggacgaccacaccctgaagttcctgtacgacgacaaccagagagtggagcccgagtggtacatccccatcatccccatggtgctgatcaacggcgccgagggcatcggcaccggctggagctgcaagatccccaacttcgacgtgagagagatcgtgaacaacatcagaagactgatggacggcgaggagcccctgcccatgctgcccagctacaagaacttcaagggcaccatcgaggagctggcccccaaccagtacgtgatcagcggcgaggtggccatcctgaacagcaccaccatcgagatcagcgagctgcccgtgagaacctggacccagacctacaaggagcaggtgctggagcccatgctgaacggcaccgagaagaccccccccctgatcaccgactacagagagtaccacaccgacaccaccgtgaagttcgtggtgaagatgaccgaggagaagctggccgaggccgagagagtgggcctgcacaaggtgttcaagctgcagaccagcctgacctgcaacagcatggtgctgttcgaccacgtgggctgcctgaagaagtacgacaccgtgctggacatcctgagagacttcttcgagctgagactgaagtactacggcctgagaaaggagtggctgctgggcatgctgggcgccgagagcgccaagctgaacaaccaggccagattcatcctggagaagatcgacggcaagatcatcatcgagaacaagcccaagaaggagctgatcaaggtgctgatccagagaggctacgacagcgaccccgtgaaggcctggaaggaggcccagcagaaggtgcccgacgaggaggagaacgaggagagcgacaacgagaaggagaccgagaagagcgacagcgtgaccgacagcggccccaccttcaactacctgctggacatgcccctgtggtacctgaccaaggagaagaaggacgagctgtgcagactgagaaacgagaaggagcaggagctggacaccctgaagagaaagagccccagcgacctgtggaaggaggacctggccaccttcatcgaggagctggaggccgtggaggccaaggagaagcaggacgagcaggtgggcctgcccggcaagggcggcaaggccaagggcaagaagacccagatggccgaggtgctgcccagccccagaggccagagagtgatccccagaatcaccatcgagatgaaggccgaggccgagaagaagaacaagaagaagatcaagaacgagaacaccgagggcagcccccaggaggacggcgtggagctggagggcctgaagcagagactggagaagaagcagaagagagagcccggcaccaagaccaagaagcagaccaccctggccttcaagcccatcaagaagggcaagaagagaaacccctggagcgacagcgagagcgacagaagcagcgacgagagcaacttcgacgtgccccccagagagaccgagcccagaagagccgccaccaagaccaagttcaccatggacctggacagcgacgaggacttcagcgacttcgacgagaagaccgacgacgaggacttcgtgcccagcgacgccagcccccccaagaccaagaccagccccaagctgagcaacaaggagctgaagccccagaagagcgtggtgagcgacctggaggccgacgacgtgaagggcagcgtgcccctgagcagcagcccccccgccacccacttccccgacgagaccgagatcaccaaccccgtgcccaagaagaacgtgaccgtgaagaagaccgccgccaagagccagagcagcaccagcaccaccggcgccaagaagagagccgcccccaagggcaccaagagagaccccgccctgaacagcggcgtgagccagaagcccgaccccgccaagaccaagaacagaagaaagagaaagcccagcaccagcgacgacagcgacagcaacttcgagaagatcgtgagcaaggccgtgaccagcaagaagagcaagggcgagagcgacgacttccacatggacttcgacagcgccgtggcccccagagccaagagcgtgagagccaagaagcccatcaagtacctggaggagagcgacgaggacgacctgttctag

SEQ ID NO: 13231 - DNA, 4707 bp, Artificial Sequence
  Description of Artificial Sequence: Synthetic coding sequence
atggaggtgagccccctgcagcccgtgaacgagaacatgcaggtgaacaagatcaagaagaacgaggacgccaagaagagactgagcgtggagagaatctaccagaagaagacccagctggagcacatcctgctgagacccgacacctacatcggcagcgtggagctggtgacccagcagatgtgggtgtacgacgaggacgtgggcatcaactacagagaggtgaccttcgtgcccggcctgtacaagatcttcgacgagatcctggtgaacgccgccgacaacaagcagagagaccccaagatgagctgcatcagagtgaccatcgaccccgagaacaacctgatcagcatctggaacaacggcaagggcatccccgtggtggagcacaaggtggagaagatgtacgtgcccgccctgatcttcggccagctgctgaccagcagcaactacgacgacgacgagaagaaggtgaccggcggcagaaacggctacggcgccaagctgtgcaacatcttcagcaccaagttcaccgtggagaccgccagcagagagtacaagaagatgttcaagcaggccatcacctggatggacaacatgggcagagccggcgagatggagctgaagcccttcaacggcgaggactacacctgcatcaccttccagcccgacctgagcaagttcaagatgcagagcctggacaaggacatcgtggccctgatggtgagaagagcctacgacatcgccggcagcaccaaggacgtgaaggtgttcctgaacggcaacaagctgcccgtgaagggcttcagaagctacgtggacatgtacctgaaggacaagctggacgagaccggcaacagcctgaaggtgatccacgagcaggtgaaccacagatgggaggtgtgcctgaccatgagcgagaagggcttccagcagatcagcttcgtgaacagcatcgccaccagcaaggtgatcctgttcctgaactacatgatctacctgtacatctacgtgttcctgctgttcctgatctacaaggtggacctgaacatcggcctggcctacttcaccggcggcagacacgtggactacgtggccgaccagatcgtgaccaagctggtggacgtggtgaagaagaagaacaagggcggcgtggccgtgaaggcccaccaggtgaagaaccacatgtggatcttcgtgaacgccctgatcgagaaccccaccttcgacagccagaccaaggagaacatgaccctgcagcccaagagcttcggcagcacctgccagctgagcgagaagttcatcaaggccgccatcggctgcggcatcgtggagagcatcctgaactgggtgaagttcaaggcccaggtgcagctgaacaagaagtgcagcgccgtgaagcacaacagaatcaagggcatccccaagctggacgacgccaacgacgccggcggcagaaacagcaccgagtgcaccctgatcctgaccgagggcgacagcgccaagaccctggccgtgagcggcctgggcgtggtgggcagagacaagtacggcgtgttccccctgagaggcaagatcctgaacgtgagagaggccagccacaagcagatcatggagaacgccgagatcaacaacatcatcaagatcgtgggcctgcagtacaagaagaactacgaggacgaggacagcctgaagaccctgagatacggcaagatcatgatcatgaccgaccaggaccaggacggcagccacatcaagggcctgctgatcaacttcatccaccacaactggcccagcctgctgagacacagattcctggaggagttcatcacccccatcgtgaaggtgagcaagaacaagcaggagatggccttctacagcctgcccgagttcgaggagtggaagagcagcacccccaaccacaagaagtggaaggtgaagtactacaagggcctgggcaccagcaccagcaaggaggccaaggagtacttcgccgacatgaagagacacagaatccagttcaagtacagcggccccgaggacgacgccgccatcagcctggccttcagcaagaagcagatcgacgacagaaaggagtggctgaccaacttcatggaggacagaagacagagaaagctgctgggcctgcccgaggactacctgtacggccagaccaccacctacctgacctacaacgacttcatcaacaaggagctgatcctgttcagcaacagcgacaacgagagaagcatccccagcatggtggacggcctgaagcccggccagagaaaggtgctgttcacctgcttcaagagaaacgacaagagagaggtgaaggtggcccagctggccggcagcgtggccgagatgagcagctaccaccacggcgagatgagcctgatgatgaccatcatcaacctggcccagaacttcgtgggcagcaacaacctgaacctgctgcagcccatcggccagttcggcaccagactgcacggcggcaaggacagcgccagccccagatacatcttcaccatgctgagcagcctggccagactgctgttcccccccaaggacgaccacaccctgaagttcctgtacgacgacaaccagagagtggagcccgagtggtacatccccatcatccccatggtgctgatcaacggcgccgagggcatcggcaccggctggagctgcaagatccccaacttcgacgtgagagagatcgtgaacaacatcagaagactgatggacggcgaggagcccctgcccatgctgcccagctacaagaacttcaagggcaccatcgaggagctggcccccaaccagtacgtgatcagcggcgaggtggccatcctgaacagcaccaccatcgagatcagcgagctgcccgtgagaacctggacccagacctacaaggagcaggtgctggagcccatgctgaacggcaccgagaagaccccccccctgatcaccgactacagagagtaccacaccgacaccaccgtgaagttcgtggtgaagatgaccgaggagaagctggccgaggccgagagagtgggcctgcacaaggtgttcaagctgcagaccagcctgacctgcaacagcatggtgctgttcgaccacgtgggctgcctgaagaagtacgacaccgtgctggacatcctgagagacttcttcgagctgagactgaagtactacggcctgagaaaggagtggctgctgggcatgctgggcgccgagagcgccaagctgaacaaccaggccagattcatcctggagaagatcgacggcaagatcatcatcgagaacaagcccaagaaggagctgatcaaggtgctgatccagagaggctacgacagcgaccccgtgaaggcctggaaggaggcccagcagaaggtgcccgacgaggaggagaacgaggagagcgacaacgagaaggagaccgagaagagcgacagcgtgaccgacagcggccccaccttcaactacctgctggacatgcccctgtggtacctgaccaaggagaagaaggacgagctgtgcagactgagaaacgagaaggagcaggagctggacaccctgaagagaaagagccccagcgacctgtggaaggaggacctggccaccttcatcgaggagctggaggccgtggaggccaaggagaagcaggacgagcaggtgggcctgcccggcaagggcggcaaggccaagggcaagaagacccagatggccgaggtgctgcccagccccagaggccagagagtgatccccagaatcaccatcgagatgaaggccgaggccgagaagaagaacaagaagaagatcaagaacgagaacaccgagggcagcccccaggaggacggcgtggagctggagggcctgaagcagagactggagaagaagcagaagagagagcccggcaccaagaccaagaagcagaccaccctggccttcaagcccatcaagaagggcaagaagagaaacccctggagcgacagcgagagcgacagaagcagcgacgagagcaacttcgacgtgccccccagagagaccgagcccagaagagccgccaccaagaccaagttcaccatggacctggacagcgacgaggacttcagcgacttcgacgagaagaccgacgacgaggacttcgtgcccagcgacgccagcccccccaagaccaagaccagccccaagcagaactgcaacaaggagctgaagccccagaagagcgtggtgagcgacctggaggccgacgacgtgaagggcagcgtgcccctgagcagcagcccccccgccacccacttccccgacgagaccgagatcaccaaccccgtgcccaagaagaacgtgaccgtgaagaagaccgccgccaagagccagagcagcaccagcaccaccggcgccaagaagagagccgcccccaagggcaccaagagagaccccgccctgaacagcggcgtgagccagaagcccgaccccgccaagaccaagaacagaagaaagagaaagcccagcaccagcgacgacagcgacagcaacttcgagaagatcgtgagcaaggccgtgaccagcaagaagagcaagggcgagagcgacgacttccacatggacttcgacagcgccgtggcccccagagccaagagcgtgagagccaagaagcccatcaagtacctggaggagagcgacgaggacgacctgttctag

SEQ ID NO: 13232 - DNA, 4596 bp, Artificial Sequence
  Description of Artificial Sequence: Synthetic coding sequence
atggaggtgagccccctgcagcccgtgaacgagaacatgcaggtgaacaagatcaagaagaacgaggacgccaagaagagactgagcgtggagagaatctaccagaagaagacccagctggagcacatcctgctgagacccgacacctacatcggcagcgtggagctggtgacccagcagatgtgggtgtacgacgaggacgtgggcatcaactacagagaggtgaccttcgtgcccggcctgtacaagatcttcgacgagatcctggtgaacgccgccgacaacaagcagagagaccccaagatgagctgcatcagagtgaccatcgaccccgagaacaacctgatcagcatctggaacaacggcaagggcatccccgtggtggagcacaaggtggagaagatgtacgtgcccgccctgatcttcggccagctgctgaccagcagcaactacgacgacgacgagaagaaggtgaccggcggcagaaacggctacggcgccaagctgtgcaacatcttcagcaccaagttcaccgtggagaccgccagcagagagtacaagaagatgttcaagcagacctggatggacaacatgggcagagccggcgagatggagctgaagcccttcaacggcgaggactacacctgcatcaccttccagcccgacctgagcaagttcaagatgcagagcctggacaaggacatcgtggccctgatggtgagaagagcctacgacatcgccggcagcaccaaggacgtgaaggtgttcctgaacggcaacaagctgcccgtgaagggcttcagaagctacgtggacatgtacctgaaggacaagctggacgagaccggcaacagcctgaaggtgatccacgagcaggtgaaccacagatgggaggtgtgcctgaccatgagcgagaagggcttccagcagatcagcttcgtgaacagcatcgccaccagcaagggcggcagacacgtggactacgtggccgaccagatcgtgaccaagctggtggacgtggtgaagaagaagaacaagggcggcgtggccgtgaaggcccaccaggtgaagaaccacatgtggatcttcgtgaacgccctgatcgagaaccccaccttcgacagccagaccaaggagaacatgaccctgcagcccaagagcttcggcagcacctgccagctgagcgagaagttcatcaaggccgccatcggctgcggcatcgtggagagcatcctgaactgggtgaagttcaaggcccaggtgcagctgaacaagaagtgcagcgccgtgaagcacaacagaatcaagggcatccccaagctggacgacgccaacgacgccggcggcagaaacagcaccgagtgcaccctgatcctgaccgagggcgacagcgccaagaccctggccgtgagcggcctgggcgtggtgggcagagacaagtacggcgtgttccccctgagaggcaagatcctgaacgtgagagaggccagccacaagcagatcatggagaacgccgagatcaacaacatcatcaagatcgtgggcctgcagtacaagaagaactacgaggacgaggacagcctgaagaccctgagatacggcaagatcatgatcatgaccgaccaggaccaggacggcagccacatcaagggcctgctgatcaacttcatccaccacaactggcccagcctgctgagacacagattcctggaggagttcatcacccccatcgtgaaggtgagcaagaacaagcaggagatggccttctacagcctgcccgagttcgaggagtggaagagcagcacccccaaccacaagaagtggaaggtgaagtactacaagggcctgggcaccagcaccagcaaggaggccaaggagtacttcgccgacatgaagagacacagaatccagttcaagtacagcggccccgaggacgacgccgccatcagcctggccttcagcaagaagcagatcgacgacagaaaggagtggctgaccaacttcatggaggacagaagacagagaaagctgctgggcctgcccgaggactacctgtacggccagaccaccacctacctgacctacaacgacttcatcaacaaggagctgatcctgttcagcaacagcgacaacgagagaagcatccccagcatggtggacggcctgaagcccggccagagaaaggtgctgttcacctgcttcaagagaaacgacaagagagaggtgaaggtggcccagctggccggcagcgtggccgagatgagcagctaccaccacggcgagatgagcctgatgatgaccatcatcaacctggcccagaacttcgtgggcagcaacaacctgaacctgctgcagcccatcggccagttcggcaccagactgcacggcggcaaggacagcgccagccccagatacatcttcaccatgctgagcagcctggccagactgctgttcccccccaaggacgaccacaccctgaagttcctgtacgacgacaaccagagagtggagcccgagtggtacatccccatcatccccatggtgctgatcaacggcgccgagggcatcggcaccggctggagctgcaagatccccaacttcgacgtgagagagatcgtgaacaacatcagaagactgatggacggcgaggagcccctgcccatgctgcccagctacaagaacttcaagggcaccatcgaggagctggcccccaaccagtacgtgatcagcggcgaggtggccatcctgaacagcaccaccatcgagatcagcgagctgcccgtgagaacctggacccagacctacaaggagcaggtgctggagcccatgctgaacggcaccgagaagaccccccccctgatcaccgactacagagagtaccacaccgacaccaccgtgaagttcgtggtgaagatgaccgaggagaagctggccgaggccgagagagtgggcctgcacaaggtgttcaagctgcagaccagcctgacctgcaacagcatggtgctgttcgaccacgtgggctgcctgaagaagtacgacaccgtgctggacatcctgagagacttcttcgagctgagactgaagtactacggcctgagaaaggagtggctgctgggcatgctgggcgccgagagcgccaagctgaacaaccaggccagattcatcctggagaagatcgacggcaagatcatcatcgagaacaagcccaagaaggagctgatcaaggtgctgatccagagaggctacgacagcgaccccgtgaaggcctggaaggaggcccagcagaaggtgcccgacgaggaggagaacgaggagagcgacaacgagaaggagaccgagaagagcgacagcgtgaccgacagcggccccaccttcaactacctgctggacatgcccctgtggtacctgaccaaggagaagaaggacgagctgtgcagactgagaaacgagaaggagcaggagctggacaccctgaagagaaagagccccagcgacctgtggaaggaggacctggccaccttcatcgaggagctggaggccgtggaggccaaggagaagcaggacgagcaggtgggcctgcccggcaagggcggcaaggccaagggcaagaagacccagatggccgaggtgctgcccagccccagaggccagagagtgatccccagaatcaccatcgagatgaaggccgaggccgagaagaagaacaagaagaagatcaagaacgagaacaccgagggcagcccccaggaggacggcgtggagctggagggcctgaagcagagactggagaagaagcagaagagagagcccggcaccaagaccaagaagcagaccaccctggccttcaagcccatcaagaagggcaagaagagaaacccctggagcgacagcgagagcgacagaagcagcgacgagagcaacttcgacgtgccccccagagagaccgagcccagaagagccgccaccaagaccaagttcaccatggacctggacagcgacgaggacttcagcgacttcgacgagaagaccgacgacgaggacttcgtgcccagcgacgccagcccccccaagaccaagaccagccccaagctgagcaacaaggagctgaagccccagaagagcgtggtgagcgacctggaggccgacgacgtgaagggcagcgtgcccctgagcagcagcccccccgccacccacttccccgacgagaccgagatcaccaaccccgtgcccaagaagaacgtgaccgtgaagaagaccgccgccaagagccagagcagcaccagcaccaccggcgccaagaagagagccgcccccaagggcaccaagagagaccccgccctgaacagcggcgtgagccagaagcccgaccccgccaagaccaagaacagaagaaagagaaagcccagcaccagcgacgacagcgacagcaacttcgagaagatcgtgagcaaggccgtgaccagcaagaagagcaagggcgagagcgacgacttccacatggacttcgacagcgccgtggcccccagagccaagagcgtgagagccaagaagcccatcaagtacctggaggagagcgacgaggacgacctgttctag

SEQ ID NO: 13233 - DNA, 4881 bp, Artificial Sequence
  Description of Artificial Sequence: Synthetic coding sequence
atggccaagagcggcggctgcggcgccggcgccggcgtgggcggcggcaacggcgccctgacctgggtgaccctgttcgaccagaacaacgccgccaagaaggaggagagcgagaccgccaacaagaacgacagcagcaagaagctgagcgtggagagagtgtaccagaagaagacccagctggagcacatcctgctgagacccgacacctacatcggcagcgtggagcccctgacccagttcatgtgggtgtacgacgaggacgtgggcatgaactgcagagaggtgaccttcgtgcccggcctgtacaagatcttcgacgagatcctggtgaacgccgccgacaacaagcagagagacaagaacatgacctgcatcaaggtgagcatcgaccccgagagcaacatcatcagcatctggaacaacggcaagggcatccccgtggtggagcacaaggtggagaaggtgtacgtgcccgccctgatcttcggccagctgctgaccagcagcaactacgacgacgacgagaagaaggtgaccggcggcagaaacggctacggcgccaagctgtgcaacatcttcagcaccaagttcaccgtggagaccgcctgcaaggagtacaagcacagcttcaagcagacctggatgaacaacatgatgaagaccagcgaggccaagatcaagcacttcgacggcgaggactacacctgcatcaccttccagcccgacctgagcaagttcaagatggagaagctggacaaggacatcgtggccctgatgaccagaagagcctacgacctggccggcagctgcagaggcgtgaaggtgatgttcaacggcaagaagctgcccgtgaacggcttcagaagctacgtggacctgtacgtgaaggacaagctggacgagaccggcgtggccctgaaggtgatccacgagctggccaacgagagatgggacgtgtgcctgaccctgagcgagaagggcttccagcagatcagcttcgtgaacagcatcgccaccaccaagggcggcagacacgtggactacgtggtggaccaggtggtgggcaagctgatcgaggtggtgaagaagaagaacaaggccggcgtgagcgtgaagcccttccaggtgaagaaccacatctgggtgttcatcaactgcctgatcgagaaccccaccttcgacagccagaccaaggagaacatgaccctgcagcccaagagcttcggcagcaagtgccagctgagcgagaagttcttcaaggccgccagcaactgcggcatcgtggagagcatcctgaactgggtgaagttcaaggcccagacccagctgaacaagaagtgcagcagcgtgaagtacagcaagatcaagggcatccccaagctggacgacgccaacgacgccggcggcaagcacagcctggagtgcaccctgatcctgaccgagggcgacagcgccaagagcctggccgtgagcggcctgggcgtgatcggcagagacagatacggcgtgttccccctgagaggcaagatcctgaacgtgagagaggccagccacaagcagatcatggagaacgccgagatcaacaacatcatcaagatcgtgggcctgcagtacaagaagagctacgacgacgccgagagcctgaagaccctgagatacggcaagatcatgatcatgaccgaccaggaccaggacggcagccacatcaagggcctgctgatcaacttcatccaccacaactggcccagcctgctgaagcacggcttcctggaggagttcatcacccccatcgtgaaggccagcaagaacaagcaggagctgagcttctacagcatccccgagttcgacgagtggaagaagcacatcgagaaccagaaggcctggaagatcaagtactacaagggcctgggcaccagcaccgccaaggaggccaaggagtacttcgccgacatggagagacacagaatcctgttcagatacgccggccccgaggacgacgccgccatcaccctggccttcagcaagaagaagatcgacgacagaaaggagtggctgaccaacttcatggaggacagaagacagagaagactgcacggcctgcccgagcagttcctgtacggcaccgccaccaagcacctgacctacaacgacttcatcaacaaggagctgatcctgttcagcaacagcgacaacgagagaagcatccccagcctggtggacggcttcaagcccggccagagaaaggtgctgttcacctgcttcaagagaaacgacaagagagaggtgaaggtggcccagctggccggcagcgtggccgagatgagcgcctaccaccacggcgagcaggccctgatgatgaccatcgtgaacctggcccagaacttcgtgggcagcaacaacatcaacctgctgcagcccatcggccagttcggcaccagactgcacggcggcaaggacgccgccagccccagatacatcttcaccatgctgagcaccctggccagactgctgttccccgccgtggacgacaacctgctgaagttcctgtacgacgacaaccagagagtggagcccgagtggtacatccccatcatccccatggtgctgatcaacggcgccgagggcatcggcaccggctgggcctgcaagctgcccaactacgacgccagagagatcgtgaacaacgtgagaagaatgctggacggcctggacccccaccccatgctgcccaactacaagaacttcaagggcaccatccaggagctgggccagaaccagtacgccgtgagcggcgagatcttcgtggtggacagaaacaccgtggagatcaccgagctgcccgtgagaacctggacccaggtgtacaaggagcaggtgctggagcccatgctgaacggcaccgacaagacccccgccctgatcagcgactacaaggagtaccacaccgacaccaccgtgaagttcgtggtgaagatgaccgaggagaagctggcccaggccgaggccgccggcctgcacaaggtgttcaagctgcagaccaccctgacctgcaacagcatggtgctgttcgaccacatgggctgcctgaagaagtacgagaccgtgcaggacatcctgaaggagttcttcgacctgagactgagctactacggcctgagaaaggagtggctggtgggcatgctgggcgccgagagcaccaagctgaacaaccaggccagattcatcctggagaagatccagggcaagatcaccatcgagaacagaagcaagaaggacctgatccagatgctggtgcagagaggctacgagagcgaccccgtgaaggcctggaaggaggcccaggagaaggccgccgaggaggacgagacccagaaccagcacgacgacagcagcagcgacagcggcacccccagcggccccgacttcaactacatcctgaacatgagcctgtggagcctgaccaaggagaaggtggaggagctgatcaagcagagagacgccaagggcagagaggtgaacgacctgaagagaaagagccccagcgacctgtggaaggaggacctggccgccttcgtggaggagctggacaaggtggagagccaggagagagaggacgtgctggccggcatgagcggcaaggccatcaagggcaaggtgggcaagcccaaggtgaagaagctgcagctggaggagaccatgcccagcccctacggcagaagaatcatccccgagatcaccgccatgaaggccgacgccagcaagaagctgctgaagaagaagaagggcgacctggacaccgccgccgtgaaggtggagttcgacgaggagttcagcggcgcccccgtggagggcgccggcgaggaggccctgacccccagcgtgcccatcaacaagggccccaagcccaagagagagaagaaggagcccggcaccagagtgagaaagacccccaccagcagcggcaagcccagcgccaagaaggtgaagaagagaaacccctggagcgacgacgagagcaagagcgagagcgacctggaggagaccgagcccgtggtgatccccagagacagcctgctgagaagagccgccgccgagagacccaagtacaccttcgacttcagcgaggaggaggacgacgacgccgacgacgacgacgacgacaacaacgacctggaggagctgaaggtgaaggccagccccatcaccaacgacggcgaggacgagttcgtgcccagcgacggcctggacaaggacgagtacaccttcagccccggcaagagcaaggccacccccgagaagagcctgcacgacaagaagagccaggacttcggcaacctgttcagcttccccagctacagccagaagagcgaggacgacagcgccaagttcgacagcaacgaggaggacagcgccagcgtgttcagccccagcttcggcctgaagcagaccgacaaggtgcccagcaagaccgtggccgccaagaagggcaagcccagcagcgacaccgtgcccaagcccaagagagcccccaagcagaagaaggtggtggaggccgtgaacagcgacagcgacagcgagttcggcatccccaagaagaccaccacccccaagggcaagggcagaggcgccaagaagagaaaggccagcggcagcgagaacgagggcgactacaaccccggcagaaagaccagcaagaccaccagcaagaagcccaagaagaccagcttcgaccaggacagcgacgtggacatcttccccagcgacttccccaccgagccccccagcctgcccagaaccggcagagccagaaaggaggtgaagtacttcgccgagagcgacgaggaggaggacgacgtggacttcgccatgttcaactag

SEQ ID NO: 13234 - DNA, 3453 bp, Artificial Sequence
  Description of Artificial Sequence: Synthetic coding sequence
atggccaagagcggcggctgcggcgccggcgccggcgtgggcggcggcaacggcgccctgacctgggtgaacaacgccgccaagaaggaggagagcgagaccgccaacaagaacgacagcagcaagaagctgagcgtggagagagtgtaccagaagaagacccagctggagcacatcctgctgagacccgacacctacatcggcagcgtggagcccctgacccagttcatgtgggtgtacgacgaggacgtgggcatgaactgcagagaggtgaccttcgtgcccggcctgtacaagatcttcgacgagatcctggtgaacgccgccgacaacaagcagagagacaagaacatgacctgcatcaaggtgagcatcgaccccgagagcaacatcatcagcatctggaacaacggcaagggcatccccgtggtggagcacaaggtggagaaggtgtacgtgcccgccctgatcttcggccagctgctgaccagcagcaactacgacgacgacgagaagaaggtgaccggcggcagaaacggctacggcgccaagctgtgcaacatcttcagcaccaagttcaccgtggagaccgcctgcaaggagtacaagcacagcttcaagcagacctggatgaacaacatgatgaagaccagcgaggccaagatcaagcacttcgacggcgaggactacacctgcatcaccttccagcccgacctgagcaagttcaagatggagaagctggacaaggacatcgtggccctgatgaccagaagagcctacgacctggccggcagctgcagaggcgtgaaggtgatgttcaacggcaagaagctgcccgtgaacggcttcagaagctacgtggacctgtacgtgaaggacaagctggacgagaccggcgtggccctgaaggtgatccacgagctggccaacgagagatgggacgtgtgcctgaccctgagcgagaagggcttccagcagatcagcttcgtgaacagcatcgccaccaccaagggcggcagacacgtggactacgtggtggaccaggtggtgggcaagctgatcgaggtggtgaagaagaagaacaaggccggcgtgagcgtgaagcccttccaggtgaagaaccacatctgggtgttcatcaactgcctgatcgagaaccccaccttcgacagccagaccaaggagaacatgaccctgcagcccaagagcttcggcagcaagtgccagctgagcgagaagttcttcaaggccgccagcaactgcggcatcgtggagagcatcctgaactgggtgaagttcaaggcccagacccagctgaacaagaagtgcagcagcgtgaagtacagcaagatcaagggcatccccaagctggacgacgccaacgacgccggcggcaagcacagcctggagtgcaccctgatcctgaccgagggcgacagcgccaagagcctggccgtgagcggcctgggcgtgatcggcagagacagatacggcgtgttccccctgagaggcaagatcctgaacgtgagagaggccagccacaagcagatcatggagaacgccgagatcaacaacatcatcaagatcgtgggcctgcagtacaagaagagctacgacgacgccgagagcctgaagaccctgagatacggcaagatcatgatcatgaccgaccaggaccaggacggcagccacatcaagggcctgctgatcaacttcatccaccacaactggcccagcctgctgaagcacggcttcctggaggagttcatcacccccatcgtgaaggccagcaagaacaagcaggagctgagcttctacagcatccccgagttcgacgagtggaagaagcacatcgagaaccagaaggcctggaagatcaagtactacaagggcctgggcaccagcaccgccaaggaggccaaggagtacttcgccgacatggagagacacagaatcctgttcagatacgccggccccgaggacgacgccgccatcaccctggccttcagcaagaagaagatcgacgacagaaaggagtggctgaccaacttcatggaggacagaagacagagaagactgcacggcctgcccgagcagttcctgtacggcaccgccaccaagcacctgacctacaacgacttcatcaacaaggagctgatcctgttcagcaacagcgacaacgagagaagcatccccagcctggtggacggcttcaagcccggccagagaaaggtgctgttcacctgcttcaagagaaacgacaagagagaggtgaaggtggcccagctggccggcagcgtggccgagatgagcgcctaccaccacggcgagcaggccctgatgatgaccatcgtgaacctggcccagaacttcgtgggcagcaacaacatcaacctgctgcagcccatcggccagttcggcaccagactgcacggcggcaaggacgccgccagccccagatacatcttcaccatgctgagcaccctggccagactgctgttccccgccgtggacgacaacctgctgaagttcctgtacgacgacaaccagagagtggagcccgagtggtacatccccatcatccccatggtgctgatcaacggcgccgagggcatcggcaccggctgggcctgcaagctgcccaactacgacgccagagagatcgtgaacaacgtgagaagaatgctggacggcctggacccccaccccatgctgcccaactacaagaacttcaagggcaccatccaggagctgggccagaaccagtacgccgtgagcggcgagatcttcgtggtggacagaaacaccgtggagatcaccgagctgcccgtgagaacctggacccaggtgtacaaggagcaggtgctggagcccatgctgaacggcaccgacaagacccccgccctgatcagcgactacaaggagtaccacaccgacaccaccgtgaagttcgtggtgaagatgaccgaggagaagctggcccaggccgaggccgccggcctgcacaaggtgttcaagctgcagaccaccctgacctgcaacagcatggtgctgttcgaccacatgggctgcctgaagaagtacgagaccgtgcaggacatcctgaaggagttcttcgacctgagactgagctactacggcctgagaaaggagtggctggtgggcatgctgggcgccgagagcaccaagctgaacaaccaggccagattcatcctggagaagatccagggcaagatcaccatcgagaacagaagcaagaaggacctgatccagatgctggtgcagagaggctacgagagcgaccccgtgaaggcctggaaggaggcccaggagaaggccgccgaggaggacgagacccagaaccagcacgacgacagcagcagcgacagcggcacccccagcggccccgacttcaactacatcctgaacatgagcctgtggagcctgacctag

SEQ ID NO: 13235 - DNA, 4866 bp, Artificial Sequence
  Description of Artificial Sequence: Synthetic coding sequence
atggccaagagcggcggctgcggcgccggcgccggcgtgggcggcggcaacggcgccctgacctgggtgaacaacgccgccaagaaggaggagagcgagaccgccaacaagaacgacagcagcaagaagctgagcgtggagagagtgtaccagaagaagacccagctggagcacatcctgctgagacccgacacctacatcggcagcgtggagcccctgacccagttcatgtgggtgtacgacgaggacgtgggcatgaactgcagagaggtgaccttcgtgcccggcctgtacaagatcttcgacgagatcctggtgaacgccgccgacaacaagcagagagacaagaacatgacctgcatcaaggtgagcatcgaccccgagagcaacatcatcagcatctggaacaacggcaagggcatccccgtggtggagcacaaggtggagaaggtgtacgtgcccgccctgatcttcggccagctgctgaccagcagcaactacgacgacgacgagaagaaggtgaccggcggcagaaacggctacggcgccaagctgtgcaacatcttcagcaccaagttcaccgtggagaccgcctgcaaggagtacaagcacagcttcaagcagacctggatgaacaacatgatgaagaccagcgaggccaagatcaagcacttcgacggcgaggactacacctgcatcaccttccagcccgacctgagcaagttcaagatggagaagctggacaaggacatcgtggccctgatgaccagaagagcctacgacctggccggcagctgcagaggcgtgaaggtgatgttcaacggcaagaagctgcccgtgaacggcttcagaagctacgtggacctgtacgtgaaggacaagctggacgagaccggcgtggccctgaaggtgatccacgagctggccaacgagagatgggacgtgtgcctgaccctgagcgagaagggcttccagcagatcagcttcgtgaacagcatcgccaccaccaagggcggcagacacgtggactacgtggtggaccaggtggtgggcaagctgatcgaggtggtgaagaagaagaacaaggccggcgtgagcgtgaagcccttccaggtgaagaaccacatctgggtgttcatcaactgcctgatcgagaaccccaccttcgacagccagaccaaggagaacatgaccctgcagcccaagagcttcggcagcaagtgccagctgagcgagaagttcttcaaggccgccagcaactgcggcatcgtggagagcatcctgaactgggtgaagttcaaggcccagacccagctgaacaagaagtgcagcagcgtgaagtacagcaagatcaagggcatccccaagctggacgacgccaacgacgccggcggcaagcacagcctggagtgcaccctgatcctgaccgagggcgacagcgccaagagcctggccgtgagcggcctgggcgtgatcggcagagacagatacggcgtgttccccctgagaggcaagatcctgaacgtgagagaggccagccacaagcagatcatggagaacgccgagatcaacaacatcatcaagatcgtgggcctgcagtacaagaagagctacgacgacgccgagagcctgaagaccctgagatacggcaagatcatgatcatgaccgaccaggaccaggacggcagccacatcaagggcctgctgatcaacttcatccaccacaactggcccagcctgctgaagcacggcttcctggaggagttcatcacccccatcgtgaaggccagcaagaacaagcaggagctgagcttctacagcatccccgagttcgacgagtggaagaagcacatcgagaaccagaaggcctggaagatcaagtactacaagggcctgggcaccagcaccgccaaggaggccaaggagtacttcgccgacatggagagacacagaatcctgttcagatacgccggccccgaggacgacgccgccatcaccctggccttcagcaagaagaagatcgacgacagaaaggagtggctgaccaacttcatggaggacagaagacagagaagactgcacggcctgcccgagcagttcctgtacggcaccgccaccaagcacctgacctacaacgacttcatcaacaaggagctgatcctgttcagcaacagcgacaacgagagaagcatccccagcctggtggacggcttcaagcccggccagagaaaggtgctgttcacctgcttcaagagaaacgacaagagagaggtgaaggtggcccagctggccggcagcgtggccgagatgagcgcctaccaccacggcgagcaggccctgatgatgaccatcgtgaacctggcccagaacttcgtgggcagcaacaacatcaacctgctgcagcccatcggccagttcggcaccagactgcacggcggcaaggacgccgccagccccagatacatcttcaccatgctgagcaccctggccagactgctgttccccgccgtggacgacaacctgctgaagttcctgtacgacgacaaccagagagtggagcccgagtggtacatccccatcatccccatggtgctgatcaacggcgccgagggcatcggcaccggctgggcctgcaagctgcccaactacgacgccagagagatcgtgaacaacgtgagaagaatgctggacggcctggacccccaccccatgctgcccaactacaagaacttcaagggcaccatccaggagctgggccagaaccagtacgccgtgagcggcgagatcttcgtggtggacagaaacaccgtggagatcaccgagctgcccgtgagaacctggacccaggtgtacaaggagcaggtgctggagcccatgctgaacggcaccgacaagacccccgccctgatcagcgactacaaggagtaccacaccgacaccaccgtgaagttcgtggtgaagatgaccgaggagaagctggcccaggccgaggccgccggcctgcacaaggtgttcaagctgcagaccaccctgacctgcaacagcatggtgctgttcgaccacatgggctgcctgaagaagtacgagaccgtgcaggacatcctgaaggagttcttcgacctgagactgagctactacggcctgagaaaggagtggctggtgggcatgctgggcgccgagagcaccaagctgaacaaccaggccagattcatcctggagaagatccagggcaagatcaccatcgagaacagaagcaagaaggacctgatccagatgctggtgcagagaggctacgagagcgaccccgtgaaggcctggaaggaggcccaggagaaggccgccgaggaggacgagacccagaaccagcacgacgacagcagcagcgacagcggcacccccagcggccccgacttcaactacatcctgaacatgagcctgtggagcctgaccaaggagaaggtggaggagctgatcaagcagagagacgccaagggcagagaggtgaacgacctgaagagaaagagccccagcgacctgtggaaggaggacctggccgccttcgtggaggagctggacaaggtggagagccaggagagagaggacgtgctggccggcatgagcggcaaggccatcaagggcaaggtgggcaagcccaaggtgaagaagctgcagctggaggagaccatgcccagcccctacggcagaagaatcatccccgagatcaccgccatgaaggccgacgccagcaagaagctgctgaagaagaagaagggcgacctggacaccgccgccgtgaaggtggagttcgacgaggagttcagcggcgcccccgtggagggcgccggcgaggaggccctgacccccagcgtgcccatcaacaagggccccaagcccaagagagagaagaaggagcccggcaccagagtgagaaagacccccaccagcagcggcaagcccagcgccaagaaggtgaagaagagaaacccctggagcgacgacgagagcaagagcgagagcgacctggaggagaccgagcccgtggtgatccccagagacagcctgctgagaagagccgccgccgagagacccaagtacaccttcgacttcagcgaggaggaggacgacgacgccgacgacgacgacgacgacaacaacgacctggaggagctgaaggtgaaggccagccccatcaccaacgacggcgaggacgagttcgtgcccagcgacggcctggacaaggacgagtacaccttcagccccggcaagagcaaggccacccccgagaagagcctgcacgacaagaagagccaggacttcggcaacctgttcagcttccccagctacagccagaagagcgaggacgacagcgccaagttcgacagcaacgaggaggacagcgccagcgtgttcagccccagcttcggcctgaagcagaccgacaaggtgcccagcaagaccgtggccgccaagaagggcaagcccagcagcgacaccgtgcccaagcccaagagagcccccaagcagaagaaggtggtggaggccgtgaacagcgacagcgacagcgagttcggcatccccaagaagaccaccacccccaagggcaagggcagaggcgccaagaagagaaaggccagcggcagcgagaacgagggcgactacaaccccggcagaaagaccagcaagaccaccagcaagaagcccaagaagaccagcttcgaccaggacagcgacgtggacatcttccccagcgacttccccaccgagccccccagcctgcccagaaccggcagagccagaaaggaggtgaagtacttcgccgagagcgacgaggaggaggacgacgtggacttcgccatgttcaactag

SEQ ID NO: 13236 - DNA, 174 bp, Artificial Sequence
  Description of Artificial Sequence: Synthetic coding sequence
accctgttcgaccagaacaacgccgccaagaaggaggagagcgagaccgccaacaagaacgacagcagcaagaagctgagcgtggagagagtgtaccagaagaagacccagctggagcacatcctgctgagacccgacacctacatcggcagcgtggagcccctgacccagtag

SEQ ID NO: 13237 - DNA, 1437 bp, Artificial Sequence
  Description of Artificial Sequence: Synthetic coding sequence
atgagcctgtggagcctgaccaaggagaaggtggaggagctgatcaagcagagagacgccaagggcagagaggtgaacgacctgaagagaaagagccccagcgacctgtggaaggaggacctggccgccttcgtggaggagctggacaaggtggagagccaggagagagaggacgtgctggccggcatgagcggcaaggccatcaagggcaaggtgggcaagcccaaggtgaagaagctgcagctggaggagaccatgcccagcccctacggcagaagaatcatccccgagatcaccgccatgaaggccgacgccagcaagaagctgctgaagaagaagaagggcgacctggacaccgccgccgtgaaggtggagttcgacgaggagttcagcggcgcccccgtggagggcgccggcgaggaggccctgacccccagcgtgcccatcaacaagggccccaagcccaagagagagaagaaggagcccggcaccagagtgagaaagacccccaccagcagcggcaagcccagcgccaagaaggtgaagaagagaaacccctggagcgacgacgagagcaagagcgagagcgacctggaggagaccgagcccgtggtgatccccagagacagcctgctgagaagagccgccgccgagagacccaagtacaccttcgacttcagcgaggaggaggacgacgacgccgacgacgacgacgacgacaacaacgacctggaggagctgaaggtgaaggccagccccatcaccaacgacggcgaggacgagttcgtgcccagcgacggcctggacaaggacgagtacaccttcagccccggcaagagcaaggccacccccgagaagagcctgcacgacaagaagagccaggacttcggcaacctgttcagcttccccagctacagccagaagagcgaggacgacagcgccaagttcgacagcaacgaggaggacagcgccagcgtgttcagccccagcttcggcctgaagcagaccgacaaggtgcccagcaagaccgtggccgccaagaagggcaagcccagcagcgacaccgtgcccaagcccaagagagcccccaagcagaagaaggtggtggaggccgtgaacagcgacagcgacagcgagttcggcatccccaagaagaccaccacccccaagggcaagggcagaggcgccaagaagagaaaggccagcggcagcgagaacgagggcgactacaaccccggcagaaagaccagcaagaccaccagcaagaagcccaagaagaccagcttcgaccaggacagcgacgtggacatcttccccagcgacttccccaccgagccccccagcctgcccagaaccggcagagccagaaaggaggtgaagtacttcgccgagagcgacgaggaggaggacgacgtggacttcgccatgttcaactag

SEQ ID NO: 13238 - DNA, 1437 bp, Artificial Sequence; identical to SEQ ID NO: 13237
  Description of Artificial Sequence: Synthetic coding sequence

SEQ ID NO: 13239 - DNA, 3006 bp, Artificial Sequence
  Description of Artificial Sequence: Synthetic coding sequence
atgatcttccccgtggccagatacgccctgagatggctgagaagacccgaggacagagccttcagcagagccgccatggagatggccctgagaggcgtgagaaaggtgctgtgcgtggccgagaagaacgacgccgccaagggcatcgccgacctgctgagcaacggcagaatgagaagaagagagggcctgagcaagttcaacaagatctacgagttcgactaccacctgtacggccagaacgtgaccatggtgatgaccagcgtgagcggccacctgctggcccacgacttccagatgcagttcagaaagtggcagagctgcaaccccctggtgctgttcgaggccgagatcgagaagtactgccccgagaacttcgtggacatcaagaagaccctggagagagagaccagacagtgccaggccctggtgatctggaccgactgcgacagagagggcgagaacatcggcttcgagatcatccacgtgtgcaaggccgtgaagcccaacctgcaggtgctgagagccagattcagcgagatcaccccccacgccgtgagaaccgcctgcgagaacctgaccgagcccgaccagagagtgagcgacgccgtggacgtgagacaggagctggacctgagaatcggcgccgccttcaccagattccagaccctgagactgcagagaatcttccccgaggtgctggccgagcagctgatcagctacggcagctgccagttccccaccctgggcttcgtggtggagagattcaaggccatccaggccttcgtgcccgagatcttccacagaatcaaggtgacccacgaccacaaggacggcatcgtggagttcaactggaagagacacagactgttcaaccacaccgcctgcctggtgctgtaccagctgtgcgtggaggaccccatggccaccgtggtggaggtgagaagcaagcccaagagcaagtggagaccccaggccctggacaccgtggagctggagaagctggccagcagaaagctgagaatcaacgccaaggagaccatgagaatcgccgagaagctgtacacccagggctacatcagctaccccagaaccgagaccaacatcttccccagagacctgaacctgaccgtgctggtggagcagcagacccccgaccccagatggggcgccttcgcccagagcatcctggagagaggcggccccacccccagaaacggcaacaagagcgaccaggcccacccccccatccaccccaccaagtacaccaacaacctgcagggcgacgagcagagactgtacgagttcatcgtgagacacttcctggcctgctgcagccaggacgcccagggccaggagaccaccgtggagatcgacatcgcccaggagagattcgtggcccacggcctgatgatcctggccagaaactacctggacgtgtacccctacgaccactggagcgacaagatcctgcccgtgtacgagcagggcagccacttccagcccagcaccgtggagatggtggacggcgagaccagcccccccaagctgctgaccgaggccgacctgatcgccctgatggagaagcacggcatcggcaccgacgccacccacgccgagcacatcgagaccatcaaggccagaatgtacgtgggcctgacccccgacaagagattcctgcccggccacctgggcatgggcctggtggagggctacgacagcatgggctacgagatgagcaagcccgacctgagagccgagctggaggccgacctgaagctgatctgcgacggcaagaaggacaagttcgtggtgctgagacagcaggtgcagaagtacaagcaggtgttcatcgaggccgtggccaaggccaagaagctggacgaggccctggcccagtacttcggcaacggcaccgagctggcccagcaggaggacatctaccccgccatgcccgagcccatcagaaagtgcccccagtgcaacaaggacatggtgctgaagaccaagaagaacggcggcttctacctgagctgcatgggcttccccgagtgcagaagcgccgtgtggctgcccgacagcgtgctggaggccagcagagacagcagcgtgtgccccgtgtgccagccccaccccgtgtacagactgaagctgaagttcaagagaggcagcctgccccccaccatgcccctggagttcgtgtgctgcatcggcggctgcgacgacaccctgagagagatcctggacctgagattcagcggcggcccccccagagccagccagcccagcggcagactgcaggccaaccagagcctgaacagaatggacaacagccagcacccccagcccgccgacagcagacagaccggcagcagcaaggccctggcccagaccctgcccccccccaccgccgccggcgagagcaacagcgtgacctgcaactgcggccaggaggccgtgctgctgaccgtgagaaaggagggccccaacagaggcagacagttcttcaagtgcaacggcggcagctgcaacttcttcctgtgggccgacagccccaaccccggcgccggcggcccccccgccctggcctacagacccctgggcgccagcctgggctgcccccccggccccggcatccacctgggcggcttcggcaaccccggcgacggcagcggcagcggcaccagctgcctgtgcagccagcccagcgtgaccagaaccgtgcagaaggacggccccaacaagggcagacagttccacacctgcgccaagcccagagagcagcagtgcggcttcttccagtgggtggacgagaacaccgcccccggcaccagcggcgcccccagctggaccggcgacagaggcagaaccctggagagcgaggccagaagcaagagacccagagccagcagcagcgacatgggcagcaccgccaagaagcccagaaagtgcagcctgtgccaccagcccggccacaccagacccttctgcccccagaacagatag

SEQ ID NO: 13240 - DNA, 1170 bp, Artificial Sequence
  Description of Artificial Sequence: Synthetic coding sequence
tgaagcagagccgccatggagatggccctgagaggcgtgagaaaggtgctgtgcgtggccgagaagaacgacgccgccaagggcatcgccgacctgctgagcaacggcagaatgagaagaagagagggcctgagcaagttcaacaagatctacgagttcgactaccacctgtacggccagaacgtgaccatggtgatgaccagcgtgagcggccacctgctggcccacgacttccagatgcagttcagaaagtggcagagctgcaaccccctggtgctgttcgaggccgagatcgagaagtactgccccgagaacttcgtggacatcaagaagaccctggagagagagaccagacagtgccaggccctggtgatctggaccgactgcgacagagagggcgagaacatcggcttcgagatcatccacgtgtgcaaggccgtgaagcccaacctgcaggtgctgagagccagattcagcgagatcaccccccacgccgtgagaaccgcctgcgagaacctgaccgagcccgaccagagagtgagcgacgccgtggacgtgagacaggagctggacctgagaatcggcgccgccttcaccagattccagaccctgagactgcagagaatcttccccgaggtgctggccgagcagctgatcagctacggcagctgccagttccccaccctgggcttcgtggtggagagattcaaggccatccaggccttcgtgcccgagatcttccacagaatcaaggtgacccacgaccacaaggacggcatcgtggagttcaactggaagagacacagactgttcaaccacaccgcctgcctggtgctgtaccagctgtgcgtggaggaccccatggccaccgtggtggaggtgagaagcaagcccaagagcaagtggagaccccaggccctggacaccgtggagctggagaagctggccagcagaaagctgagaatcaacgccaaggagaccatgagaatcgccgagaagctgtacacccagggctacatcagctaccccagaaccgagaccaacatcttccccagagacctgaacctgaccgtgctggtggagcagcagacccccgaccccagatggggcgccttcgcccagagcatcctggagagaggcggccccacccccagaaacggcaacaagtag

SEQ ID NO: 13241 - DNA, 1596 bp, Artificial Sequence
  Description of Artificial Sequence: Synthetic coding sequence
atgatcctggccagaaactacctggacgtgtacccctacgaccactggagcgacaagatcctgcccgtgtacgagcagggcagccacttccagcccagcaccgtggagatggtggacggcgagaccagcccccccaagctgctgaccgaggccgacctgatcgccctgatggagaagcacggcatcggcaccgacgccacccacgccgagcacatcgagaccatcaaggccagaatgtacgtgggcctgacccccgacaagagattcctgcccggccacctgggcatgggcctggtggagggctacgacagcatgggctacgagatgagcaagcccgacctgagagccgagctggaggccgacctgaagctgatctgcgacggcaagaaggacaagttcgtggtgctgagacagcaggtgcagaagtacaagcaggtgttcatcgaggccgtggccaaggccaagaagctggacgaggccctggcccagtacttcggcaacggcaccgagctggcccagcaggaggacatctaccccgccatgcccgagcccatcagaaagtgcccccagtgcaacaaggacatggtgctgaagaccaagaagaacggcggcttctacctgagctgcatgggcttccccgagtgcagaagcgccgtgtggctgcccgacagcgtgctggaggccagcagagacagcagcgtgtgccccgtgtgccagccccaccccgtgtacagactgaagctgaagttcaagagaggcagcctgccccccaccatgcccctggagttcgtgtgctgcatcggcggctgcgacgacaccctgagagagatcctggacctgagattcagcggcggcccccccagagccagccagcccagcggcagactgcaggccaaccagagcctgaacagaatggacaacagccagcacccccagcccgccgacagcagacagaccggcagcagcaaggccctggcccagaccctgcccccccccaccgccgccggcgagagcaacagcgtgacctgcaactgcggccaggaggccgtgctgctgaccgtgagaaaggagggccccaacagaggcagacagttcttcaagtgcaacggcggcagctgcaacttcttcctgtgggccgacagccccaaccccggcgccggcggcccccccgccctggcctacagacccctgggcgccagcctgggctgcccccccggccccggcatccacctgggcggcttcggcaaccccggcgacggcagcggcagcggcaccagctgcctgtgcagccagcccagcgtgaccagaaccgtgcagaaggacggccccaacaagggcagacagttccacacctgcgccaagcccagagagcagcagtgcggcttcttccagtgggtggacgagaacaccgcccccggcaccagcggcgcccccagctggaccggcgacagaggcagaaccctggagagcgaggccagaagcaagagacccagagccagcagcagcgacatgggcagcaccgccaagaagcccagaaagtgcagcctgtgccaccagcccggccacaccagacccttctgcccccagaacagatag

SEQ ID NO: 13242 - DNA, 2721 bp, Artificial Sequence
  Description of Artificial Sequence: Synthetic coding sequence
atgaacctgatcatcatctgcatggccagacagagctgcaaccccctggtgctgttcgaggccgagatcgagaagtactgccccgagaacttcgtggacatcaagaagaccctggagagagagaccagacagtgccaggccctggtgatctggaccgactgcgacagagagggcgagaacatcggcttcgagatcatccacgtgtgcaaggccgtgaagcccaacctgcaggtgctgagagccagattcagcgagatcaccccccacgccgtgagaaccgcctgcgagaacctgaccgagcccgaccagagagtgagcgacgccgtggacgtgagacaggagctggacctgagaatcggcgccgccttcaccagattccagaccctgagactgcagagaatcttccccgaggtgctggccgagcagctgatcagctacggcagctgccagttccccaccctgggcttcgtggtggagagattcaaggccatccaggccttcgtgcccgagatcttccacagaatcaaggtgacccacgaccacaaggacggcatcgtggagttcaactggaagagacacagactgttcaaccacaccgcctgcctggtgctgtaccagctgtgcgtggaggaccccatggccaccgtggtggaggtgagaagcaagcccaagagcaagtggagaccccaggccctggacaccgtggagctggagaagctggccagcagaaagctgagaatcaacgccaaggagaccatgagaatcgccgagaagctgtacacccagggctacatcagctaccccagaaccgagaccaacatcttccccagagacctgaacctgaccgtgctggtggagcagcagacccccgaccccagatggggcgccttcgcccagagcatcctggagagaggcggccccacccccagaaacggcaacaagagcgaccaggcccacccccccatccaccccaccaagtacaccaacaacctgcagggcgacgagcagagactgtacgagttcatcgtgagacacttcctggcctgctgcagccaggacgcccagggccaggagaccaccgtggagatcgacatcgcccaggagagattcgtggcccacggcctgatgatcctggccagaaactacctggacgtgtacccctacgaccactggagcgacaagatcctgcccgtgtacgagcagggcagccacttccagcccagcaccgtggagatggtggacggcgagaccagcccccccaagctgctgaccgaggccgacctgatcgccctgatggagaagcacggcatcggcaccgacgccacccacgccgagcacatcgagaccatcaaggccagaatgtacgtgggcctgacccccgacaagagattcctgcccggccacctgggcatgggcctggtggagggctacgacagcatgggctacgagatgagcaagcccgacctgagagccgagctggaggccgacctgaagctgatctgcgacggcaagaaggacaagttcgtggtgctgagacagcaggtgcagaagtacaagcaggtgttcatcgaggccgtggccaaggccaagaagctggacgaggccctggcccagtacttcggcaacggcaccgagctggcccagcaggaggacatctaccccgccatgcccgagcccatcagaaagtgcccccagtgcaacaaggacatggtgctgaagaccaagaagaacggcggcttctacctgagctgcatgggcttccccgagtgcagaagcgccgtgtggctgcccgacagcgtgctggaggccagcagagacagcagcgtgtgccccgtgtgccagccccaccccgtgtacagactgaagctgaagttcaagagaggcagcctgccccccaccatgcccctggagttcgtgtgctgcatcggcggctgcgacgacaccctgagagagatcctggacctgagattcagcggcggcccccccagagccagccagcccagcggcagactgcaggccaaccagagcctgaacagaatggacaacagccagcacccccagcccgccgacagcagacagaccggcagcagcaaggccctggcccagaccctgcccccccccaccgccgccggcgagagcaacagcgtgacctgcaactgcggccaggaggccgtgctgctgaccgtgagaaaggagggccccaacagaggcagacagttcttcaagtgcaacggcggcagctgcaacttcttcctgtgggccgacagccccaaccccggcgccggcggcccccccgccctggcctacagacccctgggcgccagcctgggctgcccccccggccccggcatccacctgggcggcttcggcaaccccggcgacggcagcggcagcggcaccagctgcctgtgcagccagcccagcgtgaccagaaccgtgcagaaggacggccccaacaagggcagacagttccacacctgcgccaagcccagagagcagcagtgcggcttcttccagtgggtggacgagaacaccgcccccggcaccagcggcgcccccagctggaccggcgacagaggcagaaccctggagagcgaggccagaagcaagagacccagagccagcagcagcgacatgggcagcaccgccaagaagcccagaaagtgcagcctgtgccaccagcccggccacaccagacccttctgcccccagaacagatag

SEQ ID NO: 13243 - DNA, 2589 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacaccggcaccttcgccggccagcccgtgagattcaagatgaccagcgtgtgcggccacgtgatgaccctggacttcctgggcaagtacaacaagtgggacaaggtggaccccgccgagctgttcagccaggcccccaccgagaagaaggaggccaaccccaagctgaacatggtgaagttcctgcaggtggagggcagaggctgcgactacatcgtgctgtggctggactgcgacaaggagggcgagaacatctgcttcgaggtgctggacgccgtgctgcccgtgatgaacaaggcccacggcggcgagaagaccgtgttcagagccagattcagcagcatcaccgacaccgacatctgcaacgccatggcctgcctgggcgagcccgaccacaacgaggccctgagcgtggacgccagacaggagctggacctgagaatcggctgcgccttcaccagattccagaccaagtacttccagggcaagtacggcgacctggacagcagcctgatcagcttcggcccctgccagacccccaccctgggcttctgcgtggagagacacgacaagatccagagcttcaagcccgagacctactgggtgctgcaggccaaggtgaacaccgacaaggacagaagcctgctgctggactgggacagagtgagagtgttcgacagagagatcgcccagatgttcctgaacatgaccaagctggagaaggaggcccaggtggaggccaccagcagaaaggagaaggccaagcagagacccctggccctgaacaccgtggagatgctgagagtggccagcagcagcctgggcatgggcccccagcacgccatgcagaccgccgagagactgtacacccagggctacatcagctaccccagaaccgagaccacccactaccccgagaacttcgacctgaagggcagcctgagacagcaggccaaccacccctactgggccgacaccgtgaagagactgctggccgagggcatcaacagacccagaaagggccacgacgccggcgaccacccccccatcacccccatgaagagcgccaccgaggccgagctgggcggcgacgcctggagactgtacgagtacatcaccagacacttcatcgccaccgtgagccacgactgcaagtacctgcagagcaccatcagcttcagaatcggccccgagctgttcacctgcagcggcaagaccgtgctgagccccggcttcaccgaggtgatgccctggcagagcgtgcccctggaggagagcctgcccacctgccagagaggcgacgccttccccgtgggcgaggtgaagatgctggagaagcagaccaacccccccgactacctgaccgaggccgagctgatcaccctgatggagaagcacggcatcggcaccgacgccagcatccccgtgcacatcaacaacatctgccagagaaactacgtgaccgtggagagcggcagaagactgaagcccaccaacctgggcatcgtgctggtgcacggctactacaagatcgacgccgagctggtgctgcccaccatcagaagcgccgtggagaagcagctgaacctgatcgcccagggcaaggccgactacagacaggtgctgggccacaccctggacgtgttcaagagaaagttccactacttcgtggacagcatcgccggcatggacgagctgatggaggtgagcttcagccccctggccgccaccggcaagcccctgagcagatgcggcaagtgccacagattcatgaagtacatccaggccaagcccagcagactgcactgcagccactgcgacgagacctacaccctgccccagaacggcaccatcaagctgtacaaggagctgagatgccccctggacgacttcgagctggtgctgtggagcagcggcagcagaggcaagagctaccccctgtgcccctactgctacaaccacccccccttcagagacatgaagaagggcatgggctgcaacgagtgcacccaccccagctgccagcacagcctgagcatgctgggcatcggccagtgcgtggagtgcgagagcggcgtgctggtgctggaccccaccagcggccccaagtggaaggtggcctgcaacaagtgcaacgtggtggcccactgcttcgagaacgcccacagagtgagagtgagcgccgacacctgcagcgtgtgcgaggccgccctgctggacgtggacttcaacaaggccaagagccccctgcccggcgacgagacccagcacatgggctgcgtgttctgcgaccccgtgttccaggagctggtggagctgaagcacgccgccagctgccaccccatgcacagaggcggccccggcagaagacagggcagaggcagaggcagagccagaagaccccccggcaagcccaaccccagaagacccaaggacaagatgagcgccctggccgcctacttcgtgtag

SEQ ID NO: 13244 - DNA, 2589 bp, Artificial Sequence; identical to SEQ ID NO: 13243
  Description of Artificial Sequence: Synthetic coding sequence

SEQ ID NO: 13245 - DNA, 849 bp, Artificial Sequence
  Description of Artificial Sequence: Synthetic coding sequence
atgttcctgaacatgaccaagctggagaaggaggcccaggtggaggccaccagcagaaaggagaaggccaagcagagacccctggccctgaacaccgtggagatgctgagagtggccagcagcagcctgggcatgggcccccagcacgccatgcagaccgccgagagactgtacacccagggctacatcagctaccccagaaccgagaccacccactaccccgagaacttcgacctgaagggcagcctgagacagcaggccaaccacccctactgggccgacaccgtgaagagactgctggccgagggcatcaacagacccagaaagggccacgacgccggcgaccacccccccatcacccccatgaagagcgccaccgaggccgagctgggcggcgacgcctggagactgtacgagtacatcaccagacacttcatcgccaccgtgagccacgactgcaagtacctgcagagcaccatcagcttcagaatcggccccgagctgttcacctgcagcggcaagaccgtgctgagccccggcttcaccgaggtgatgccctggcagagcgtgcccctggaggagagcctgcccacctgccagagaggcgacgccttccccgtgggcgaggtgaagatgctggagaagcagaccaacccccccgactacctgaccgaggccgagctgatcaccctgatggagaagcacggcatcggcggctgcgcctgccccggccccagagccggcagcgtgagcagcacccaggccagcagcctgctgaccaagctgcccagacagccctgcgtgcccagccccgcccccctgcacggcctggtgagcggcaactggtag

SEQ ID NO: 13246 - DNA, 741 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacaccggcaccttcgccggccagcccgtgagattcaagatgaccagcgtgtgcggccacgtgatgaccctggacttcctgggcaagtacaacaagtgggacaaggtggaccccgccgagctgttcagccaggcccccaccgagaagaaggaggccaaccccaagctgaacatggtgaagttcctgcaggtggagggcagaggctgcgactacatcgtgctgtggctggactgcgacaaggagggcgagaacatctgcttcgaggtgctggacgccgtgctgcccgtgatgaacaaggcccacggcggcgagaagaccgtgttcagagccagattcagcagcatcaccgacaccgacatctgcaacgccatggcctgcctgggcgagcccgaccacaacgaggccctgagcgtggacgccagacaggagctggacctgagaatcggctgcgccttcaccagattccagaccaagtacttccagggcaagtacggcgacctggacagcagcctgatcagcttcggcccctgccagacccccaccctgggcttctgcgtggagagacacgacaagatccagagcttcaagcccgagacctactgggtgctgcaggccaagtag

SEQ ID NO: 13247 - DNA, 366 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacaccggcaccttcgccggccagcccgtgagattcaagatgaccagcgtgtgcggccacgtgatgaccctggacttcctgggcaagtacaacaagtgggacaaggtggaccccgccgagctgttcagccaggcccccaccgagaagaaggaggccaaccccaagctgaacatggtgaagttcctgcaggtggagggcagaggctgcgactacatcgtgctgtggctggactgcgacaaggagtag

SEQ ID NO: 13248 - DNA, 66 bp, Artificial Sequence
  Description of Artificial Sequence: Synthetic coding sequence
atgaagaccgtgctgatggtggccgagaagcccagcctggcccagagcatcgccaagatcctgtag

SEQ ID NO: 13249 - DNA, 129 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacacctag

SEQ ID NO: 13250 - DNA, 369 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacaccggcaccttcgccggccagcccgtgagattcaagatgaccagcgtgtgcggccacgtgatgaccctggacttcctgggcaagtacaacaagtgggacaaggtggaccccgccgagctgttcagccaggcccccaccgagaagaaggaggccaaccccaagctgaacatggtgaagttcctgcaggtggagggcagaggctgcgactacatcgtgctgtggctggactgcgacaaggagggctag

SEQ ID NO: 13251 - DNA, 144 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacaccggcaccttcgccggctag

SEQ ID NO: 13252 - DNA, 399 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacaccggcaccttcgccggccagcccgtgagattcaagatgaccagcgtgtgcggccacgtgatgaccctggacttcctgggcaagtacaacaagtgggacaaggtggaccccgccgagctgttcagccaggcccccaccgagaagaaggaggccaaccccaagctgccccaggccagcgtgtgcacccaggccgcccccggcgtgagaccccacccctgcccccccgccgccgccagagtggccgacagagtggtgccctgcggccccgtgacctag

SEQ ID NO: 13253 - DNA, 183 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacaccggcaccttcgccggccagcccgtgagattcaagatgaccagcgtgtgcggccactag

SEQ ID NO: 13254 - DNA, 186 bp, Artificial Sequence
  Description of Artificial Sequence: Synthetic coding sequence
atgaagaccgtgctgatggtggccgagaagcccagcctggcccagagcatcgccaagatcctgagcagaggcagcctgagcagccacaagggcctgaacggcgcctgcagcgtgcacgagtacaccggcaccttcgccggccagcccgtgagattcaagatgaccagcgtgtgcggccacgtgtag

SEQ ID NO: 13255 - DNA, 1578 bp, Artificial Sequence
  Description of Artificial Sequence: Synthetic coding sequence
tgactggacagcagcctgatcagcttcggcccctgccagacccccaccctgggcttctgcgtggagagacacgacaagatccagagcttcaagcccgagacctactgggtgctgcaggccaaggtgaacaccgacaaggacagaagcctgctgctggactgggacagagtgagagtgttcgacagagagatcgcccagatgttcctgaacatgaccaagctggagaaggaggcccaggtggaggccaccagcagaaaggagaaggccaagcagagacccctggccctgaacaccgtggagatgctgagagtggccagcagcagcctgggcatgggcccccagcacgccatgcagaccgccgagagactgtacacccagggctacatcagctaccccagaaccgagaccacccactaccccgagaacttcgacctgaagggcagcctgagacagcaggccaaccacccctactgggccgacaccgtgaagagactgctggccgagggcatcaacagacccagaaagggccacgacgccggcgaccacccccccatcacccccatgaagagcgccaccgaggccgagctgggcggcgacgcctggagactgtacgagtacatcaccagacacttcatcgccaccgtgagccacgactgcaagtacctgcagagcaccatcagcttcagaatcggccccgagctgttcacctgcagcggcaagaccgtgctgagccccggcttcaccgaggtgatgccctggcagagcgtgcccctggaggagagcctgcccacctgccagagaggcgacgccttccccgtgggcgaggtgaagatgctggagaagcagaccaacccccccgactacctgaccgaggccgagctgatcaccctgatggagaagcacggcatcggcaccgacgccagcatccccgtgcacatcaacaacatctgccagagaaactacgtgaccgtggagagcggcagaagactgaagcccaccaacctgggcatcgtgctggtgcacggctactacaagatcgacgccgagctggtgctgcccaccatcagaagcgccgtggagaagcagctgaacctgatcgcccagggcaaggccgactacagacaggtgctgggccacaccctggacgtgttcaagagaaagttccactacttcgtggacagcatcgccggcatggacgagctgatggaggtgagcttcagccccctggccgccaccggcaagcccctgagcagatgcggcaagtgccacagattcatgaagtacatccaggccaagcccagcagactgcactgcagccactgcgacgagacctacaccctgccccagaacggcaccatcaagctgtacaaggagctgagatgccccctggacgacttcgagctggtgctgtggagcagcggcagcagaggcaagagctaccccctgtgcccctactgctacaaccacccccccttcagagacatgaagaagggcgagtgcagccacagcctgctgagcaccggcagctgcagcctgttcagcgtgcccacccccgccctgcaccaggccggcctgtag

SEQ ID NO: 13256 - DNA, 951 bp, Artificial Sequence
  Description of Artificial Sequence: Synthetic coding sequence
atgagcgccgaggtggagaccagcgagggcgtggacgagagcgagaagaagaacagcggcgccctggagaaggagaaccagatgagaatggccgacctgagcgagctgctgaaggagggcaccaaggaggcccacgacagagccgagaacacccagttcgtgaaggacttcctgaagggcaacatcaagaaggagctgttcaagctggccaccaccgccctgtacttcacctacagcgccctggaggaggagatggagagaaacaaggaccaccccgccttcgcccccctgtacttccccatggagctgcacagaaaggaggccctgaccaaggacatggagtacttcttcggcgagaactgggaggagcaggtgcagtgccccaaggccgcccagaagtacgtggagagaatccactacatcggccagaacgagcccgagctgctggtggcccacgcctacaccagatacatgggcgacctgagcggcggccaggtgctgaagaaggtggcccagagagccctgaagctgcccagcaccggcgagggcacccagttctacctgttcgagaacgtggacaacgcccagcagttcaagcagctgtacagagccagaatgaacgccctggacctgaacatgaagaccaaggagagaatcgtggaggaggccaacaaggccttcgagtacaacatgcagatcttcaacgagctggaccaggccggcagcaccctggccagagagaccctggaggacggcttccccgtgcacgacggcaagggcgacatgagaaagtgccccttctacgccgccgagcaggacaagggcgccctggagggcagcagctgccccttcagaaccgccatggccgtgctgagaaagcccagcctgcagttcatcctggccgccggcgtggccctggccgccggcctgctggcctggtactacatgtag

SEQ ID NO: 13257 - DNA, 1716 bp, Artificial Sequence
  Description of Artificial Sequence: Synthetic coding sequence
atgaagtgccagcccagaagcggcgccagaagaatcgaggagagactgcactacctgatcaccacctacctgaagttcggcaacaacaacaactacatgaacatggccgaggccaacaacgccttcttcgccgccagcgagaccttccacacccccagcctgggcgacgaggagttcgagatcccccccatcacccccccccccgagagcgaccccgccctgggcatgcccgacgtgctgctgcccttccaggccctgagcgaccccctgcccagccagggcagcgagttcaccccccagttccccccccagagcctggacctgcccagcatcaccatcagcagaaacctggtggagcaggacggcgtgctgcacagcagcggcctgcacatggaccagagccacacccaggtgagccagtacagacaggaccccagcctgatcatgagaagcatcgtgcacatgaccgacgccgccagaagcggcgtgatgccccccgcccagctgaccaccatcaaccagagccagctgagcgcccagctgggcctgaacctgggcggcgccagcatgccccacaccagccccagcccccccgccagcaagagcgccacccccagccccagcagcagcatcaacgaggaggacgccgacgaggccaacagagccatcggcgagaagagagccgcccccgacagcggcaagaagcccaagacccccaagaagaagaagaagaaggaccccaacgagccccagaagcccgtgagcgcctacgccctgttcttcagagacacccaggccgccatcaagggccagaaccccaacgccaccttcggcgaggtgagcaagatcgtggccagcatgtgggacagcctgggcgaggagcagaagcaggtgtacaagagaaagaccgaggccgccaagaaggagtacctgaaggccctggccgcctacagagccagcctggtgagcaaggccgccgccgagagcgccgaggcccagaccatcagaagcgtgcagcagaccctggccagcaccaacctgaccagcagcctgctgctgaacacccccctgagccagcacggcaccgtgagcgccagcccccagaccctgcagcagagcctgcccagaagcatcgcccccaagcccctgaccatgagactgcccatgaaccagatcgtgaccagcgtgaccatcgccgccaacatgcccagcaacatcggcgcccccctgatcagcagcatgggcaccaccatggtgggcagcgcccccagcacccaggtgagccccagcgtgcagacccagcagcaccagatgcagctgcagcagcagcagcagcagcagcagcagcagatgcagcagatgcagcagcagcagctgcagcagcaccagatgcaccagcagatccagcagcagatgcagcagcagcacttccagcaccacatgcagcagcacctgcagcagcagcagcagcacctgcagcagcagatcaaccagcagcagctgcagcagcagctgcagcagagactgcagctgcagcagctgcagcacatgcagcaccagagccagcccagccccagacagcacagccccgtggccagccagatcaccagccccatccccgccatcggcagcccccagcccgccagccagcagcaccagagccagatccagagccagacccagacccaggtgctgagccaggtgagcatcttctag

SEQ ID NO: 13258 - DNA, 5817 bp, Artificial Sequence
  Description of Artificial Sequence: Synthetic coding sequence
atgcagagcttcagagagcagagcagctaccacggcaaccagcagagctacccccaggaggtgcacggcagcagcagactggaggagttcagccccagacaggcccagatgttccagaacttcggcggcaccggcggcagcagcggcagcagcggcagcggcagcggcggcggcagaagaggcgccgccgccgccgccgccgccatggccagcgagaccagcggccaccagggctaccagggcttcagaaaggaggccggcgacttctactacatggccggcaacaaggaccccgtgaccaccggcaccccccagcccccccagagaagacccagcggccccgtgcagagctacggccccccccagggcagcagcttcggcaaccagtacggcagcgagggccacgtgggccagttccaggcccagcacagcggcctgggcggcgtgagccactaccagcaggactacaccggccccttcagccccggcagcgcccagtaccagcagcaggccagcagccagcagcagcagcagcaggtgcagcagctgagacagcagctgtaccagagccaccagcccctgccccaggccaccggccagcccgccagcagcagcagccacctgcagcccatgcagagacccagcaccctgcccagcagcgccgccggctaccagctgagagtgggccagttcggccagcactaccagagcagcgccagcagcagcagcagcagcagcttccccagcccccagagattcagccagagcggccagagctacgacggcagctacaacgtgaacgccggcagccagtacgagggccacaacgtgggcagcaacgcccaggcctacggcacccagagcaactacagctaccagccccagagcatgaagaacttcgagcaggccaagatcccccagggcacccagcagggccagcagcagcagcagccccagcagcagcagcaccccagccagcacgtgatgcagtacaccaacgccgccaccaagctgcccctgcagagccaggtgggccagtacaaccagcccgaggtgcccgtgagaagccccatgcagttccaccagaacttcagccccatcagcaaccccagccccgccgccagcgtggtgcagagccccagctgcagcagcacccccagccccctgatgcagaccggcgagaacctgcagtgcggccagggcagcgtgcccatgggcagcagaaacagaatcctgcagctgatgccccagctgagccccacccccagcatgatgcccagccccaacagccacgccgccggcttcaagggcttcggcctggagggcgtgcccgagaagagactgaccgaccccggcctgagcagcctgagcgccctgagcacccaggtggccaacctgcccaacaccgtgcagcacatgctgctgagcgacgccctgaccccccagaagaagaccagcaagagacccagcagcagcaagaaggccgacagctgcaccaacagcgagggcagcagccagcccgaggagcagctgaagagccccatggccgagagcctggacggcggctgcagcagcagcagcgaggaccagggcgagagagtgagacagctgagcggccagagcaccagcagcgacaccacctacaagggcggcgccagcgagaaggccggcagcagccccgcccagggcgcccagaacgagccccccagactgaacgccagccccgccgccagagaggaggccaccagccccggcgccaaggacatgcccctgagcagcgacggcaaccccaaggtgaacgagaagaccgtgggcgtgatcgtgagcagagaggccatgaccggcagagtggagaagcccggcggccaggacaagggcagccaggaggacgaccccgccgccacccagagaccccccagcaacggcggcgccaaggagaccagccacgccagcctgccccagcccgagccccccggcggcggcggcagcaagggcaacaagaacggcgacaacaacagcaaccacaacggcgagggcaacggccagagcggccacagcgccgccggccccggcttcaccagcagaaccgagcccagcaagagccccggcagcctgagatacagctacaaggacagcttcggcagcgccgtgcccagaaacgtgagcggcttcccccagtaccccaccggccaggagaagggcgacttcaccggccacggcgagagaaagggcagaaacgagaagttccccagcctgctgcaggaggtgctgcagggctaccaccaccaccccgacagaagatacagcagaagcacccaggagcaccagggcatggccggcagcctggagggcaccaccagacccaacgtgctggtgagccagaccaacgagctggccagcagaggcctgctgaacaagagcatcggcagcctgctggagaacccccactggggcccctgggagagaaagagcagcagcaccgcccccgagatgaagcagatcaacctgaccgactaccccatccccagaaagttcgagatcgagccccagagcagcgcccacgagcccggcggcagcctgagcgagagaagaagcgtgatctgcgacatcagccccctgagacagatcgtgagagaccccggcgcccacagcctgggccacatgagcgccgacaccagaatcggcagaaacgacagactgaaccccaccctgagccagagcgtgatcctgcccggcggcctggtgagcatggagaccaagctgaagagccagagcggccagatcaaggaggaggacttcgagcagagcaagagccaggccagcttcaacaacaagaagagcggcgaccactgccacccccccagcatcaagcacgagagctacagaggcaacgccagccccggcgccgccacccacgacagcctgagcgactacggcccccaggacagcagacccacccccatgagaagagtgcccggcagagtgggcggcagagagggcatgagaggcagaagccccagccagtaccacgacttcgccgagaagctgaagatgagccccggcagaagcagaggccccggcggcgacccccaccacatgaacccccacatgaccttcagcgagagagccaacagaagcagcctgcacacccccttcagccccaacagcgagaccctggccagcgcctaccacgccaacaccagagcccacgcctacggcgaccccaacgccggcctgaacagccagctgcactacaagagacagatgtaccagcagcagcccgaggagtacaaggactggagcagcggcagcgcccagggcgtgatcgccgccgcccagcacagacaggagggccccagaaagagccccagacagcagcagttcctggacagagtgagaagccccctgaagaacgacaaggacggcatgatgtacggcccccccgtgggcacctaccacgaccccagcgcccaggaggccggcagatgcctgatgagcagcgacggcctgcccaacaagggcatggagctgaagcacggcagccagaagctgcaggagagctgctgggacctgagcagacagaccagccccgccaagagcagcggcccccccggcatgagcagccagaagagatacggccccccccacgagaccgacggccacggcctggccgaggccacccagagcagcaagcccggcagcgtgatgctgagactgcccggccaggaggaccacagcagccagaaccccctgatcatgagaagaagagtgagaagcttcatcagccccatccccagcaagagacagagccaggacgtgaagaacagcagcaccgaggacaagggcagactgctgcacagcagcaaggagggcgccgacaaggccttcaacagctacgcccacctgagccacagccaggacatcaagagcatccccaagagagacagcagcaaggacctgcccagccccgacagcagaaactgccccgccgtgaccctgaccagccccgccaagaccaagatcctgccccccagaaagggcagaggcctgaagctggaggccatcgtgcagaagatcaccagccccaacatcagaagaagcgccagcagcaacagcgccgaggccggcggcgacaccgtgaccctggacgacatcctgagcctgaagagcggcccccccgagggcggcagcgtggccgtgcaggacgccgacatcgagaagagaaagggcgaggtggccagcgacctggtgagccccgccaaccaggagctgcacgtggagaagcccctgcccagaagcagcgaggagtggagaggcagcgtggacgacaaggtgaagaccgagacccacgccgagaccgtgaccgccggcaaggagccccccggcgccatgaccagcaccaccagccagaagcccggcagcaaccagggcagacccgacggcagcctgggcggcaccgcccccctgatcttccccgacagcaagaacgtgccccccgtgggcatcctggcccccgaggccaaccccaaggccgaggagaaggagaacgacaccgtgaccatcagccccaagcaggagggcttcccccccaagggctacttccccagcggcaagaagaagggcagacccatcggcagcgtgaacaagcagaagaagcagcagcagcccccccccccccccccccagcccccccagatccccgagggcagcgccgacggcgagcccaagcccaagaagcagagacagagaagagagagaagaaagcccggcgcccagcccagaaagagaaagaccaagcaggccgtgcccatcgtggagccccaggagcccgagatcaagctgaagtacgccacccagcccctggacaagaccgacgccaagaacaagagcttctacccctacatccacgtggtgaacaagtgcgagctgggcgccgtgtgcaccatcatcaacgccgaggaggaggagcagaccaagctggtgagaggcagaaagggccagagaagcctgacccccccccccagcagcaccgagagcaaggccctgcccgccagcagcttcatgctgcagggccccgtggtgaccgagagcagcgtgatgggccacctggtgtgctgcctgtgcggcaagtgggccagctacagaaacatgggcgacctgttcggccccttctacccccaggactacgccgccaccctgcccaagaaccccccccccaagagagccaccgagatgcagagcaaggtgaaggtgagacacaagagcgccagcaacggcagcaagaccgacaccgaggaggaggaggagcagcagcagcagcagaaggagcagagaagcctggccgcccaccccagattcaagagaagacacagaagcgaggactgcggcggcggccccagaagcctgagcagaggcctgccctgcaagaaggccgccaccgagggcagcagcgagaagaccgtgctggacagcaagcccagcgtgcccaccaccagcgagggcggccccgagctggagctgcagatccccgagctgcccctggacagcaacgagttctgggtgcacgagggctgcatcctgtgggccaacggcatctacctggtgtgcggcagactgtacggcctgcaggaggccctggagatcgccagagagatgaagtgcagccactgccaggaggccggcgccaccctgggctgctacaacaagggctgcagcttcagataccactacccctgcgccatcgacgccgactgcctgctgcacgaggagaacttcagcgtgagatgccccaagcacaaggtgagactgtggagatag

SEQ ID NO: 13259 - DNA, 5883 bp, Artificial Sequence
  Description of Artificial Sequence: Synthetic coding sequence
atgcagagcttcagagagcagagcagctaccacggcaaccagcagagctacccccaggaggtgcacggcagcagcagactggaggagttcagccccagacaggcccagatgttccagaacttcggcggcaccggcggcagcagcggcagcagcggcagcggcagcggcggcggcagaagaggcgccgccgccgccgccgccgccatggccagcgagaccagcggccaccagggctaccagggcttcagaaaggaggccggcgacttctactacatggccggcaacaaggaccccgtgaccaccggcaccccccagcccccccagagaagacccagcggccccgtgcagagctacggccccccccagggcagcagcttcggcaaccagtacggcagcgagggccacgtgggccagttccaggcccagcacagcggcctgggcggcgtgagccactaccagcaggactacaccggccccttcagccccggcagcgcccagtaccagcagcaggccagcagccagcagcagcagcagcaggtgcagcagctgagacagcagctgtaccagagccaccagcccctgccccaggccaccggccagcccgccagcagcagcagccacctgcagcccatgcagagacccagcaccctgcccagcagcgccgccggctaccagctgagagtgggccagttcggccagcactaccagagcagcgccagcagcagcagcagcagcagcttccccagcccccagagattcagccagagcggccagagctacgacggcagctacaacgtgaacgccggcagccagtacgagggccacaacgtgggcagcaacgcccaggcctacggcacccagagcaactacagctaccagccccagagcatgaagaacttcgagcaggccaagatcccccagggcacccagcagggccagcagcagcagcagccccagcagcagcagcaccccagccagcacgtgatgcagtacaccaacgccgccaccaagctgcccctgcagagccaggtgggccagtacaaccagcccgaggtgcccgtgagaagccccatgcagttccaccagaacttcagccccatcagcaaccccagccccgccgccagcgtggtgcagagccccagctgcagcagcacccccagccccctgatgcagaccggcgagaacctgcagtgcggccagggcagcgtgcccatgggcagcagaaacagaatcctgcagctgatgccccagctgagccccacccccagcatgatgcccagccccaacagccacgccgccggcttcaagggcttcggcctggagggcgtgcccgagaagagactgaccgaccccggcctgagcagcctgagcgccctgagcacccaggtggccaacctgcccaacaccgtgcagcacatgctgctgagcgacgccctgaccccccagaagaagaccagcaagagacccagcagcagcaagaaggccgacagctgcaccaacagcgagggcagcagccagcccgaggagcagctgaagagccccatggccgagagcctggacggcggctgcagcagcagcagcgaggaccagggcgagagagtgagacagctgagcggccagagcaccagcagcgacaccacctacaagggcggcgccagcgagaaggccggcagcagccccgcccagggcgcccagaacgagccccccagactgaacgccagccccgccgccagagaggaggccaccagccccggcgccaaggacatgcccctgagcagcgacggcaaccccaaggtgaacgagaagaccgtgggcgtgatcgtgagcagagaggccatgaccggcagagtggagaagcccggcggccaggacaagggcagccaggaggacgaccccgccgccacccagagaccccccagcaacggcggcgccaaggagaccagccacgccagcctgccccagcccgagccccccggcggcggcggcagcaagggcaacaagaacggcgacaacaacagcaaccacaacggcgagggcaacggccagagcggccacagcgccgccggccccggcttcaccagcagaaccgagcccagcaagagccccggcagcctgagatacagctacaaggacagcttcggcagcgccgtgcccagaaacgtgagcggcttcccccagtaccccaccggccaggagaagggcgacttcaccggccacggcgagagaaagggcagaaacgagaagttccccagcctgctgcaggaggtgctgcagggctaccaccaccaccccgacagaagatacagcagaagcacccaggagcaccagggcatggccggcagcctggagggcaccaccagacccaacgtgctggtgagccagaccaacgagctggccagcagaggcctgctgaacaagagcatcggcagcctgctggagaacccccactggggcccctgggagagaaagagcagcagcaccgcccccgagatgaagcagatcaacctgaccgactaccccatccccagaaagttcgagatcgagccccagagcagcgcccacgagcccggcggcagcctgagcgagagaagaagcgtgatctgcgacatcagccccctgagacagatcgtgagagaccccggcgcccacagcctgggccacatgagcgccgacaccagaatcggcagaaacgacagactgaaccccaccctgagccagagcgtgatcctgcccggcggcctggtgagcatggagaccaagctgaagagccagagcggccagatcaaggaggaggacttcgagcagagcaagagccaggccagcttcaacaacaagaagagcggcgaccactgccacccccccagcatcaagcacgagagctacagaggcaacgccagccccggcgccgccacccacgacagcctgagcgactacggcccccaggacagcagacccacccccatgagaagagtgcccggcagagtgggcggcagagagggcatgagaggcagaagccccagccagtaccacgacttcgccgagaagctgaagatgagccccggcagaagcagaggccccggcggcgacccccaccacatgaacccccacatgaccttcagcgagagagccaacagaagcagcctgcacacccccttcagccccaacagcgagaccctggccagcgcctaccacgccaacaccagagcccacgcctacggcgaccccaacgccggcctgaacagccagctgcactacaagagacagatgtaccagcagcagcccgaggagtacaaggactggagcagcggcagcgcccagggcgtgatcgccgccgcccagcacagacaggagggccccagaaagagccccagacagcagcagttcctggacagagtgagaagccccctgaagaacgacaaggacggcatgatgtacggcccccccgtgggcacctaccacgaccccagcgcccaggaggccggcagatgcctgatgagcagcgacggcctgcccaacaagggcatggagctgaagcacggcagccagaagctgcaggagagctgctgggacctgagcagacagaccagccccgccaagagcagcggcccccccggcatgagcagccagaagagatacggccccccccacgagaccgacggccacggcctggccgaggccacccagagcagcaagcccggcagcgtgatgctgagactgcccggccaggaggaccacagcagccagaaccccctgatcatgagaagaagagtgagaagcttcatcagccccatccccagcaagagacagagccaggacgtgaagaacagcagcaccgaggacaagggcagactgctgcacagcagcaaggagggcgccgacaaggccttcaacagctacgcccacctgagccacagccaggacatcaagagcatccccaagagagacagcagcaaggacctgcccagccccgacagcagaaactgccccgccgtgaccctgaccagccccgccaagaccaagatcctgccccccagaaagggcagaggcctgaagctggaggccatcgtgcagaagatcaccagccccaacatcagaagaagcgccagcagcaacagcgccgaggccggcggcgacaccgtgaccctggacgacatcctgagcctgaagagcggcccccccgagggcggcagcgtggccgtgcaggacgccgacatcgagaagagaaagggcgaggtggccagcgacctggtgagccccgccaaccaggagctgcacgtggagaagcccctgcccagaagcagcgaggagtggagaggcagcgtggacgacaaggtgaagaccgagacccacgccgagaccgtgaccgccggcaaggagccccccggcgccatgaccagcaccaccagccagaagcccggcagcaaccagggcagacccgacggcagcctgggcggcaccgcccccctgatcttccccgacagcaagaacgtgccccccgtgggcatcctggcccccgaggccaaccccaaggccgaggagaaggagaacgacaccgtgaccatcagccccaagcaggagggcttcccccccaagggctacttccccagcggcaagaagaagggcagacccatcggcagcgtgaacaagcagaagaagcagcagcagcccccccccccccccccccagcccccccagatccccgagggcagcgccgacggcgagcccaagcccaagaagcagagacagagaagagagagaagaaagcccggcgcccagcccagaaagagaaagaccaagcaggccgtgcccatcgtggagccccaggagcccgagatcaagctgaagtacgccacccagcccctggacaagaccgacgccaagaacaagagcttctacccctacatccacgtggtgaacaagtgcgagctgggcgccgtgtgcaccatcatcaacgccgaggaggaggagcagaccaagctggtgagaggcagaaagggccagagaagcctgacccccccccccagcagcaccgagagcaaggccctgcccgccagcagcttcatgctgcagggccccgtggtgaccgagagcagcgtgatgggccacctggtgtgctgcctgtgcggcaagtgggccagctacagaaacatgggcgacctgttcggccccttctacccccaggactacgccgccaccctgcccaagaaccccccccccaagagagccaccgagatgcagagcaaggtgaaggtgagacacaagagcgccagcaacggcagcaagaccgacaccgaggaggaggaggagcagcagcagcagcagaaggagcagagaagcctggccgcccaccccagattcaagagaagacacagaagcgaggactgcggcggcggccccagaagcctgagcagaggcctgccctgcaagaaggccgccaccgagggcagcagcgagaagaccgtgctggacagcaagcccagcgtgcccaccaccagcgagggcggccccgagctggagctgcagatccccgagctgcccctggacagcaacgagttctgggtgcacgagggctgcatcctgtgggccaacggcatctacctggtgtgcggcagactgtacggcctgcaggaggccctggagatcgccagagagatgaagtgcagccactgccaggaggccggcgccaccctgggctgctacaacaagggctgcagcttcagataccactacccctgcgccatcgacgccgactgcctgctgcacgaggagaacttcagcgtgagatgccccaagcacaagccccccctgccctgccccctgccccccctgcagaacaagaccgccaagggcagcctgagcaccgagcagagcgagagaggctag

SEQ ID NO: 13260 - DNA, 540 bp, Artificial Sequence
  Description of Artificial Sequence: Synthetic coding sequence
atgagcaccggcagcctgagcgacgtggaggacctgcaggaggtggagatgctggagtgcgacggcctgaagatggacagcaacaaggagttcgtgaccagcaacgagagcaccgaggagagcagcaactgcgagaacggcagcccccagaagggcagaggcggcctgggcaagagaagaaaggcccccaccaagaagagccccctgagcggcgtgagccaggagggcaagcaggtgcagagaaacgccgccaacgccagagagagagccagaatgagagtgctgagcaaggccttcagcagactgaagaccaccctgccctgggtgccccccgacaccaagctgagcaagctggacaccctgagactggccagcagctacatcgcccacctgagacagatcctggccaacgacaagtacgagaacggctacatccaccccgtgaacctgacctggcccttcatggtggccggcaagcccgagagcgacctgaaggaggtggtgaccgccagcagactgtgcggcaccaccgccagctag

SEQ ID NO: 13261 - DNA, 540 bp, Artificial Sequence; identical to SEQ ID NO: 13260
  Description of Artificial Sequence: Synthetic coding sequence

SEQ ID NO: 13262 - DNA, 1965 bp, Artificial Sequence
  Description of Artificial Sequence: Synthetic coding sequence
atgaaccagccccagagaatggcccccgtgggcaccgacaaggagctgagcgacctgctggacttcagcatgatgttccccctgcccgtgaccaacggcaagggcagacccgccagcctggccggcgcccagttcggcggcagcggcctggaggacagacccagcagcggcagctggggcagcggcgaccagagcagcagcagcttcgaccccagcagaaccttcagcgagggcacccacttcaccgagagccacagcagcctgagcagcagcaccttcctgggccccggcctgggcggcaagagcggcgagagaggcgcctacgccagcttcggcagagacgccggcgtgggcggcctgacccaggccggcttcctgagcggcgagctggccctgaacagccccggccccctgagccccagcggcatgaagggcaccagccagtactaccccagctacagcggcagcagcagaagaagagccgccgacggcagcctggacacccagcccaagaaggtgagaaaggtgccccccggcctgcccagcagcgtgtacccccccagcagcggcgaggactacggcagagacgccaccgcctaccccagcgccaagacccccagcagcacctaccccgcccccttctacgtggccgacggcagcctgcaccccagcgccgagctgtggagcccccccggccaggccggcttcggccccatgctgggcggcggcagcagccccctgcccctgccccccggcagcggccccgtgggcagcagcggcagcagcagcaccttcggcggcctgcaccagcacgagagaatgggctaccagctgcacggcgccgaggtgaacggcggcctgcccagcgccagcagcttcagcagcgcccccggcgccacctacggcggcgtgagcagccacaccccccccgtgagcggcgccgacagcctgctgggcagcagaggcaccaccgccggcagcagcggcgacgccctgggcaaggccctggccagcatctacagccccgaccacagcagcaacaacttcagcagcagccccagcacccccgtgggcagcccccagggcctggccggcaccagccagtggcccagagccggcgcccccggcgccctgagccccagctacgacggcggcctgcacggcctgcagagcaagatcgaggaccacctggacgaggccatccacgtgctgagaagccacgccgtgggcaccgccggcgacatgcacaccctgctgcccggccacggcgccctggccagcggcttcaccggccccatgagcctgggcggcagacacgccggcctggtgggcggcagccaccccgaggacggcctggccggcagcaccagcctgatgcacaaccacgccgccctgcccagccagcccggcaccctgcccgacctgagcagaccccccgacagctacagcggcctgggcagagccggcgccaccgccgccgccagcgagatcaagagagaggagaaggaggacgaggagaacaccagcgccgccgaccacagcgaggaggagaagaaggagctgaaggcccccagagccagaaccagccccgacgaggacgaggacgacctgctgccccccgagcagaaggccgagagagagaaggagagaagagtggccaacaacgccagagagagactgagagtgagagacatcaacgaggccttcaaggagctgggcagaatgtgccagctgcacctgaacagcgagaagccccagaccaagctgctgatcctgcaccaggccgtgagcgtgatcctgaacctggagcagcaggtgagagagagaaacctgaaccccaaggccgcctgcctgaagagaagagaggaggagaaggtgagcggcgtggtgggcgacccccagatggtgctgagcgccccccaccccggcctgagcgaggcccacaaccccgccggccacatgtag

SEQ ID NO: 13263 - DNA, 1956 bp, Artificial Sequence
  Description of Artificial Sequence: Synthetic coding sequence
atgaaccagccccagagaatggcccccgtgggcaccgacaaggagctgagcgacctgctggacttcagcatgatgttccccctgcccgtgaccaacggcaagggcagacccgccagcctggccggcgcccagttcggcggcagcggcctggaggacagacccagcagcggcagctggggcagcggcgaccagagcagcagcagcttcgaccccagcagaaccttcagcgagggcacccacttcaccgagagccacagcagcctgagcagcagcaccttcctgggccccggcctgggcggcaagagcggcgagagaggcgcctacgccagcttcggcagagacgccggcgtgggcggcctgacccaggccggcttcctgagcggcgagctggccctgaacagccccggccccctgagccccagcggcatgaagggcaccagccagtactaccccagctacagcggcagcagcagaagaagagccgccgacggcagcctggacacccagcccaagaaggtgagaaaggtgccccccggcctgcccagcagcgtgtacccccccagcagcggcgaggactacggcagagacgccaccgcctaccccagcgccaagacccccagcagcacctaccccgcccccttctacgtggccgacggcagcctgcaccccagcgccgagctgtggagcccccccggccaggccggcttcggccccatgctgggcggcggcagcagccccctgcccctgccccccggcagcggccccgtgggcagcagcggcagcagcagcaccttcggcggcctgcaccagcacgagagaatgggctaccagctgcacggcgccgaggtgaacggcggcctgcccagcgccagcagcttcagcagcgcccccggcgccacctacggcggcgtgagcagccacaccccccccgtgagcggcgccgacagcctgctgggcagcagaggcaccaccgccggcagcagcggcgacgccctgggcaaggccctggccagcatctacagccccgaccacagcagcaacaacttcagcagcagccccagcacccccgtgggcagcccccagggcctggccggcaccagccagtggcccagagccggcgcccccggcgccctgagccccagctacgacggcggcctgcacggcctgcagagcaagatcgaggaccacctggacgaggccatccacgtgctgagaagccacgccgtgggcaccgccggcgacatgcacaccctgctgcccggccacggcgccctggccagcggcttcaccggccccatgagcctgggcggcagacacgccggcctggtgggcggcagccaccccgaggacggcctggccggcagcaccagcctgatgcacaaccacgccgccctgcccagccagcccggcaccctgcccgacctgagcagaccccccgacagctacagcggcctgggcagagccggcgccaccgccgccgccagcgagatcaagagagaggagaaggaggacgaggagaacaccagcgccgccgaccacagcgaggaggagaagaaggagctgaaggcccccagagccagaaccagcagcaccgacgaggtgctgagcctggaggagaaggacctgagagacagagagagaagaatggccaacaacgccagagagagagtgagagtgagagacatcaacgaggccttcagagagctgggcagaatgtgccagatgcacctgaagagcgacaaggcccagaccaagctgctgatcctgcagcaggccgtgcaggtgatcctgggcctggagcagcaggtgagagagagaaacctgaaccccaaggccgcctgcctgaagagaagagaggaggagaaggtgagcggcgtggtgggcgacccccagatggtgctgagcgccccccaccccggcctgagcgaggcccacaaccccgccggccacatgtag

SEQ ID NO: 13264 - DNA, 1977 bp, Artificial Sequence
  Description of Artificial Sequence: Synthetic coding sequence
atgaaccagccccagagaatggcccccgtgggcaccgacaaggagctgagcgacctgctggacttcagcatgatgttccccctgcccgtgaccaacggcaagggcagacccgccagcctggccggcgcccagttcggcggcagcggcaagagcggcgagagaggcgcctacgccagcttcggcagagacgccggcgtgggcggcctgacccaggccggcttcctgagcggcgagctggccctgaacagccccggccccctgagccccagcggcatgaagggcaccagccagtactaccccagctacagcggcagcagcagaagaagagccgccgacggcagcctggacacccagcccaagaaggtgagaaaggtgccccccggcctgcccagcagcgtgtacccccccagcagcggcgaggactacggcagagacgccaccgcctaccccagcgccaagacccccagcagcacctaccccgcccccttctacgtggccgacggcagcctgcaccccagcgccgagctgtggagcccccccggccaggccggcttcggccccatgctgggcggcggcagcagccccctgcccctgccccccggcagcggccccgtgggcagcagcggcagcagcagcaccttcggcggcctgcaccagcacgagagaatgggctaccagctgcacggcgccgaggtgaacggcggcctgcccagcgccagcagcttcagcagcgcccccggcgccacctacggcggcgtgagcagccacaccccccccgtgagcggcgccgacagcctgctgggcagcagaggcaccaccgccggcagcagcggcgacgccctgggcaaggccctggccagcatctacagccccgaccacagcagcaacaacttcagcagcagccccagcacccccgtgggcagcccccagggcctggccggcaccagccagtggcccagagccggcgcccccggcgccctgagccccagctacgacggcggcctgcacggcctgcagagcaagatcgaggaccacctggacgaggccatccacgtgctgagaagccacgccgtgggcaccgccggcgacatgcacaccctgctgcccggccacggcgccctggccagcggcttcaccggccccatgagcctgggcggcagacacgccggcctggtgggcggcagccaccccgaggacggcctggccggcagcaccagcctgatgcacaaccacgccgccctgcccagccagcccggcaccctgcccgacctgagcagaccccccgacagctacagcggcctgggcagagccggcgccaccgccgccgccagcgagatcaagagagaggagaaggaggacgaggagaacaccagcgccgccgaccacagcgaggaggagaagaaggagctgaaggcccccagagccagaaccagatgccagcccacccccagacacagcccccccagcccccaccaggacgcccacgtgcacagaccccacgcccacagaacccacaccggcagacccagcgccggccccaccctgttcccccagccccactgcctgcccctggcccccagcagaagacccccccacagccccgacgaggacgaggacgacctgctgccccccgagcagaaggccgagagagagaaggagagaagagtggccaacaacgccagagagagactgagagtgagagacatcaacgaggccttcaaggagctgggcagaatgtgccagctgcacctgaacagcgagaagccccagaccaagctgctgatcctgcaccaggccgtgagcgtgatcctgaacctggagcagcaggtgagagagagaaacctgaaccccaaggccgcctgcctgaagagaagagaggaggagaaggtgagcggcgtggtgggcgacccccagatggtgctgagcgccccccaccccggcctgagcgaggcccacaaccccgccggccacatgtag

SEQ ID NO: 13265 - DNA, 1956 bp, Artificial Sequence; identical to SEQ ID NO: 13263
  Description of Artificial Sequence: Synthetic coding sequence

SEQ ID NO: 13266 - DNA, 474 bp, Artificial Sequence
  Description of Artificial Sequence: Synthetic coding sequence
atgggctaccagctgcacggcgccgaggtgaacggcggcctgcccagcgccagcagcttcagcagcgcccccggcgccacctacggcggcgtgagcagccacaccccccccgtgagcggcgccgacagcctgctgggcagcagaggcaccaccgccggcagcagcggcgacgccctgggcaaggccctggccagcatctacagccccgaccacagcagcaacaacttcagcagcagccccagcacccccgtgggcagcccccagggcctggccggcaccagccagtggcccagagccggcgcccccggcgccctgagccccagctacgacggcggcctgcacggcctggtgggcggcagccaccccgaggacggcctggccggcagcaccagcctgatgcacaaccacgccgccctgcccagccagcccggcaccctgcccgacctgagcagaccccccgacagctacagctag

SEQ ID NO: 13267 - DNA, 2016 bp, Artificial Sequence
  Description of Artificial Sequence: Synthetic coding sequence
atgcaccaccagcagagaatggccgccctgggcaccgacaaggagctgagcgacctgctggacttcagcgccatgttcagcccccccgtgagcagcggcaagaacggccccaccagcctggccagcggccacttcaccggcagcaacgtggaggacagaagcagcagcggcagctggggcaacggcggccaccccagccccagcagaaactacggcgacggcaccccctacgaccacatgaccagcagagacctgggcagccacgacaacctgagcccccccttcgtgaacagcagaatccagagcaagaccgagagaggcagctacagcagctacggcagagagagcaacctgcagggctgccaccagcagagcctgctgggcggcgacatggacatgggcaaccccggcaccctgagccccaccaagcccggcagccagtactaccagtacagcagcaacaaccccagaagaagacccctgcacagcagcgccatggaggtgcagaccaagaaggtgagaaaggtgccccccggcctgcccagcagcgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagaagcagaagcagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13268 - DNA, 2004 bp, Artificial Sequence
  Description of Artificial Sequence: Synthetic coding sequence
atgcaccaccagcagagaatggccgccctgggcaccgacaaggagctgagcgacctgctggacttcagcgccatgttcagcccccccgtgagcagcggcaagaacggccccaccagcctggccagcggccacttcaccggcagcaacgtggaggacagaagcagcagcggcagctggggcaacggcggccaccccagccccagcagaaactacggcgacggcaccccctacgaccacatgaccagcagagacctgggcagccacgacaacctgagcccccccttcgtgaacagcagaatccagagcaagaccgagagaggcagctacagcagctacggcagagagagcaacctgcagggctgccaccagcagagcctgctgggcggcgacatggacatgggcaaccccggcaccctgagccccaccaagcccggcagccagtactaccagtacagcagcaacaaccccagaagaagacccctgcacagcagcgccatggaggtgcagaccaagaaggtgagaaaggtgccccccggcctgcccagcagcgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13269 - DNA, 2322 bp, Artificial Sequence
  Description of Artificial Sequence: Synthetic coding sequence
atgttcagcaagagactggagaagatcgcccaggtgcccctgctgttccccttcatcttcatcatcctgaccaactacagcaagatggagggcgccgtggagagccagcccagcttcttcaagaccagccaggacatcgtgacctgcacctgggtggagaactgctacagcagcttcagcagaagacccctggagcagatgttctgcaagcaccagagcaagaacatcatcagctggaccggcatggtggcccacacctgcaaccccagcaccctgggcggccagggcctgtgcgacttcgccaagatgcaccaccagcagagaatggccgccctgggcaccgacaaggagctgagcgacctgctggacttcagcgccatgttcagcccccccgtgagcagcggcaagaacggccccaccagcctggccagcggccacttcaccggcagcaacgtggaggacagaagcagcagcggcagctggggcaacggcggccaccccagccccagcagaaactacggcgacggcaccccctacgaccacatgaccagcagagacctgggcagccacgacaacctgagcccccccttcgtgaacagcagaatccagagcaagaccgagagaggcagctacagcagctacggcagagagagcaacctgcagggctgccaccagcagagcctgctgggcggcgacatggacatgggcaaccccggcaccctgagccccaccaagcccggcagccagtactaccagtacagcagcaacaaccccagaagaagacccctgcacagcagcgccatggaggtgcagaccaagaaggtgagaaaggtgccccccggcctgcccagcagcgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagaagcagaagcagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13270 - DNA, 1536 bp, Artificial Sequence
  Description of Artificial Sequence: Synthetic coding sequence
atgtactgcgcctacaccatccccggcatgggcggcaacagcctgatgtactactacaacggcaaggccgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagaagcagaagcagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13271 - DNA, 1944 bp, Artificial Sequence
  Description of Artificial Sequence: Synthetic coding sequence
atgttcagcccccccgtgagcagcggcaagaacggccccaccagcctggccagcggccacttcaccggcagcaacgtggaggacagaagcagcagcggcagctggggcaacggcggccaccccagccccagcagaaactacggcgacggcaccccctacgaccacatgaccagcagagacctgggcagccacgacaacctgagcccccccttcgtgaacagcagaatccagagcaagaccgagagaggcagctacagcagctacggcagagagagcaacctgcagggctgccaccagcagagcctgctgggcggcgacatggacatgggcaaccccggcaccctgagccccaccaagcccggcagccagtactaccagtacagcagcaacaaccccagaagaagacccctgcacagcagcgccatggaggtgcagaccaagaaggtgagaaaggtgccccccggcctgcccagcagcgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagaagcagaagcagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13272 - DNA, 1614 bp, Artificial Sequence
  Description of Artificial Sequence: Synthetic coding sequence
atggacatgggcaaccccggcaccctgagccccaccaagcccggcagccagtactaccagtacagcagcaacaaccccagaagaagacccctgcacagcagcgccatggaggtgcagaccaagaaggtgagaaaggtgccccccggcctgcccagcagcgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13273 - DNA, 1932 bp, Artificial Sequence
  Description of Artificial Sequence: Synthetic coding sequence
atgttcagcccccccgtgagcagcggcaagaacggccccaccagcctggccagcggccacttcaccggcagcaacgtggaggacagaagcagcagcggcagctggggcaacggcggccaccccagccccagcagaaactacggcgacggcaccccctacgaccacatgaccagcagagacctgggcagccacgacaacctgagcccccccttcgtgaacagcagaatccagagcaagaccgagagaggcagctacagcagctacggcagagagagcaacctgcagggctgccaccagcagagcctgctgggcggcgacatggacatgggcaaccccggcaccctgagccccaccaagcccggcagccagtactaccagtacagcagcaacaaccccagaagaagacccctgcacagcagcgccatggaggtgcagaccaagaaggtgagaaaggtgccccccggcctgcccagcagcgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13274 - DNA, 1878 bp, Artificial Sequence
  Description of Artificial Sequence: Synthetic coding sequence
atggaggaggacagcagagacgtggaggacagaagcagcagcggcagctggggcaacggcggccaccccagccccagcagaaactacggcgacggcaccccctacgaccacatgaccagcagagacctgggcagccacgacaacctgagcccccccttcgtgaacagcagaatccagagcaagaccgagagaggcagctacagcagctacggcagagagagcaacctgcagggctgccaccagcagagcctgctgggcggcgacatggacatgggcaaccccggcaccctgagccccaccaagcccggcagccagtactaccagtacagcagcaacaaccccagaagaagacccctgcacagcagcgccatggaggtgcagaccaagaaggtgagaaaggtgccccccggcctgcccagcagcgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13275 - DNA, 1803 bp, Artificial Sequence
  Description of Artificial Sequence: Synthetic coding sequence
atgaaggacatcttcttccagttcatcatcgccagagtgagaaagtgctacagcctgagctgcctgcacaccctgcccgtggtgcccaccctgagaaagaccgagagaggcagctacagcagctacggcagagagagcaacctgcagggctgccaccagagcctgctgggcggcgacatggacatgggcaaccccggcaccctgagccccaccaagcccggcagccagtactaccagtacagcagcaacaaccccagaagaagacccctgcacagcagcgccatggaggtgcagaccaagaaggtgagaaaggtgccccccggcctgcccagcagcgtgtacgcccccagcgccagcaccgccgactacaacagagacagccccggctaccccagcagcaagcccgccaccagcaccttccccagcagcttcttcatgcaggacggccaccacagcagcgacccctggagcagcagcagcggcatgaaccagcccggctacgccggcatgctgggcaacagcagccacatcccccagagcagcagctactgcagcctgcacccccacgagagactgagctaccccagccacagcagcgccgacatcaacagcagcctgccccccatgagcaccttccacagaagcggcaccaaccactacagcaccagcagctgcaccccccccgccaacggcaccgacagcatcatggccaacagaggcagcggcgccgccggcagcagccagaccggcgacgccctgggcaaggccctggccagcatctacagccccgaccacaccaacaacagcttcagcagcaaccccagcacccccgtgggcagcccccccagcctgagcgccggcaccgccgtgtggagcagaaacggcggccaggccagcagcagccccaactacgagggccccctgcacagcctgcagagcagaatcgaggacagactggagagactggacgacgccatccacgtgctgagaaaccacgccgtgggccccagcaccgccatgcccggcggccacggcgacatgcacggcatcatcggccccagccacaacggcgccatgggcggcctgggcagcggctacggcaccggcctgctgagcgccaacagacacagcctgatggtgggcacccacagagaggacggcgtggccctgagaggcagccacagcctgctgcccaaccaggtgcccgtgccccagctgcccgtgcagagcgccaccagccccgacctgaaccccccccaggacccctacagaggcatgccccccggcctgcagggccagagcgtgagcagcggcagcagcgagatcaagagcgacgacgagggcgacgagaacctgcaggacaccaagagcagcgaggacaagaagctggacgacgacaagaaggacatcaagagcatcaccagaagcagaagcagcaacaacgacgacgaggacctgacccccgagcagaaggccgagagagagaaggagagaagaatggccaacaacgccagagagagactgagagtgagagacatcaacgaggccttcaaggagctgggcagaatggtgcagctgcacctgaagagcgacaagccccagaccaagctgctgatcctgcaccaggccgtggccgtgatcctgagcctggagcagcaggtgagagagagaaacctgaaccccaaggccgcctgcctgaagagaagagaggaggagaaggtgagcagcgagcccccccccctgagcctggccggcccccaccccggcatgggcgacgccagcaaccacatgggccagatgtag

SEQ ID NO: 13276 - DNA, 1233 bp, Artificial Sequence
  Description of Artificial Sequence: Synthetic coding sequence
atggccaaggacgccggcctgatcgaggccaacggcgagctgaaggtgttcatcgaccagaacctgagccccggcaagggcgtggtgagcctggtggccgtgcaccccagcaccgtgaaccccctgggcaagcagctgctgcccaagaccttcggccagagcaacgtgaacatcgcccagcaggtggtgatcggcaccccccagagacccgccgccagcaacaccctggtggtgggcagcccccacacccccagcacccacttcgccagccagaaccagcccagcgacagcagcccctggagcgccggcaagagaaacagaaagggcgagaagaacggcaagggcctgagacacttcagcatgaaggtgtgcgagaaggtgcagagaaagggcaccaccagctacaacgaggtggccgacgagctggtggccgagttcagcgccgccgacaaccacatcctgcccaacgagagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggaggtggagagacagagaagactggagagaatcaagcagaagcagagccagctgcaggagctgatcctgcagcagatcgccttcaagaacctggtgcagagaaacagacacgccgagcagcaggccagcagaccccccccccccaacagcgtgatccacctgcccttcatcatcgtgaacaccagcaagaagaccgtgatcgactgcagcatcagcaacgacaagttcgagtacctgttcaacttcgacaacaccttcgagatccacgacgacatcgaggtgctgaagagaatgggcatggcctgcggcctggagagcggcagctgcagcgccgaggacctgaagatggccagaagcctggtgcccaaggccctggagccctacgtgaccgagatggcccagggcaccgtgggcggcgtgttcatcaccaccgccggcagcaccagcaacggcaccagattcagcgccagcgacctgaccaacggcgccgacggcatgctggccaccagcagcaacggcagccagtacagcggcagcagagtggagacccccgtgagctacgtgggcgaggacgacgaggaggacgacgacttcaacgagaacgacgaggacgactag

SEQ ID NO: 13277 - DNA, 711 bp, Artificial Sequence
  Description of Artificial Sequence: Synthetic coding sequence
atggccaaggacgccggcctgatcgaggccaacggcgagctgaaggtgttcatcgaccagaacctgagccccggcaagggcgtggtgagcctggtggccgtgcaccccagcaccgtgaaccccctgggcaagcagctgctgcccaagaccttcggccagagcaacgtgaacatcgcccagcaggtggtgatcggcaccccccagagacccgccgccagcaacaccctggtggtgggcagcccccacacccccagcacccacttcgccagccagaaccagcccagcgacagcagcccctggagcgccggcaagagaaacagaaagggcgagaagaacggcaagggcctgagacacttcagcatgaaggtgtgcgagaaggtgcagagaaagggcaccaccagctacaacgaggtggccgacgagctggtggccgagttcagcgccgccgacaaccacatcctgcccaacgagagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggaggtggagagacagagaagactggagagaatcaagcagaagcagagccagctgcaggagctgatcctgcagcagatcgccttcaagaacctgtag

SEQ ID NO: 13278 - DNA, 480 bp, Artificial Sequence
  Description of Artificial Sequence: Synthetic coding sequence
atggccaaggacgccggcctgatcgaggccaacggcgagctgaaggtgttcatcgaccagaacctgagccccggcaagggcgtggtgagcctggtggccgtgcaccccagcaccgtgaaccccctgggcaagcagctgctgcccaagaccttcggccagagcaacgtgaacatcgcccagcaggtggtgatcggcaccccccagagacccgccgccagcaacaccctggtggtgggcagcccccacacccccagcacccacttcgccagccagaaccagcccagcgacagcagcccctggagcgccggcaagagaaacagaaagggcgagaagaacggcaagggcctgagacacttcagcatgaaggtgtgcgagaaggtgcagagaaagggcaccaccagctacaacgaggtggccgacgagctggtggccgagttcagcgccgccgacaaccacatcctgcccaacgagagcgtgtag

SEQ ID NO: 13279 - DNA, 936 bp, Artificial Sequence
  Description of Artificial Sequence: Synthetic coding sequence
atgagcaccctgcccagcaagtggaagagaaacagaaagggcgagaagaacggcaagggcctgagacacttcagcatgaaggtgtgcgagaaggtgcagagaaagggcaccaccagctacaacgaggtggccgacgagctggtggccgagttcagcgccgccgacaaccacatcctgcccaacgagagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggaggtggagagacagagaagactggagagaatcaagcagaagcagagccagctgcaggagctgatcctgcagcagatcgccttcaagaacctggtgcagagaaacagacacgccgagcagcaggccagcagaccccccccccccaacagcgtgatccacctgcccttcatcatcgtgaacaccagcaagaagaccgtgatcgactgcagcatcagcaacgacaagttcgagtacctgttcaacttcgacaacaccttcgagatccacgacgacatcgaggtgctgaagagaatgggcatggcctgcggcctggagagcggcagctgcagcgccgaggacctgaagatggccagaagcctggtgcccaaggccctggagccctacgtgaccgagatggcccagggcaccgtgggcggcgtgttcatcaccaccgccggcagcaccagcaacggcaccagcgacctgaccaacggcgccgacggcatgctggccaccagcagcaacggcagccagtacagcggcagcagagtggagacccccgtgagctacgtgggcgaggacgacgaggaggacgacgacttcaacgagaacgacgaggacgactag

SEQ ID NO: 13280 - DNA, 1146 bp, Artificial Sequence
  Description of Artificial Sequence: Synthetic coding sequence
atgagcaccctgcccagcaagtggaagagaaacagaaagggcgagaagaacggcaagggcctgagacacttcagcatgaaggtgtgcgagaaggtgcagagaaagggcaccaccagctacaacgaggtggccgacgagctggtggccgagttcagcgccgccgacaaccacatcctgcccaacgagagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggaggtggagagacagagaagactggagagaatcaagcagaagcagagccagctgcaggagctgatcctgcagcagatcgccttcaagaacctggtgcagagaaacagacacgccgagcagcaggccagcagaccccccccccccaacagcgtgatccacctgcccttcatcatcgtgaacaccagcaagaagaccgtgatcgactgcagcatcagcaacgacaagttcgagtacctgttcaacttcgacaacaccttcgagatccacgacgacatcgaggtgctgaagagaatgggcatggcctgcggcctggagagcggcagctgcagcgccgaggacctgaagatggccagaagcctggtgcccaaggccctggagccctacgtgaccgagaagaccggcctgtgcgactgcaccgccggctgccccgccccctggagaagcgtggagaacaccggccaggccaaggacatcagaaagctgctgcagcccagcgtgctgtggaactgcgccagcttctgctggctgcccgtgagactggtgctgttcctgttccacgaccacagcctgatcttcttccccttcagcgagatggcccagggcaccgtgggcggcgtgttcatcaccaccgccggcagcaccagcaacggcaccagattcagcgccagcgacctgaccaacggcgccgacggcatgctggccaccagcagcaacggcagccagtacagcggcagcagagtggagacccccgtgagctacgtgggcgaggacgacgaggaggacgacgacttcaacgagaacgacgaggacgactag

SEQ ID NO: 13281 - DNA, 1161 bp, Artificial Sequence
  Description of Artificial Sequence: Synthetic coding sequence
atgatcatcagcaccccccagagactgaccagcagcggcagcgtgctgatcggcagcccctacacccccgcccccgccatggtgacccagacccacatcgccgaggccaccggctgggtgcccggcgacagaaagagagccagaaagttcatcgacagcgacttcagcgagagcaagagaagcaagaagggcgacaagaacggcaagggcctgagacacttcagcatgaaggtgtgcgagaaggtgcagagaaagggcaccaccagctacaacgaggtggccgacgagctggtgagcgagttcaccaacagcaacaaccacctggccgccgacagccaggcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggagatcgagaagcagagaagaatcgagagaatcaagcagaagagagcccagctgcaggagctgctgctgcagcagatcgccttcaagaacctggtgcagagaaacagacagaacgagcagcagaaccagggcccccccgccctgaacagcaccatccagctgcccttcatcatcatcaacaccagcagaaagaccgtgatcgactgcagcatcagcagcgacaagttcgagtacctgttcaacttcgacaacaccttcgagatccacgacgacatcgaggtgctgaagagaatgggcatgagcttcggcctggagagcggcaagtgcagcctggaggacctgaagctggccaagagcctggtgcccaaggccctggagggctacatcaccgacatcagcaccggccccagctggctgaaccagggcctgctgctgaacagcacccagagcgtgagcaacctggacctgaccaccggcgccaccctgccccagagcagcgtgaaccagggcctgtgcctggacgccgaggtggccctggccaccggccagttcctggcccccaacagccaccagagcagcagcgccgccagccactgcagcgagagcagaggcgagaccccctgcagcttcaacgacgaggacgaggaggacgacgaggaggacagcagcagccccgagtag

SEQ ID NO: 13282 - DNA, 1113 bp, Artificial Sequence
  Description of Artificial Sequence: Synthetic coding sequence
atgatcatcagcaccccccagagactgaccagcagcggcagcgtgctgatcggcagcccctacacccccgcccccgccatggtgacccagacccacatcgccgaggccaccggctgggtgcccggcaagagaagcaagaagggcgacaagaacggcaagggcctgagacacttcagcatgaaggtgtgcgagaaggtgcagagaaagggcaccaccagctacaacgaggtggccgacgagctggtgagcgagttcaccaacagcaacaaccacctggccgccgacagccaggcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggagatcgagaagcagagaagaatcgagagaatcaagcagaagagagcccagctgcaggagctgctgctgcagcagatcgccttcaagaacctggtgcagagaaacagacagaacgagcagcagaaccagggcccccccgccctgaacagcaccatccagctgcccttcatcatcatcaacaccagcagaaagaccgtgatcgactgcagcatcagcagcgacaagttcgagtacctgttcaacttcgacaacaccttcgagatccacgacgacatcgaggtgctgaagagaatgggcatgagcttcggcctggagagcggcaagtgcagcctggaggacctgaagctggccaagagcctggtgcccaaggccctggagggctacatcaccgacatcagcaccggccccagctggctgaaccagggcctgctgctgaacagcacccagagcgtgagcaacctggacctgaccaccggcgccaccctgccccagagcagcgtgaaccagggcctgtgcctggacgccgaggtggccctggccaccggccagttcctggcccccaacagccaccagagcagcagcgccgccagccactgcagcgagagcagaggcgagaccccctgcagcttcaacgacgaggacgaggaggacgacgaggaggacagcagcagccccgagtag

SEQ ID NO: 13283 - DNA, 1257 bp, Artificial Sequence
  Description of Artificial Sequence: Synthetic coding sequence
atgcagcccgagggcatcatcttcgaggccgagaacaagcccagccccggcaccgagagcgccggcaccttcatcctggacctgagcgccaccagcagaaccatcatcagcaccccccagagactgaccagcagcggcagcgtgctgatcggcagcccctacacccccgcccccgccatggtgacccagacccacatcgccgaggccaccggctgggtgcccggcgacagaaagagagccagaaagttcatcgacagcgacttcagcgagagcaagagaagcaagaagggcgacaagaacggcaagggcctgagacacttcagcatgaaggtgtgcgagaaggtgcagagaaagggcaccaccagctacaacgaggtggccgacgagctggtgagcgagttcaccaacagcaacaaccacctggccgccgacagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggagatcgagaagcagagaagaatcgagagaatcaagcagaagagagcccagctgcaggagctgctgctgcagcagatcgccttcaagaacctggtgcagagaaacagacagaacgagcagcagaaccagggcccccccgccctgaacagcaccatccagctgcccttcatcatcatcaacaccagcagaaagaccgtgatcgactgcagcatcagcagcgacaagttcgagtacctgttcaacttcgacaacaccttcgagatccacgacgacatcgaggtgctgaagagaatgggcatgagcttcggcctggagagcggcaagtgcagcctggaggacctgaagctggccaagagcctggtgcccaaggccctggagggctacatcaccgacatcagcaccggccccagctggctgaaccagggcctgctgctgaacagcacccagagcgtgagcaacctggacctgaccaccggcgccaccctgccccagagcagcgtgaaccagggcctgtgcctggacgccgaggtggccctggccaccggccagttcctggcccccaacagccaccagagcagcagcgccgccagccactgcagcgagagcagaggcgagaccccctgcagcttcaacgacgaggacgaggaggacgacgaggaggacagcagcagccccgagtag

SEQ ID NO: 13284 - DNA, 1161 bp, Artificial Sequence; identical to SEQ ID NO: 13281
  Description of Artificial Sequence: Synthetic coding sequence

SEQ ID NO: 13285 - DNA, 261 bp, Artificial Sequence
  Description of Artificial Sequence: Synthetic coding sequence
atgaccgccaagaacgtgggcctgaccagcaccaacgccgaggtgagaggcttcatcgaccagaacctgagccccaccaagggcaacatcagcttcgtggccttccccgtgagcaacaccaacagccccaccaagatcctgcccaagaccctgggccccatcaacgtgaacgtgggcccccagatgatcatcagcaccccccagagactgaccagcagcggcagcgtgctgatcggcagcccctacacccccgccccctag

SEQ ID NO: 13286 - DNA, 141 bp, Artificial Sequence
  Description of Artificial Sequence: Synthetic coding sequence
atgatcatcagcaccccccagagactgaccagcagcggcagcgtgctgatcggcagcccctacacccccgcccccgccatggtgacccagacccacatcgccgaggccaccggctgggtgcccggcgacagaaagagatag

SEQ ID NO: 13287 - DNA, 1158 bp, Artificial Sequence
  Description of Artificial Sequence: Synthetic coding sequence
atgatcatcagcaccccccagagactgaccagcagcggcagcgtgctgatcggcagcccctacacccccgcccccgccatggtgacccagacccacatcgccgaggccaccggctgggtgcccggcgacagaaagagagccagaaagttcatcgacagcgacttcagcgagagcaagagaagcaagaagggcgacaagaacggcaagggcctgagacacttcagcatgaaggtgtgcgagaaggtgcagagaaagggcaccaccagctacaacgaggtggccgacgagctggtgagcgagttcaccaacagcaacaaccacctggccgccgacagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggagatcgagaagcagagaagaatcgagagaatcaagcagaagagagcccagctgcaggagctgctgctgcagcagatcgccttcaagaacctggtgcagagaaacagacagaacgagcagcagaaccagggcccccccgccctgaacagcaccatccagctgcccttcatcatcatcaacaccagcagaaagaccgtgatcgactgcagcatcagcagcgacaagttcgagtacctgttcaacttcgacaacaccttcgagatccacgacgacatcgaggtgctgaagagaatgggcatgagcttcggcctggagagcggcaagtgcagcctggaggacctgaagctggccaagagcctggtgcccaaggccctggagggctacatcaccgacatcagcaccggccccagctggctgaaccagggcctgctgctgaacagcacccagagcgtgagcaacctggacctgaccaccggcgccaccctgccccagagcagcgtgaaccagggcctgtgcctggacgccgaggtggccctggccaccggccagttcctggcccccaacagccaccagagcagcagcgccgccagccactgcagcgagagcagaggcgagaccccctgcagcttcaacgacgaggacgaggaggacgacgaggaggacagcagcagccccgagtag

SEQ ID NO: 13288 - DNA, 270 bp, Artificial Sequence
  Description of Artificial Sequence: Synthetic coding sequence
atgatcatcagcaccccccagagactgaccagcagcggcagcgtgctgatcggcagcccctacacccccgcccccgccatggtgacccagacccacatcgccgaggccaccggctgggtgcccggcgacagaaagagagccagaaagttcatcgacagcgacttcagcgagagcaagagaagcaagaagggcgacaagaacggcaagggcctgagacacttcagcatgaaggtgtgcgagaaggtgcagagaaagggcaccaccagctag

SEQ ID NO: 13289 - DNA, 1341 bp, Artificial Sequence
  Description of Artificial Sequence: Synthetic coding sequence
atgaccgccaagaacgtgggcctgaccagcaccaacgccgaggtgagaggcttcatcgaccagaacctgagccccaccaagggcaacatcagcttcgtggccttccccgtgagcaacaccaacagccccaccaagatcctgcccaagaccctgggccccatcaacgtgaacgtgggcccccagatgatcatcagcaccccccagagactgaccagcagcggcagcgtgctgatcggcagcccctacacccccgcccccgccatggtgacccagacccacatcgccgaggccaccggctgggtgcccggcgacagaaagagagccagaaagttcatcgacagcgacttcagcgagagcaagagaagcaagaagggcgacaagaacggcaagggcctgagacacttcagcatgaaggtgtgcgagaaggtgcagagaaagggcaccaccagctacaacgaggtggccgacgagctggtgagcgagttcaccaacagcaacaaccacctggccgccgacagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggagatcgagaagcagagaagaatcgagagaatcaagcagaagagagcccagctgcaggagctgctgctgcagcagatcgccttcaagaacctggtgcagagaaacagacagaacgagcagcagaaccagggcccccccgccctgaacagcaccatccagctgcccttcatcatcatcaacaccagcagaaagaccgtgatcgactgcagcatcagcagcgacaagttcgagtacctgttcaacttcgacaacaccttcgagatccacgacgacatcgaggtgctgaagagaatgggcatgagcttcggcctggagagcggcaagtgcagcctggaggacctgaagctggccaagagcctggtgcccaaggccctggagggctacatcaccgacatcagcaccggccccagctggctgaaccagggcctgctgctgaacagcacccagagcgtgagcaacctggacctgaccaccggcgccaccctgccccagagcagcgtgaaccagggcctgtgcctggacgccgaggtggccctggccaccggccagttcctggcccccaacagccaccagagcagcagcgccgccagccactgcagcgagagcagaggcgagaccccctgcagcttcaacgacgaggacgaggaggacgacgaggaggacagcagcagccccgagtag

SEQ ID NO: 13290 - DNA, 84 bp, Artificial Sequence
  Description of Artificial Sequence: Synthetic coding sequence
atgatcatcagcaccccccagagactgaccagcagcggcagcgtgctgatcggcagcccctacacccccgcccccgccatgtag

SEQ ID NO: 13291 - DNA, 1050 bp, Artificial Sequence
  Description of Artificial Sequence: Synthetic coding sequence
atgctggaccccaagtgcgacagaaagagagccagaaagttcatcgacagcgacttcagcgagagcaagagaagcaagaagggcgacaagaacggcaagggcctgagacacttcagcatgaaggtgtgcgagaaggtgcagagaaagggcaccaccagctacaacgaggtggccgacgagctggtgagcgagttcaccaacagcaacaaccacctggccgccgacagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggagatcgagaagcagagaagaatcgagagaatcaagcagaagagagcccagctgcaggagctgctgctgcagcagatcgccttcaagaacctggtgcagagaaacagacagaacgagcagcagaaccagggcccccccgccctgaacagcaccatccagctgcccttcatcatcatcaacaccagcagaaagaccgtgatcgactgcagcatcagcagcgacaagttcgagtacctgttcaacttcgacaacaccttcgagatccacgacgacatcgaggtgctgaagagaatgggcatgagcttcggcctggagagcggcaagtgcagcctggaggacctgaagctggccaagagcctggtgcccaaggccctggagggctacatcaccgacatcagcaccggccccagctggctgaaccagggcctgctgctgaacagcacccagagcgtgagcaacctggacctgaccaccggcgccaccctgccccagagcagcgtgaaccagggcctgtgcctggacgccgaggtggccctggccaccggccagttcctggcccccaacagccaccagagcagcagcgccgccagccactgcagcgagagcagaggcgagaccccctgcagcttcaacgacgaggacgaggaggacgacgaggaggacagcagcagccccgagtag

SEQ ID NO: 13292 - DNA, 663 bp, Artificial Sequence
  Description of Artificial Sequence: Synthetic coding sequence
atgatcatcagcaccccccagagactgaccagcagcggcagcgtgctgatcggcagcccctacacccccgcccccgccatggtgacccagacccacatcgccgaggccaccggctgggtgcccggcgacagaaagagagccagaaagttcatcgacagcgacttcagcgagagcaagagaagcaagaagggcgacaagaacggcaagggcctgagacacttcagcatgaaggtgtgcgagaaggtgcagagaaagggcaccaccagctacaacgaggtggccgacgagctggtgagcgagttcaccaacagcaacaaccacctggccgccgacagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggagatcgagaagcagagaagaatcgagagaatcaagcagaagagagcccagctgcaggagctgctgctgcagcagatcgccttcaagaacctggtgcagagaaacagacagaacgagcagcagaaccagggcccccccgccctgaacagcaccatccagctgcccttcatcatcatcaacacctag

SEQ ID NO: 13293 - DNA, 1161 bp, Artificial Sequence; identical to SEQ ID NO: 13281
  Description of Artificial Sequence: Synthetic coding sequence

SEQ ID NO: 13294 - DNA, 933 bp, Artificial Sequence
  Description of Artificial Sequence: Synthetic coding sequence
atgaaggtgtgcgagaaggtgcagagaaagggcaccaccagctacaacgaggtggccgacgagctggtgagcgagttcaccaacagcaacaaccacctggccgccgacagcgcctacgaccagaagaacatcagaagaagagtgtacgacgccctgaacgtgctgatggccatgaacatcatcagcaaggagaagaaggagatcaagtggatcggcctgcccaccaacagcgcccaggagtgccagaacctggagatcgagaagcagagaagaatcgagagaatcaagcagaagagagcccagctgcaggagctgctgctgcagcagatcgccttcaagaacctggtgcagagaaacagacagaacgagcagcagaaccagggcccccccgccctgaacagcaccatccagctgcccttcatcatcatcaacaccagcagaaagaccgtgatcgactgcagcatcagcagcgacaagttcgagtacctgttcaacttcgacaacaccttcgagatccacgacgacatcgaggtgctgaagagaatgggcatgagcttcggcctggagagcggcaagtgcagcctggaggacctgaagctggccaagagcctggtgcccaaggccctggagggctacatcaccgacatcagcaccggccccagctggctgaaccagggcctgctgctgaacagcacccagagcgtgagcaacctggacctgaccaccggcgccaccctgccccagagcagcgtgaaccagggcctgtgcctggacgccgaggtggccctggccaccggccagttcctggcccccaacagccaccagagcagcagcgccgccagccactgcagcgagagcagaggcgagaccccctgcagcttcaacgacgaggacgaggaggacgacgaggaggacagcagcagccccgagtag

SEQ ID NO: 13295 - DNA, 1335 bp, Artificial Sequence
  Description of Artificial Sequence: Synthetic coding sequence
atgcccagaagcggcgcccccaaggagagacccgccgagcccctgacccccccccccagctacggccaccagccccagaccggcagcggcgagagcagcggcgccagcggcgacaaggaccacctgtacagcaccgtgtgcaagcccagaagccccaagcccgccgcccccgccgccccccccttcagcagcagcagcggcgtgctgggcaccggcctgtgcgagctggacagactgctgcaggagctgaacgccacccagttcaacatcaccgacgagatcatgagccagttccccagcagcaaggtggccagcggcgagcagaaggaggaccagagcgaggacaagaagagacccagcctgcccagcagccccagccccggcctgcccaaggccagcgccaccagcgccaccctggagctggacagactgatggccagcctgagcgacttcagagtgcagaaccacctgcccgccagcggccccacccagccccccgtggtgagcagcaccaacgagggcagccccagcccccccgagcccaccggcaagggcagcctggacaccatgctgggcctgctgcagagcgacctgagcagaagaggcgtgcccacccaggccaagggcctgtgcggcagctgcaacaagcccatcgccggccaggtggtgaccgccctgggcagagcctggcaccccgagcacttcgtgtgcggcggctgcagcaccgccctgggcggcagcagcttcttcgagaaggacggcgcccccttctgccccgagtgctacttcgagagattcagccccagatgcggcttctgcaaccagcccatcagacacaagatggtgaccgccctgggcacccactggcaccccgagcacttctgctgcgtgagctgcggcgagcccttcggcgacgagggcttccacgagagagagggcagaccctactgcagaagagacttcctgcagctgttcgcccccagatgccagggctgccagggccccatcctggacaactacatcagcgccctgagcgccctgtggcaccccgactgcttcgtgtgcagagagtgcttcgcccccttcagcggcggcagcttcttcgagcacgagggcagacccctgtgcgagaaccacttccacgccagaagaggcagcctgtgcgccacctgcggcctgcccgtgaccggcagatgcgtgagcgccctgggcagaagattccaccccgaccacttcacctgcaccttctgcctgagacccctgaccaagggcagcttccaggagagagccggcaagccctactgccagccctgcttcctgaagctgttcggctag

SEQ ID NO: 13296 - DNA, 1335 bp, Artificial Sequence; identical to SEQ ID NO: 13295
  Description of Artificial Sequence: Synthetic coding sequence

SEQ ID NO: 13297 - DNA, 1386 bp, Artificial Sequence
  Description of Artificial Sequence: Synthetic coding sequence
atggaggacctggacgccctgctgagcgacctggagaccaccaccagccacatgcccagaagcggcgcccccaaggagagacccgccgagcccctgacccccccccccagctacggccaccagccccagaccggcagcggcgagagcagcggcgccagcggcgacaaggaccacctgtacagcaccgtgtgcaagcccagaagccccaagcccgccgcccccgccgccccccccttcagcagcagcagcggcgtgctgggcaccggcctgtgcgagctggacagactgctgcaggagctgaacgccacccagttcaacatcaccgacgagatcatgagccagttccccagcagcaaggtggccagcggcgagcagaaggaggaccagagcgaggacaagaagagacccagcctgcccagcagccccagccccggcctgcccaaggccagcgccaccagcgccaccctggagctggacagactgatggccagcctgagcgacttcagagtgcagaaccacctgcccgccagcggccccacccagccccccgtggtgagcagcaccaacgagggcagccccagcccccccgagcccaccggcaagggcagcctggacaccatgctgggcctgctgcagagcgacctgagcagaagaggcgtgcccacccaggccaagggcctgtgcggcagctgcaacaagcccatcgccggccaggtggtgaccgccctgggcagagcctggcaccccgagcacttcgtgtgcggcggctgcagcaccgccctgggcggcagcagcttcttcgagaaggacggcgcccccttctgccccgagtgctacttcgagagattcagccccagatgcggcttctgcaaccagcccatcagacacaagatggtgaccgccctgggcacccactggcaccccgagcacttctgctgcgtgagctgcggcgagcccttcggcgacgagggcttccacgagagagagggcagaccctactgcagaagagacttcctgcagctgttcgcccccagatgccagggctgccagggccccatcctggacaactacatcagcgccctgagcgccctgtggcaccccgactgcttcgtgtgcagagagtgcttcgcccccttcagcggcggcagcttcttcgagcacgagggcagacccctgtgcgagaaccacttccacgccagaagaggcagcctgtgcgccacctgcggcctgcccgtgaccggcagatgcgtgagcgccctgggcagaagattccaccccgaccacttcacctgcaccttctgcctgagacccctgaccaagggcagcttccaggagagagccggcaagccctactgccagccctgcttcctgaagctgttcggctag

SEQ ID NO: 13298 - DNA, 783 bp, Artificial Sequence
  Description of Artificial Sequence: Synthetic coding sequence
atggtgtggcccgccctgtgggagctgtacagagagctgggcctgttccagggccccgccctgggcctgagaaaccacctgggcagaaagctgagaagaagaaagaagaagaaggccaagagaaccaccaactggaagatcatcaccgacagacccggcttccacgacgagagcgccatctaccccgtgggctactgcagcaccagaatctacgccagcatgaagtgccccgaccagaagtgcctgtacacctgccagatcaaggacggcggcgtgcagccccagttcgagatcgtgcccgaggacgacccccagaacgccatcgtgagcagcagcgccgacgcctgccacgccgagctgctgagaaccatcagcaccaccatgggcaagctgatgcccaacctgctgcccgccggcgccgacttcttcggcttcagccaccccgccatccacaacctgatccagagctgccccggcgccagaaagtgcatcaactaccagtgggtgaagttcgacgtgtgcaagcccggcgacggccagctgcccgagggcctgcccgagaacgacgccgccatgagcttcgaggccttccagagacagatcttcgacgaggaccagaacgaccccctgctgcccggcagcctggacctgcccgagctgcagcccgccgccttcgtgagcagctaccagcccatgtacctgacccacgagcccctggtggacacccacctgcagcacctgaagagccccagccagggcagccccatccagagcagcgactag

SEQ ID NO: 13299 - DNA, 1236 bp, Artificial Sequence
  Description of Artificial Sequence: Synthetic coding sequence
atgagcctgctggacggcctggccagcagccccagagcccccctgcagagcagcaaggccagaatgaagaagctgcccaagaagagccagaacgagaagtacagactgaagtacctgagactgagaaaggccgccaaggccaccgtgttcgagaacgccgccatctgcgacgagatcgccagactggaggagaagttcctgaaggccaaggaggagagaagatacctgctgaagaagctgctgcagctgcaggccctgaccgagggcgaggtgcaggccgccgcccccagccacagcagcagcctgcccctgacctacggcgtggccagcagcgtgggcaccatccagggcgccggccccatcagcggccccagcaccggcgccgaggagcccttcggcaagaagaccaagaaggagaagaaggagaagggcaaggagaacaacaagctggaggtgctgaagaagacctgcaagaagaagaagatggccggcggcgccagaaagctggtgcagcccatcgccctggaccccagcggcagacccgtgttccccatcggcctgggcggcctgaccgtgtacagcctgggcgagatcatcaccgacagacccggcttccacgacgagagcgccatctaccccgtgggctactgcagcaccagaatctacgccagcatgaagtgccccgaccagaagtgcctgtacacctgccagatcaaggacggcggcgtgcagccccagttcgagatcgtgcccgaggacgacccccagaacgccatcgtgagcagcagcgccgacgcctgccacgccgagctgctgagaaccatcagcaccaccatgggcaagctgatgcccaacctgctgcccgccggcgccgacttcttcggcttcagccaccccgccatccacaacctgatccagagctgccccggcgccagaaagtgcatcaactaccagtgggtgaagttcgacgtgtgcaagcccggcgacggccagctgcccgagggcctgcccgagaacgacgccgccatgagcttcgaggccttccagagacagatcttcgacgaggaccagaacgaccccctgctgcccggcagcctggacctgcccgagctgcagcccgccgccttcgtgagcagctaccagcccatgtacctgacccacgagcccctggtggacacccacctgcagcacctgaagagccccagccagggcagccccatccagagcagcgactag

SEQ ID NO: 13300 - DNA, 1281 bp, Artificial Sequence
  Description of Artificial Sequence: Synthetic coding sequence
atggaggccgccgtggccgcccccagacccagactgctgctgctggtgctggccgccgccgccgccgccgccgccgccctgctgcccggcgccaccgccctgcagtgcttctgccacctgtgcaccaaggacaacttcacctgcgtgaccgacggcctgtgcttcgtgagcgtgaccgagaccaccgacaaggtgatccacaacagcatgtgcatcgccgagatcgacctgatccccagagacagacccttcgtgtgcgcccccagcagcaagaccggcagcgtgaccaccacctactgctgcaaccaggaccactgcaacaagatcgagctgcccaccaccggcctgcccctgctggtgcagagaaccatcgccagaaccatcgtgctgcaggagagcatcggcaagggcagattcggcgaggtgtggagaggcaagtggagaggcgaggaggtggccgtgaagatcttcagcagcagagaggagagaagctggttcagagaggccgagatctaccagaccgtgatgctgagacacgagaacatcctgggcttcatcgccgccgacaacaaggacaacggcacctggacccagctgtggctggtgagcgactaccacgagcacggcagcctgttcgactacctgaacagatacaccgtgaccgtggagggcatgatcaagctggccctgagcaccgccagcggcctggcccacctgcacatggagatcgtgggcacccagggcaagcccgccatcgcccacagagacctgaagagcaagaacatcctggtgaagaagaacggcacctgctgcatcgccgacctgggcctggccgtgagacacgacagcgccaccgacaccatcgacatcgcccccaaccacagagtgggcaccaagagatacatggcccccgaggtgctggacgacagcatcaacatgaagcacttcgagagcttcaagagagccgacatctacgccatgggcctggtgttctgggagatcgccagaagatgcagcatcggcggcatccacgaggactaccagctgccctactacgacctggtgcccagcgaccccagcgtggaggagatgagaaaggtggtgtgcgagcagaagctgagacccaacatccccaacagatggcagagctgcgaggccctgagagtgatggccaagatcatgagagagtgctggtacgccaacggcgccgccagactgaccgccctgagaatcaagaagaccctgagccagctgagccagcaggagggcatcaagatgtag

SEQ ID NO: 13301 - DNA, 1512 bp, Artificial Sequence
  Description of Artificial Sequence: Synthetic coding sequence
atggaggccgccgtggccgcccccagacccagactgctgctgctggtgctggccgccgccgccgccgccgccgccgccctgctgcccggcgccaccgccctgcagtgcttctgccacctgtgcaccaaggacaacttcacctgcgtgaccgacggcctgtgcttcgtgagcgtgaccgagaccaccgacaaggtgatccacaacagcatgtgcatcgccgagatcgacctgatccccagagacagacccttcgtgtgcgcccccagcagcaagaccggcagcgtgaccaccacctactgctgcaaccaggaccactgcaacaagatcgagctgcccaccaccgtgaagagcagccccggcctgggccccgtggagctggccgccgtgatcgccggccccgtgtgcttcgtgtgcatcagcctgatgctgatggtgtacatctgccacaacagaaccgtgatccaccacagagtgcccaacgaggaggaccccagcctggacagacccttcatcagcgagggcaccaccctgaaggacctgatctacgacatgaccaccagcggcagcggcagcggcctgcccctgctggtgcagagaaccatcgccagaaccatcgtgctgcaggagagcatcggcaagggcagattcggcgaggtgtggagaggcaagtggagaggcgaggaggtggccgtgaagatcttcagcagcagagaggagagaagctggttcagagaggccgagatctaccagaccgtgatgctgagacacgagaacatcctgggcttcatcgccgccgacaacaaggacaacggcacctggacccagctgtggctggtgagcgactaccacgagcacggcagcctgttcgactacctgaacagatacaccgtgaccgtggagggcatgatcaagctggccctgagcaccgccagcggcctggcccacctgcacatggagatcgtgggcacccagggcaagcccgccatcgcccacagagacctgaagagcaagaacatcctggtgaagaagaacggcacctgctgcatcgccgacctgggcctggccgtgagacacgacagcgccaccgacaccatcgacatcgcccccaaccacagagtgggcaccaagagatacatggcccccgaggtgctggacgacagcatcaacatgaagcacttcgagagcttcaagagagccgacatctacgccatgggcctggtgttctgggagatcgccagaagatgcagcatcggcggcatccacgaggactaccagctgccctactacgacctggtgcccagcgaccccagcgtggaggagatgagaaaggtggtgtgcgagcagaagctgagacccaacatccccaacagatggcagagctgcgaggccctgagagtgatggccaagatcatgagagagtgctggtacgccaacggcgccgccagactgaccgccctgagaatcaagaagaccctgagccagctgagccagcaggagggcatcaagatgtag

SEQ ID NO: 13302 - DNA, 1398 bp, Artificial Sequence
  Description of Artificial Sequence: Synthetic coding sequence
atggaggccgccgtggccgcccccagacccagactgctgctgctggtgctggccgccgccgccgccgccgccgccgccctgctgcccggcgccaccgccctgcagtgcttctgccacctgtgcaccaaggacaacttcacctgcgtgaccgacggcctgtgcttcgtgagcgtgaccgagaccaccgacaaggtgatccacaacagcatgtgcatcgccgagatcgacctgatccccagagacagacccttcgtgtgcgcccccagcagcaagaccggcagcgtgaccaccacctactgctgcaaccaggaccactgcaacaagatcgagctgcccaccaccgtgaagagcagccccggcctgggccccgtggagctggccgccgtgatcgccggccccgtgtgcttcgtgtgcatcagcctgatgctgatggtgtacatctgccacaacagaaccgtgatccaccacagagtgcccaacgaggaggaccccagcctggacagacccttcatcagcgagggcaccaccctgaaggacctgatctacgacatgaccaccagcggcagcggcagcggcctgcccctgctggtgcagagaaccatcgccagaaccatcgtgctgcaggagagcatcggcaagggcagattcggcgaggtgtggagaggcaagtggagaggcgaggaggtggccgtgaagatcttcagcagcagagaggagagaagctggttcagagaggccgagatctaccagaccgtgatgctgagacacgagaacatcctgggcttcatcgccgccgacaacaaggacaacggcacctggacccagctgtggctggtgagcgactaccacgagcacggcagcctgttcgactacctgaacagatacaccgtgaccgtggagggcatgatcaagctggccctgagcaccgccagcggcctggcccacctgcacatggagatcgtgggcacccagggcaagcccgccatcgcccccaaccacagagtgggcaccaagagatacatggcccccgaggtgctggacgacagcatcaacatgaagcacttcgagagcttcaagagagccgacatctacgccatgggcctggtgttctgggagatcgccagaagatgcagcatcggcggcatccacgaggactaccagctgccctactacgacctggtgcccagcgaccccagcgtggaggagatgagaaaggtggtgtgcgagcagaagctgagacccaacatccccaacagatggcagagctgcgaggccctgagagtgatggccaagatcatgagagagtgctggtacgccaacggcgccgccagactgaccgccctgagaatcaagaagaccctgagccagctgagccagcaggagggcatcaagatgtag

SEQ ID NO: 13303 - DNA, 216 bp, Artificial Sequence
  Description of Artificial Sequence: Synthetic coding sequence
atggaggccgccgtggccgcccccagacccagactgctgctggccagcaccagcctgcagtgcttctgccacctgtgcaccaaggacaacttcacctgcgtgaccgacggcctgtgcttcgtgagcgtgaccgagaccaccgacaaggtgatccacaacagcatgtgcatcgccgagatcgacctgatccccagagacagacccttcgtgtgctag

SEQ ID NO: 13304 - DNA, 1305 bp, Artificial Sequence
  Description of Artificial Sequence: Synthetic coding sequence
atgtgcatcgccgagatcgacctgatccccagagacagacccttcgtgtgcgcccccagcagcaagaccggcagcgtgaccaccacctactgctgcaaccaggaccactgcaacaagatcgagctgcccaccaccgtgaagagcagccccggcctgggccccgtggagctggccgccgtgatcgccggccccgtgtgcttcgtgtgcatcagcctgatgctgatggtgtacatctgccacaacagaaccgtgatccaccacagagtgcccaacgaggaggaccccagcctggacagacccttcatcagcgagggcaccaccctgaaggacctgatctacgacatgaccaccagcggcagcggcagcggcctgcccctgctggtgcagagaaccatcgccagaaccatcgtgctgcaggagagcatcggcaagggcagattcggcgaggtgtggagaggcaagtggagaggcgaggaggtggccgtgaagatcttcagcagcagagaggagagaagctggttcagagaggccgagatctaccagaccgtgatgctgagacacgagaacatcctgggcttcatcgccgccgacaacaaggacaacggcacctggacccagctgtggctggtgagcgactaccacgagcacggcagcctgttcgactacctgaacagatacaccgtgaccgtggagggcatgatcaagctggccctgagcaccgccagcggcctggcccacctgcacatggagatcgtgggcacccagggcaagcccgccatcgcccacagagacctgaagagcaagaacatcctggtgaagaagaacggcacctgctgcatcgccgacctgggcctggccgtgagacacgacagcgccaccgacaccatcgacatcgcccccaaccacagagtgggcaccaagagatacatggcccccgaggtgctggacgacagcatcaacatgaagcacttcgagagcttcaagagagccgacatctacgccatgggcctggtgttctgggagatcgccagaagatgcagcatcggcggcatccacgaggactaccagctgccctactacgacctggtgcccagcgaccccagcgtggaggagatgagaaaggtggtgtgcgagcagaagctgagacccaacatccccaacagatggcagagctgcgaggccctgagagtgatggccaagatcatgagagagtgctggtacgccaacggcgccgccagactgaccgccctgagaatcaagaagaccctgagccagctgagccagcaggagggcatcaagatgtag

SEQ ID NO: 13305 - DNA, 411 bp, Artificial Sequence
  Description of Artificial Sequence: Synthetic coding sequence
atgaaggacagcaacagatgctgctgcggccagttcaccaaccagcacatcccccccctgcccagcgccacccccagcaagaacgaggaggagagcaagcaggtggagacccagcccgagaagtggagcgtggccaagcacacccagagctaccccaccgacagctacggcgtgctggagttccagggcggcggctacagcaacaaggccatggtgagaaaggccttcagacacggcgccaccagaatcaccgccttcatcggcggccagagccccagccccaagctgcagatccccggcctgctgcacggctgcggcagcatcttcctggacatcagcctgaagaaccaggagatctacctgtgcacctggctgctggccatgagactgggcaactggacccccctgtag

SEQ ID NO: 13306 - DNA, 4878 bp, Artificial Sequence
  Description of Artificial Sequence: Synthetic coding sequence
atgggccagaagagctggatcgagaagaccttctgcaagagagagtgcatcttcgtgatccccagcatgaaggacagcaacagatgctgctgcggccagttcaccaaccagcacatcccccccctgcccagcgccacccccagcaagaacgaggaggagagcaagcaggtggagacccagcccgagaagtggagcgtggccaagcacacccagagctaccccaccgacagctacggcgtgctggagttccagggcggcggctacagcaacaaggccatgtacatcagagtgagctacgacaccaagcccgacagcctgctgcacctgatggtgaaggactggcagctggagctgcccaagctgctgatcagcgtgcacggcggcctgcagaacttcgagatgcagcccaagctgaagcaggtgttcggcaagggcctgatcaaggccgccatgaccaccggcgcctggatcttcaccggcggcgtgagcaccggcgtgatcagccacgtgggcgacgccctgaaggaccacagcagcaagagcagaggcagagtgtgcgccatcggcatcgccccctggggcatcgtggagaacaaggaggacctggtgggcaaggacgtgaccagagtgtaccagaccatgagcaaccccctgagcaagctgagcgtgctgaacaacagccacacccacttcatcctggccgacaacggcaccctgggcaagtacggcgccgaggtgaagctgagaagactgctggagaagcacatcagcctgcagaagatcaacaccagactgggccagggcgtgcccctggtgggcctggtggtggagggcggccccaacgtggtgagcatcgtgctggagtacctgcaggaggagccccccatccccgtggtgatctgcgacggcagcggcagagccagcgacatcctgagcttcgcccacaagtactgcgaggagggcggcatcatcaacgagagcctgagagagcagctgctggtgaccatccagaagaccttcaactacaacaaggcccagagccaccagctgttcgccatcatcatggagtgcatgaagaagaaggagctggtgaccgtgttcagaatgggcagcgagggccagcaggacatcgagatggccatcctgaccgccctgctgaagggcaccaacgtgagcgcccccgaccagctgagcctggccctggcctggaacagagtggacatcgccagaagccagatcttcgtgttcggcccccactggccccccctgggcagcctggccccccccaccgacagcaaggccaccgagaaggagaagaagccccccatggccaccaccaagggcggcagaggcaagggcaagggcaagaagaagggcaaggtgaaggaggaggtggaggaggagaccgaccccagaaagatcgagctgctgaactgggtgaacgccctggagcaggccatgctggacgccctggtgctggacagagtggacttcgtgaagctgctgatcgagaacggcgtgaacatgcagcacttcctgaccatccccagactggaggagctgtacaacaccagactgggcccccccaacaccctgcacctgctggtgagagacgtgaagaagagcaacctgccccccgactaccacatcagcctgatcgacatcggcctggtgctggagtacctgatgggcggcgcctacagatgcaactacaccagaaagaacttcagaaccctgtacaacaacctgttcggccccaagagacccaaggccctgaagctgctgggcatggaggacgacgagccccccgccaagggcaagaagaagaagaagaagaagaaggaggaggagatcgacatcgacgtggacgaccccgccgtgagcagattccagtaccccttccacgagctgatggtgtgggccgtgctgatgaagagacagaagatggccgtgttcctgtggcagagaggcgaggagagcatggccaaggccctggtggcctgcaagctgtacaaggccatggcccacgagagcagcgagagcgacctggtggacgacatcagccaggacctggacaacaacagcaaggacttcggccagctggccctggagctgctggaccagagctacaagcacgacgagcagatcgccatgaagctgctgacctacgagctgaagaactggagcaacagcacctgcctgaagctggccgtggccgccaagcacagagacttcatcgcccacacctgcagccagatgctgctgaccgacatgtggatgggcagactgagaatgagaaagaaccccggcctgaaggtgatcatgggcatcctgctgccccccaccatcctgttcctggagttcagaacctacgacgacttcagctaccagaccagcaaggagaacgaggacggcaaggagaaggaggaggagaacaccgacgccaacgccgacgccggcagcagaaagggcgacgaggagaacgagcacaagaagcagagaagcatccccatcggcaccaagatctgcgagttctacaacgcccccatcgtgaagttctggttctacaccatcagctacctgggctacctgctgctgttcaactacgtgatcctggtgagaatggacggctggcccagcctgcaggagtggatcgtgatcagctacatcgtgagcctggccctggagaagatcagagagatcctgatgagcgagcccggcaagctgagccagaagatcaaggtgtggctgcaggagtactggaacatcaccgacctggtggccatcagcaccttcatgatcggcgccatcctgagactgcagaaccagccctacatgggctacggcagagtgatctactgcgtggacatcatcttctggtacatcagagtgctggacatcttcggcgtgaacaagtacctgggcccctacgtgatgatgatcggcaagatgatgatcgacatgctgtacttcgtggtgatcatgctggtggtgctgatgagcttcggcgtggccagacaggccatcctgcaccccgaggagaagcccagctggaagctggccagaaacatcttctacatgccctactggatgatctacggcgaggtgttcgccgaccagatcgacctgtacgccatggagatcaaccccccctgcggcgagaacctgtacgacgaggagggcaagagactgcccccctgcatccccggcgcctggctgacccccgccctgatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgacagacccgtgctgcccccccccatgatcatcctgagccacatctacatcatcatcatgagactgagcggcagatgcagaaagaagagagagggcgaccaggaggagagagacagaggcctgaagctgttcctgagcgacgaggagctgaagagactgcacgagttcgaggagcagtgcgtgcaggagcacttcagagagaaggaggacgagcagcagagcagcagcgacgagagaatcagagtgaccagcgagagagtggagaacatgagcatgagactggaggagatcaacgagagagagaccttcatgaagaccagcctgcagaccgtggacctgagactggcccagctggaggagctgagcaacagaatggtgaacgccctggagaacctggccggcatcgacagaagcgacctgatccaggccagaagcagagccagcagcgagtgcgaggccacctacctgctgagacagagcagcatcaacagcgccgacggctacagcctgtacagataccacttcaacggcgaggagctgctgttcgaggacaccagcctgagcaccagccccggcaccggcgtgagaaagaagacctgcagcttcagaatcaaggaggagaaggacgtgaagacccacctggtgcccgagtgccagaacagcctgcacctgagcctgggcaccagcaccagcgccacccccgacggcagccacctggccgtggacgacctgaagaacgccgaggagagcaagctgggccccgacatcggcatcagcaaggaggacgacgagagacagaccgacagcaagaaggaggagaccatcagccccagcctgaacaagaccgacgtgatccacggccaggacaagagcgacgtgcagaacacccagctgaccgtggagaccaccaacatcgagggcaccatcagctaccccctggaggagaccaagatcaccagatacttccccgacgagaccatcaacgcctgcaagaccatgaagagcagaagcttcgtgtacagcagaggcagaaagctggtgggcggcgtgaaccaggacgtggagtacagcagcatcaccgaccagcagctgaccaccgagtggcagtgccaggtgcagaagatcaccagaagccacagcaccgacatcccctacatcgtgagcgaggccgccgtgcaggccgagcacaaggagcagttcgccgacatgcaggacgagcaccacgtggccgaggccatccccagaatccccagactgagcctgaccatcaccgacagaaacggcatggagaacctgctgagcgtgaagcccgaccagaccctgggcttccccagcctgagaagcaagagcctgcacggccaccccagaaacgtgaagagcatccagggcaagctggacagaagcggccacgccagcagcgtgagcagcctggtgatcgtgagcggcatgaccgccgaggagaagaaggtgaagaaggagaaggccagcaccgagaccgagtgctag

SEQ ID NO: 13307 - DNA, 4812 bp, Artificial Sequence
  Description of Artificial Sequence: Synthetic coding sequence
atcaagaccagcaagagatgctgctgcggccagttcaccaaccagcacatcccccccctgcccagcgccacccccagcaagaacgaggaggagagcaagcaggtggagacccagcccgagaagtggagcgtggccaagcacacccagagctaccccaccgacagctacggcgtgctggagttccagggcggcggctacagcaacaaggccatgtacatcagagtgagctacgacaccaagcccgacagcctgctgcacctgatggtgaaggactggcagctggagctgcccaagctgctgatcagcgtgcacggcggcctgcagaacttcgagatgcagcccaagctgaagcaggtgttcggcaagggcctgatcaaggccgccatgaccaccggcgcctggatcttcaccggcggcgtgagcaccggcgtgatcagccacgtgggcgacgccctgaaggaccacagcagcaagagcagaggcagagtgtgcgccatcggcatcgccccctggggcatcgtggagaacaaggaggacctggtgggcaaggacgtgaccagagtgtaccagaccatgagcaaccccctgagcaagctgagcgtgctgaacaacagccacacccacttcatcctggccgacaacggcaccctgggcaagtacggcgccgaggtgaagctgagaagactgctggagaagcacatcagcctgcagaagatcaacaccagactgggccagggcgtgcccctggtgggcctggtggtggagggcggccccaacgtggtgagcatcgtgctggagtacctgcaggaggagccccccatccccgtggtgatctgcgacggcagcggcagagccagcgacatcctgagcttcgcccacaagtactgcgaggagggcggcatcatcaacgagagcctgagagagcagctgctggtgaccatccagaagaccttcaactacaacaaggcccagagccaccagctgttcgccatcatcatggagtgcatgaagaagaaggagctggtgaccgtgttcagaatgggcagcgagggccagcaggacatcgagatggccatcctgaccgccctgctgaagggcaccaacgtgagcgcccccgaccagctgagcctggccctggcctggaacagagtggacatcgccagaagccagatcttcgtgttcggcccccactggccccccctgggcagcctggccccccccaccgacagcaaggccaccgagaaggagaagaagccccccatggccaccaccaagggcggcagaggcaagggcaagggcaagaagaagggcaaggtgaaggaggaggtggaggaggagaccgaccccagaaagatcgagctgctgaactgggtgaacgccctggagcaggccatgctggacgccctggtgctggacagagtggacttcgtgaagctgctgatcgagaacggcgtgaacatgcagcacttcctgaccatccccagactggaggagctgtacaacaccagactgggcccccccaacaccctgcacctgctggtgagagacgtgaagaagagcaacctgccccccgactaccacatcagcctgatcgacatcggcctggtgctggagtacctgatgggcggcgcctacagatgcaactacaccagaaagaacttcagaaccctgtacaacaacctgttcggccccaagagacccaaggccctgaagctgctgggcatggaggacgacgagccccccgccaagggcaagaagaagaagaagaagaagaaggaggaggagatcgacatcgacgtggacgaccccgccgtgagcagattccagtaccccttccacgagctgatggtgtgggccgtgctgatgaagagacagaagatggccgtgttcctgtggcagagaggcgaggagagcatggccaaggccctggtggcctgcaagctgtacaaggccatggcccacgagagcagcgagagcgacctggtggacgacatcagccaggacctggacaacaacagcaaggacttcggccagctggccctggagctgctggaccagagctacaagcacgacgagcagatcgccatgaagctgctgacctacgagctgaagaactggagcaacagcacctgcctgaagctggccgtggccgccaagcacagagacttcatcgcccacacctgcagccagatgctgctgaccgacatgtggatgggcagactgagaatgagaaagaaccccggcctgaaggtgatcatgggcatcctgctgccccccaccatcctgttcctggagttcagaacctacgacgacttcagctaccagaccagcaaggagaacgaggacggcaaggagaaggaggaggagaacaccgacgccaacgccgacgccggcagcagaaagggcgacgaggagaacgagcacaagaagcagagaagcatccccatcggcaccaagatctgcgagttctacaacgcccccatcgtgaagttctggttctacaccatcagctacctgggctacctgctgctgttcaactacgtgatcctggtgagaatggacggctggcccagcctgcaggagtggatcgtgatcagctacatcgtgagcctggccctggagaagatcagagagatcctgatgagcgagcccggcaagctgagccagaagatcaaggtgtggctgcaggagtactggaacatcaccgacctggtggccatcagcaccttcatgatcggcgccatcctgagactgcagaaccagccctacatgggctacggcagagtgatctactgcgtggacatcatcttctggtacatcagagtgctggacatcttcggcgtgaacaagtacctgggcccctacgtgatgatgatcggcaagatgatgatcgacatgctgtacttcgtggtgatcatgctggtggtgctgatgagcttcggcgtggccagacaggccatcctgcaccccgaggagaagcccagctggaagctggccagaaacatcttctacatgccctactggatgatctacggcgaggtgttcgccgaccagatcgacctgtacgccatggagatcaaccccccctgcggcgagaacctgtacgacgaggagggcaagagactgcccccctgcatccccggcgcctggctgacccccgccctgatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgacagacccgtgctgcccccccccatgatcatcctgagccacatctacatcatcatcatgagactgagcggcagatgcagaaagaagagagagggcgaccaggaggagagagacagaggcctgaagctgttcctgagcgacgaggagctgaagagactgcacgagttcgaggagcagtgcgtgcaggagcacttcagagagaaggaggacgagcagcagagcagcagcgacgagagaatcagagtgaccagcgagagagtggagaacatgagcatgagactggaggagatcaacgagagagagaccttcatgaagaccagcctgcagaccgtggacctgagactggcccagctggaggagctgagcaacagaatggtgaacgccctggagaacctggccggcatcgacagaagcgacctgatccaggccagaagcagagccagcagcgagtgcgaggccacctacctgctgagacagagcagcatcaacagcgccgacggctacagcctgtacagataccacttcaacggcgaggagctgctgttcgaggacaccagcctgagcaccagccccggcaccggcgtgagaaagaagacctgcagcttcagaatcaaggaggagaaggacgtgaagacccacctggtgcccgagtgccagaacagcctgcacctgagcctgggcaccagcaccagcgccacccccgacggcagccacctggccgtggacgacctgaagaacgccgaggagagcaagctgggccccgacatcggcatcagcaaggaggacgacgagagacagaccgacagcaagaaggaggagaccatcagccccagcctgaacaagaccgacgtgatccacggccaggacaagagcgacgtgcagaacacccagctgaccgtggagaccaccaacatcgagggcaccatcagctaccccctggaggagaccaagatcaccagatacttccccgacgagaccatcaacgcctgcaagaccatgaagagcagaagcttcgtgtacagcagaggcagaaagctggtgggcggcgtgaaccaggacgtggagtacagcagcatcaccgaccagcagctgaccaccgagtggcagtgccaggtgcagaagatcaccagaagccacagcaccgacatcccctacatcgtgagcgaggccgccgtgcaggccgagcacaaggagcagttcgccgacatgcaggacgagcaccacgtggccgaggccatccccagaatccccagactgagcctgaccatcaccgacagaaacggcatggagaacctgctgagcgtgaagcccgaccagaccctgggcttccccagcctgagaagcaagagcctgcacggccaccccagaaacgtgaagagcatccagggcaagctggacagaagcggccacgccagcagcgtgagcagcctggtgatcgtgagcggcatgaccgccgaggagaagaaggtgaagaaggagaaggccagcaccgagaccgagtgctag

SEQ ID NO: 13308 - DNA, 4812 bp, Artificial Sequence
  Description of Artificial Sequence: Synthetic coding sequence
atgaaggacagcaacagatgctgctgcggccagttcaccaaccagcacatcccccccctgcccagcgccacccccagcaagaacgaggaggagagcaagcaggtggagacccagcccgagaagtggagcgtggccaagcacacccagagctaccccaccgacagctacggcgtgctggagttccagggcggcggctacagcaacaaggccatgtacatcagagtgagctacgacaccaagcccgacagcctgctgcacctgatggtgaaggactggcagctggagctgcccaagctgctgatcagcgtgcacggcggcctgcagaacttcgagatgcagcccaagctgaagcaggtgttcggcaagggcctgatcaaggccgccatgaccaccggcgcctggatcttcaccggcggcgtgagcaccggcgtgatcagccacgtgggcgacgccctgaaggaccacagcagcaagagcagaggcagagtgtgcgccatcggcatcgccccctggggcatcgtggagaacaaggaggacctggtgggcaaggacgtgaccagagtgtaccagaccatgagcaaccccctgagcaagctgagcgtgctgaacaacagccacacccacttcatcctggccgacaacggcaccctgggcaagtacggcgccgaggtgaagctgagaagactgctggagaagcacatcagcctgcagaagatcaacaccagactgggccagggcgtgcccctggtgggcctggtggtggagggcggccccaacgtggtgagcatcgtgctggagtacctgcaggaggagccccccatccccgtggtgatctgcgacggcagcggcagagccagcgacatcctgagcttcgcccacaagtactgcgaggagggcggcatcatcaacgagagcctgagagagcagctgctggtgaccatccagaagaccttcaactacaacaaggcccagagccaccagctgttcgccatcatcatggagtgcatgaagaagaaggagctggtgaccgtgttcagaatgggcagcgagggccagcaggacatcgagatggccatcctgaccgccctgctgaagggcaccaacgtgagcgcccccgaccagctgagcctggccctggcctggaacagagtggacatcgccagaagccagatcttcgtgttcggcccccactggccccccctgggcagcctggccccccccaccgacagcaaggccaccgagaaggagaagaagccccccatggccaccaccaagggcggcagaggcaagggcaagggcaagaagaagggcaaggtgaaggaggaggtggaggaggagaccgaccccagaaagatcgagctgctgaactgggtgaacgccctggagcaggccatgctggacgccctggtgctggacagagtggacttcgtgaagctgctgatcgagaacggcgtgaacatgcagcacttcctgaccatccccagactggaggagctgtacaacaccagactgggcccccccaacaccctgcacctgctggtgagagacgtgaagaagagcaacctgccccccgactaccacatcagcctgatcgacatcggcctggtgctggagtacctgatgggcggcgcctacagatgcaactacaccagaaagaacttcagaaccctgtacaacaacctgttcggccccaagagacccaaggccctgaagctgctgggcatggaggacgacgagccccccgccaagggcaagaagaagaagaagaagaagaaggaggaggagatcgacatcgacgtggacgaccccgccgtgagcagattccagtaccccttccacgagctgatggtgtgggccgtgctgatgaagagacagaagatggccgtgttcctgtggcagagaggcgaggagagcatggccaaggccctggtggcctgcaagctgtacaaggccatggcccacgagagcagcgagagcgacctggtggacgacatcagccaggacctggacaacaacagcaaggacttcggccagctggccctggagctgctggaccagagctacaagcacgacgagcagatcgccatgaagctgctgacctacgagctgaagaactggagcaacagcacctgcctgaagctggccgtggccgccaagcacagagacttcatcgcccacacctgcagccagatgctgctgaccgacatgtggatgggcagactgagaatgagaaagaaccccggcctgaaggtgatcatgggcatcctgctgccccccaccatcctgttcctggagttcagaacctacgacgacttcagctaccagaccagcaaggagaacgaggacggcaaggagaaggaggaggagaacaccgacgccaacgccgacgccggcagcagaaagggcgacgaggagaacgagcacaagaagcagagaagcatccccatcggcaccaagatctgcgagttctacaacgcccccatcgtgaagttctggttctacaccatcagctacctgggctacctgctgctgttcaactacgtgatcctggtgagaatggacggctggcccagcctgcaggagtggatcgtgatcagctacatcgtgagcctggccctggagaagatcagagagatcctgatgagcgagcccggcaagctgagccagaagatcaaggtgtggctgcaggagtactggaacatcaccgacctggtggccatcagcaccttcatgatcggcgccatcctgagactgcagaaccagccctacatgggctacggcagagtgatctactgcgtggacatcatcttctggtacatcagagtgctggacatcttcggcgtgaacaagtacctgggcccctacgtgatgatgatcggcaagatgatgatcgacatgctgtacttcgtggtgatcatgctggtggtgctgatgagcttcggcgtggccagacaggccatcctgcaccccgaggagaagcccagctggaagctggccagaaacatcttctacatgccctactggatgatctacggcgaggtgttcgccgaccagatcgacctgtacgccatggagatcaaccccccctgcggcgagaacctgtacgacgaggagggcaagagactgcccccctgcatccccggcgcctggctgacccccgccctgatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgacagacccgtgctgcccccccccatgatcatcctgagccacatctacatcatcatcatgagactgagcggcagatgcagaaagaagagagagggcgaccaggaggagagagacagaggcctgaagctgttcctgagcgacgaggagctgaagagactgcacgagttcgaggagcagtgcgtgcaggagcacttcagagagaaggaggacgagcagcagagcagcagcgacgagagaatcagagtgaccagcgagagagtggagaacatgagcatgagactggaggagatcaacgagagagagaccttcatgaagaccagcctgcagaccgtggacctgagactggcccagctggaggagctgagcaacagaatggtgaacgccctggagaacctggccggcatcgacagaagcgacctgatccaggccagaagcagagccagcagcgagtgcgaggccacctacctgctgagacagagcagcatcaacagcgccgacggctacagcctgtacagataccacttcaacggcgaggagctgctgttcgaggacaccagcctgagcaccagccccggcaccggcgtgagaaagaagacctgcagcttcagaatcaaggaggagaaggacgtgaagacccacctggtgcccgagtgccagaacagcctgcacctgagcctgggcaccagcaccagcgccacccccgacggcagccacctggccgtggacgacctgaagaacgccgaggagagcaagctgggccccgacatcggcatcagcaaggaggacgacgagagacagaccgacagcaagaaggaggagaccatcagccccagcctgaacaagaccgacgtgatccacggccaggacaagagcgacgtgcagaacacccagctgaccgtggagaccaccaacatcgagggcaccatcagctaccccctggaggagaccaagatcaccagatacttccccgacgagaccatcaacgcctgcaagaccatgaagagcagaagcttcgtgtacagcagaggcagaaagctggtgggcggcgtgaaccaggacgtggagtacagcagcatcaccgaccagcagctgaccaccgagtggcagtgccaggtgcagaagatcaccagaagccacagcaccgacatcccctacatcgtgagcgaggccgccgtgcaggccgagcacaaggagcagttcgccgacatgcaggacgagcaccacgtggccgaggccatccccagaatccccagactgagcctgaccatcaccgacagaaacggcatggagaacctgctgagcgtgaagcccgaccagaccctgggcttccccagcctgagaagcaagagcctgcacggccaccccagaaacgtgaagagcatccagggcaagctggacagaagcggccacgccagcagcgtgagcagcctggtgatcgtgagcggcatgaccgccgaggagaagaaggtgaagaaggagaaggccagcaccgagaccgagtgctag

SEQ ID NO: 13309 - DNA, 4929 bp, Artificial Sequence
  Description of Artificial Sequence: Synthetic coding sequence
atgagcagcttcaagagaggcagcctgaagagcagcaccagcggcagccagaagggccagaagagctggatcgagaagaccttctgcaagagagagtgcatcttcgtgatccccagcatgaaggacagcaacagatgctgctgcggccagttcaccaaccagcacatcccccccctgcccagcgccacccccagcaagaacgaggaggagagcaagcaggtggagacccagcccgagaagtggagcgtggccaagcacacccagagctaccccaccgacagctacggcgtgctggagttccagggcggcggctacagcaacaaggccatgtacatcagagtgagctacgacaccaagcccgacagcctgctgcacctgatggtgaaggactggcagctggagctgcccaagctgctgatcagcgtgcacggcggcctgcagaacttcgagatgcagcccaagctgaagcaggtgttcggcaagggcctgatcaaggccgccatgaccaccggcgcctggatcttcaccggcggcgtgagcaccggcgtgatcagccacgtgggcgacgccctgaaggaccacagcagcaagagcagaggcagagtgtgcgccatcggcatcgccccctggggcatcgtggagaacaaggaggacctggtgggcaaggacgtgaccagagtgtaccagaccatgagcaaccccctgagcaagctgagcgtgctgaacaacagccacacccacttcatcctggccgacaacggcaccctgggcaagtacggcgccgaggtgaagctgagaagactgctggagaagcacatcagcctgcagaagatcaacaccagactgggccagggcgtgcccctggtgggcctggtggtggagggcggccccaacgtggtgagcatcgtgctggagtacctgcaggaggagccccccatccccgtggtgatctgcgacggcagcggcagagccagcgacatcctgagcttcgcccacaagtactgcgaggagggcggcatcatcaacgagagcctgagagagcagctgctggtgaccatccagaagaccttcaactacaacaaggcccagagccaccagctgttcgccatcatcatggagtgcatgaagaagaaggagctggtgaccgtgttcagaatgggcagcgagggccagcaggacatcgagatggccatcctgaccgccctgctgaagggcaccaacgtgagcgcccccgaccagctgagcctggccctggcctggaacagagtggacatcgccagaagccagatcttcgtgttcggcccccactggccccccctgggcagcctggccccccccaccgacagcaaggccaccgagaaggagaagaagccccccatggccaccaccaagggcggcagaggcaagggcaagggcaagaagaagggcaaggtgaaggaggaggtggaggaggagaccgaccccagaaagatcgagctgctgaactgggtgaacgccctggagcaggccatgctggacgccctggtgctggacagagtggacttcgtgaagctgctgatcgagaacggcgtgaacatgcagcacttcctgaccatccccagactggaggagctgtacaacaccagactgggcccccccaacaccctgcacctgctggtgagagacgtgaagaagagcaacctgccccccgactaccacatcagcctgatcgacatcggcctggtgctggagtacctgatgggcggcgcctacagatgcaactacaccagaaagaacttcagaaccctgtacaacaacctgttcggccccaagagacccaaggccctgaagctgctgggcatggaggacgacgagccccccgccaagggcaagaagaagaagaagaagaagaaggaggaggagatcgacatcgacgtggacgaccccgccgtgagcagattccagtaccccttccacgagctgatggtgtgggccgtgctgatgaagagacagaagatggccgtgttcctgtggcagagaggcgaggagagcatggccaaggccctggtggcctgcaagctgtacaaggccatggcccacgagagcagcgagagcgacctggtggacgacatcagccaggacctggacaacaacagcaaggacttcggccagctggccctggagctgctggaccagagctacaagcacgacgagcagatcgccatgaagctgctgacctacgagctgaagaactggagcaacagcacctgcctgaagctggccgtggccgccaagcacagagacttcatcgcccacacctgcagccagatgctgctgaccgacatgtggatgggcagactgagaatgagaaagaaccccggcctgaaggtgatcatgggcatcctgctgccccccaccatcctgttcctggagttcagaacctacgacgacttcagctaccagaccagcaaggagaacgaggacggcaaggagaaggaggaggagaacaccgacgccaacgccgacgccggcagcagaaagggcgacgaggagaacgagcacaagaagcagagaagcatccccatcggcaccaagatctgcgagttctacaacgcccccatcgtgaagttctggttctacaccatcagctacctgggctacctgctgctgttcaactacgtgatcctggtgagaatggacggctggcccagcctgcaggagtggatcgtgatcagctacatcgtgagcctggccctggagaagatcagagagatcctgatgagcgagcccggcaagctgagccagaagatcaaggtgtggctgcaggagtactggaacatcaccgacctggtggccatcagcaccttcatgatcggcgccatcctgagactgcagaaccagccctacatgggctacggcagagtgatctactgcgtggacatcatcttctggtacatcagagtgctggacatcttcggcgtgaacaagtacctgggcccctacgtgatgatgatcggcaagatgatgatcgacatgctgtacttcgtggtgatcatgctggtggtgctgatgagcttcggcgtggccagacaggccatcctgcaccccgaggagaagcccagctggaagctggccagaaacatcttctacatgccctactggatgatctacggcgaggtgttcgccgaccagatcgacctgtacgccatggagatcaaccccccctgcggcgagaacctgtacgacgaggagggcaagagactgcccccctgcatccccggcgcctggctgacccccgccctgatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgacagacccgtgctgcccccccccatgatcatcctgagccacatctacatcatcatcatgagactgagcggcagatgcagaaagaagagagagggcgaccaggaggagagagacagaggcctgaagctgttcctgagcgacgaggagctgaagagactgcacgagttcgaggagcagtgcgtgcaggagcacttcagagagaaggaggacgagcagcagagcagcagcgacgagagaatcagagtgaccagcgagagagtggagaacatgagcatgagactggaggagatcaacgagagagagaccttcatgaagaccagcctgcagaccgtggacctgagactggcccagctggaggagctgagcaacagaatggtgaacgccctggagaacctggccggcatcgacagaagcgacctgatccaggccagaagcagagccagcagcgagtgcgaggccacctacctgctgagacagagcagcatcaacagcgccgacggctacagcctgtacagataccacttcaacggcgaggagctgctgttcgaggacaccagcctgagcaccagccccggcaccggcgtgagaaagaagacctgcagcttcagaatcaaggaggagaaggacgtgaagacccacctggtgcccgagtgccagaacagcctgcacctgagcctgggcaccagcaccagcgccacccccgacggcagccacctggccgtggacgacctgaagaacgccgaggagagcaagctgggccccgacatcggcatcagcaaggaggacgacgagagacagaccgacagcaagaaggaggagaccatcagccccagcctgaacaagaccgacgtgatccacggccaggacaagagcgacgtgcagaacacccagctgaccgtggagaccaccaacatcgagggcaccatcagctaccccctggaggagaccaagatcaccagatacttccccgacgagaccatcaacgcctgcaagaccatgaagagcagaagcttcgtgtacagcagaggcagaaagctggtgggcggcgtgaaccaggacgtggagtacagcagcatcaccgaccagcagctgaccaccgagtggcagtgccaggtgcagaagatcaccagaagccacagcaccgacatcccctacatcgtgagcgaggccgccgtgcaggccgagcacaaggagcagttcgccgacatgcaggacgagcaccacgtggccgaggccatccccagaatccccagactgagcctgaccatcaccgacagaaacggcatggagaacctgctgagcgtgaagcccgaccagaccctgggcttccccagcctgagaagcaagagcctgcacggccaccccagaaacgtgaagagcatccagggcaagctggacagaagcggccacgccagcagcgtgagcagcctggtgatcgtgagcggcatgaccgccgaggagaagaaggtgaagaaggagaaggccagcaccgagaccgagtgctag

SEQ ID NO: 13310 - DNA, 4173 bp, Artificial Sequence
  Description of Artificial Sequence: Synthetic coding sequence
atgaaggacagcaacagatgctgctgcggccagttcaccaaccagcacatcccccccctgcccagcgccacccccagcaagaacgaggaggagagcaagcaggtggagacccagcccgagaagtggagcgtggccaagcacacccagagctaccccaccgacagctacggcgtgctggagttccagggcggcggctacagcaacaaggccatgtacatcagagtgagctacgacaccaagcccgacagcctgctgcacctgatggtgaaggactggcagctggagctgcccaagctgctgatcagcgtgcacggcggcctgcagaacttcgagatgcagcccaagctgaagcaggtgttcggcaagggcctgatcaaggccgccatgaccaccggcgcctggatcttcaccggcggcgtgagcaccggcgtgatcagccacgtgggcgacgccctgaaggaccacagcagcaagagcagaggcagagtgtgcgccatcggcatcgccccctggggcatcgtggagaacaaggaggacctggtgggcaaggacgtgaccagagtgtaccagaccatgagcaaccccctgagcaagctgagcgtgctgaacaacagccacacccacttcatcctggccgacaacggcaccctgggcaagtacggcgccgaggtgaagctgagaagactgctggagaagcacatcagcctgcagaagatcaacaccagactgggccagggcgtgcccctggtgggcctggtggtggagggcggccccaacgtggtgagcatcgtgctggagtacctgcaggaggagccccccatccccgtggtgatctgcgacggcagcggcagagccagcgacatcctgagcttcgcccacaagtactgcgaggagggcggcatcatcaacgagagcctgagagagcagctgctggtgaccatccagaagaccttcaactacaacaaggcccagagccaccagctgttcgccatcatcatggagtgcatgaagaagaaggagctggtgaccgtgttcagaatgggcagcgagggccagcaggacatcgagatggccatcctgaccgccctgctgaagggcaccaacgtgagcgcccccgaccagctgagcctggccctggcctggaacagagtggacatcgccagaagccagatcttcgtgttcggcccccactggccccccctgggcagcctggccccccccaccgacagcaaggccaccgagaaggagaagaagccccccatggccaccaccaagggcggcagaggcaagggcaagggcaagaagaagggcaaggtgaaggaggaggtggaggaggagaccgaccccagaaagatcgagctgctgaactgggtgaacgccctggagcaggccatgctggacgccctggtgctggacagagtggacttcgtgaagctgctgatcgagaacggcgtgaacatgcagcacttcctgaccatccccagactggaggagctgtacaacaccagactgggcccccccaacaccctgcacctgctggtgagagacgtgaagaagagcaacctgccccccgactaccacatcagcctgatcgacatcggcctggtgctggagtacctgatgggcggcgcctacagatgcaactacaccagaaagaacttcagaaccctgtacaacaacctgttcggccccaagagacccaaggccctgaagctgctgggcatggaggacgacgagccccccgccaagggcaagaagaagaagaagaagaagaaggaggaggagatcgacatcgacgtggacgaccccgccgtgagcagattccagtaccccttccacgagctgatggtgtgggccgtgctgatgaagagacagaagatggccgtgttcctgtggcagagaggcgaggagagcatggccaaggccctggtggcctgcaagctgtacaaggccatggcccacgagagcagcgagagcgacctggtggacgacatcagccaggacctggacaacaacagcaaggacttcggccagctggccctggagctgctggaccagagctacaagcacgacgagcagatcgccatgaagctgctgacctacgagctgaagaactggagcaacagcacctgcctgaagctggccgtggccgccaagcacagagacttcatcgcccacacctgcagccagatgctgctgaccgacatgtggatgggcagactgagaatgagaaagaaccccggcctgaaggtgatcatgggcatcctgctgccccccaccatcctgttcctggagttcagaacctacgacgacttcagctaccagaccagcaaggagaacgaggacggcaaggagaaggaggaggagaacaccgacgccaacgccgacgccggcagcagaaagggcgacgaggagaacgagcacaagaagcagagaagcatccccatcggcaccaagatctgcgagttctacaacgcccccatcgtgaagttctggttctacaccatcagctacctgggctacctgctgctgttcaactacgtgatcctggtgagaatggacggctggcccagcctgcaggagtggatcgtgatcagctacatcgtgagcctggccctggagaagatcagagagatcctgatgagcgagcccggcaagctgagccagaagatcaaggtgtggctgcaggagtactggaacatcaccgacctggtggccatcagcaccttcatgatcggcgccatcctgagactgcagaaccagccctacatgggctacggcagagtgatctactgcgtggacatcatcttctggtacatcagagtgctggacatcttcggcgtgaacaagtacctgggcccctacgtgatgatgatcggcaagatgatgatcgacatgctgtacttcgtggtgatcatgctggtggtgctgatgagcttcggcgtggccagacaggccatcctgcaccccgaggagaagcccagctggaagctggccagaaacatcttctacatgccctactggatgatctacggcgaggtgttcgccgaccagatcgacctgtacgccatggagatcaaccccccctgcggcgagaacctgtacgacgaggagggcaagagactgcccccctgcatccccggcgcctggctgacccccgccctgatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgacagacccgtgctgcccccccccatgatcatcctgagccacatctacatcatcatcatgagactgagcggcagatgcagaaagaagagagagggcgaccaggaggagagagacagaggcctgaagctgttcctgagcgacgaggagctgaagagactgcacgagttcgaggagcagtgcgtgcaggagcacttcagagagaaggaggacgagcagcagagcagcagcgacgagagaatcagagtgaccagcgagagagtggagaacatgagcatgagactggaggagatcaacgagagagagaccttcatgaagaccagcctgcagaccgtggacctgagactggcccagctggaggagctgagcaacagaatggtgaacgccctggagaacctggccggcatcgacagaagcgacctgatccaggccagaagcagagccagcagcgagtgcgaggccacctacctgctgagacagagcagcatcaacagcgccgacggctacagcctgtacagataccacttcaacggcgaggagctgctgttcgaggacaccagcctgagcaccagccccggcaccggcgtgagaaagaagacctgcagcttcagaatcaaggaggagaaggacgtgaagacccacctggtgcccgagtgccagaacagcctgcacctgagcctgggcaccagcaccagcgccacccccgacggcagccacctggccgtggacgacctgaagaacgccgaggagagcaagctgggccccgacatcggcatcagcaaggaggacgacgagagacagaccgacagcaagaaggaggagaccatcagccccagcctgaacaagaccgacgtgatccacggccagtag

SEQ ID NO: 13311 - DNA, 4584 bp, Artificial Sequence
  Description of Artificial Sequence: Synthetic coding sequence
atgtacatcagagtgagctacgacaccaagcccgacagcctgctgcacctgatggtgaaggactggcagctggagctgcccaagctgctgatcagcgtgcacggcggcctgcagaacttcgagatgcagcccaagctgaagcaggtgttcggcaagggcctgatcaaggccgccatgaccaccggcgcctggatcttcaccggcggcgtgagcaccggcgtgatcagccacgtgggcgacgccctgaaggaccacagcagcaagagcagaggcagagtgtgcgccatcggcatcgccccctggggcatcgtggagaacaaggaggacctggtgggcaaggacgtgaccagagtgtaccagaccatgagcaaccccctgagcaagctgagcgtgctgaacaacagccacacccacttcatcctggccgacaacggcaccctgggcaagtacggcgccgaggtgaagctgagaagactgctggagaagcacatcagcctgcagaagatcaacaccagactgggccagggcgtgcccctggtgggcctggtggtggagggcggccccaacgtggtgagcatcgtgctggagtacctgcaggaggagccccccatccccgtggtgatctgcgacggcagcggcagagccagcgacatcctgagcttcgcccacaagatcatcaacgagagcctgagagagcagctgctggtgaccatccagaagaccttcaactacaacaaggcccagagccaccagctgttcgccatcatcatggagtgcatgaagaagaaggagctggtgaccgtgttcagaatgggcagcgagggccagcaggacatcgagatggccatcctgaccgccctgctgaagggcaccaacgtgagcgcccccgaccagctgagcctggccctggcctggaacagagtggacatcgccagaagccagatcttcgtgttcggcccccactggccccccctgggcagcctggccccccccaccgacagcaaggccaccgagaaggagaagaagccccccatggccaccaccaagggcggcagaggcaagggcaagggcaagaagaagggcaaggtgaaggaggaggtggaggaggagaccgaccccagaaagatcgagctgctgaactgggtgaacgccctggagcaggccatgctggacgccctggtgctggacagagtggacttcgtgaagctgctgatcgagaacggcgtgaacatgcagcacttcctgaccatccccagactggaggagctgtacaacaccagactgggcccccccaacaccctgcacctgctggtgagagacgtgaagaagagcaacctgccccccgactaccacatcagcctgatcgacatcggcctggtgctggagtacctgatgggcggcgcctacagatgcaactacaccagaaagaacttcagaaccctgtacaacaacctgttcggccccaagagacccaaggccctgaagctgctgggcatggaggacgacgagccccccgccaagggcaagaagaagaagaagaagaagaaggaggaggagatcgacatcgacgtggacgaccccgccgtgagcagattccagtaccccttccacgagctgatggtgtgggccgtgctgatgaagagacagaagatggccgtgttcctgtggcagagaggcgaggagagcatggccaaggccctggtggcctgcaagctgtacaaggccatggcccacgagagcagcgagagcgacctggtggacgacatcagccaggacctggacaacaacagcaaggacttcggccagctggccctggagctgctggaccagagctacaagcacgacgagcagatcgccatgaagctgctgacctacgagctgaagaactggagcaacagcacctgcctgaagctggccgtggccgccaagcacagagacttcatcgcccacacctgcagccagatgctgctgaccgacatgtggatgggcagactgagaatgagaaagaaccccggcctgaaggtgatcatgggcatcctgctgccccccaccatcctgttcctggagttcagaacctacgacgacttcagctaccagaccagcaaggagaacgaggacggcaaggagaaggaggaggagaacaccgacgccaacgccgacgccggcagcagaaagggcgacgaggagaacgagcacaagaagcagagaagcatccccatcggcaccaagatctgcgagttctacaacgcccccatcgtgaagttctggttctacaccatcagctacctgggctacctgctgctgttcaactacgtgatcctggtgagaatggacggctggcccagcctgcaggagtggatcgtgatcagctacatcgtgagcctggccctggagaagatcagagagatcctgatgagcgagcccggcaagctgagccagaagatcaaggtgtggctgcaggagtactggaacatcaccgacctggtggccatcagcaccttcatgatcggcgccatcctgagactgcagaaccagccctacatgggctacggcagagtgatctactgcgtggacatcatcttctggtacatcagagtgctggacatcttcggcgtgaacaagtacctgggcccctacgtgatgatgatcggcaagatgatgatcgacatgctgtacttcgtggtgatcatgctggtggtgctgatgagcttcggcgtggccagacaggccatcctgcaccccgaggagaagcccagctggaagctggccagaaacatcttctacatgccctactggatgatctacggcgaggtgttcgccgaccagatcgacctgtacgccatggagatcaaccccccctgcggcgagaacctgtacgacgaggagggcaagagactgcccccctgcatccccggcgcctggctgacccccgccctgatggcctgctacctgctggtggccaacatcctgctggtgaacctgctgatcgccgtgttcaacaacaccttcttcgaggtgaagagcatcagcaaccaggtgtggaagttccagagataccagctgatcatgaccttccacgacagacccgtgctgcccccccccatgatcatcctgagccacatctacatcatcatcatgagactgagcggcagatgcagaaagaagagagagggcgaccaggaggagagagacagaggcctgaagctgttcctgagcgacgaggagctgaagagactgcacgagttcgaggagcagtgcgtgcaggagcacttcagagagaaggaggacgagcagcagagcagcagcgacgagagaatcagagtgaccagcgagagagtggagaacatgagcatgagactggaggagatcaacgagagagagaccttcatgaagaccagcctgcagaccgtggacctgagactggcccagctggaggagctgagcaacagaatggtgaacgccctggagaacctggccggcatcgacagaagcgacctgatccaggccagaagcagagccagcagcgagtgcgaggccacctacctgctgagacagagcagcatcaacagcgccgacggctacagcctgtacagataccacttcaacggcgaggagctgctgttcgaggacaccagcctgagcaccagccccggcaccggcgtgagaaagaagacctgcagcttcagaatcaaggaggagaaggacgtgaagacccacctggtgcccgagtgccagaacagcctgcacctgagcctgggcaccagcaccagcgccacccccgacggcagccacctggccgtggacgacctgaagaacgccgaggagagcaagctgggccccgacatcggcatcagcaaggaggacgacgagagacagaccgacagcaagaaggaggagaccatcagccccagcctgaacaagaccgacgtgatccacggccaggacaagagcgacgtgcagaacacccagctgaccgtggagaccaccaacatcgagggcaccatcagctaccccctggaggagaccaagatcaccagatacttccccgacgagaccatcaacgcctgcaagaccatgaagagcagaagcttcgtgtacagcagaggcagaaagctggtgggcggcgtgaaccaggacgtggagtacagcagcatcaccgaccagcagctgaccaccgagtggcagtgccaggtgcagaagatcaccagaagccacagcaccgacatcccctacatcgtgagcgaggccgccgtgcaggccgagcacaaggagcagttcgccgacatgcaggacgagcaccacgtggccgaggccatccccagaatccccagactgagcctgaccatcaccgacagaaacggcatggagaacctgctgagcgtgaagcccgaccagaccctgggcttccccagcctgagaagcaagagcctgcacggccaccccagaaacgtgaagagcatccagggcaagctggacagaagcggccacgccagcagcgtgagcagcctggtgatcgtgagcggcatgaccgccgaggagaagaaggtgaagaaggagaaggccagcaccgagaccgagtgctag

SEQ ID NO: 13312 - DNA, 1479 bp, Artificial Sequence
  Description of Artificial Sequence: Synthetic coding sequence
atggccctgaacagcggcagcccccccgccatcggcccctactacgagaaccacggctaccagcccgagaacccctaccccgcccagcccaccgtggtgcccaccgtgtacgaggtgcaccccgcccagtactaccccagccccgtgccccagtacgcccccagagtgctgacccaggccagcaaccccgtggtgtgcacccagcccaagagccccagcggcaccgtgtgcaccagcaagaccaagaaggccctgtgcatcaccctgaccctgggcaccttcctggtgggcgccgccctggccgccggcctgctgtggaagttcatgggcagcaagtgcagcaacagcggcatcgagtgcgacagcagcggcacctgcatcaaccccagcaactggtgcgacggcgtgagccactgccccggcggcgaggacgagaacagatgcgtgagactgtacggccccaacttcatcctgcaggtgtacagcagccagagaaagagctggcaccccgtgtgccaggacgactggaacgagaactacggcagagccgcctgcagagacatgggctacaagaacaacttctacagcagccagggcatcgtggacgacagcggcagcaccagcttcatgaagctgaacaccagcgccggcaacgtggacatctacaagaagctgtaccacagcgacgcctgcagcagcaaggccgtggtgagcctgagatgcatcgcctgcggcgtgaacctgaacagcagcagacagagcagaatcgtgggcggcgagagcgccctgcccggcgcctggccctggcaggtgagcctgcacgtgcagaacgtgcacgtgtgcggcggcagcatcatcacccccgagtggatcgtgaccgccgcccactgcgtggagaagcccctgaacaacccctggcactggaccgccttcgccggcatcctgagacagagcttcatgttctacggcgccggctaccaggtggagaaggtgatcagccaccccaactacgacagcaagaccaagaacaacgacatcgccctgatgaagctgcagaagcccctgaccttcaacgacctggtgaagcccgtgtgcctgcccaaccccggcatgatgctgcagcccgagcagctgtgctggatcagcggctggggcgccaccgaggagaagggcaagaccagcgaggtgctgaacgccgccaaggtgctgctgatcgagacccagagatgcaacagcagatacgtgtacgacaacctgatcacccccgccatgatctgcgccggcttcctgcagggcaacgtggacagctgccagggcgacagcggcggccccctggtgaccagcaagaacaacatctggtggctgatcggcgacaccagctggggcagcggctgcgccaaggcctacagacccggcgtgtacggcaacgtgatggtgttcaccgactggatctacagacagatgagagccgacggctag

SEQ ID NO: 13313 - DNA, 1590 bp, Artificial Sequence
  Description of Artificial Sequence: Synthetic coding sequence
atgccccccgccccccccggcggcgagagcggctgcgaggagagaggcgccgccggccacatcgagcacagcagatacctgagcctgctggacgccgtggacaacagcaagatggccctgaacagcggcagcccccccgccatcggcccctactacgagaaccacggctaccagcccgagaacccctaccccgcccagcccaccgtggtgcccaccgtgtacgaggtgcaccccgcccagtactaccccagccccgtgccccagtacgcccccagagtgctgacccaggccagcaaccccgtggtgtgcacccagcccaagagccccagcggcaccgtgtgcaccagcaagaccaagaaggccctgtgcatcaccctgaccctgggcaccttcctggtgggcgccgccctggccgccggcctgctgtggaagttcatgggcagcaagtgcagcaacagcggcatcgagtgcgacagcagcggcacctgcatcaaccccagcaactggtgcgacggcgtgagccactgccccggcggcgaggacgagaacagatgcgtgagactgtacggccccaacttcatcctgcaggtgtacagcagccagagaaagagctggcaccccgtgtgccaggacgactggaacgagaactacggcagagccgcctgcagagacatgggctacaagaacaacttctacagcagccagggcatcgtggacgacagcggcagcaccagcttcatgaagctgaacaccagcgccggcaacgtggacatctacaagaagctgtaccacagcgacgcctgcagcagcaaggccgtggtgagcctgagatgcatcgcctgcggcgtgaacctgaacagcagcagacagagcagaatcgtgggcggcgagagcgccctgcccggcgcctggccctggcaggtgagcctgcacgtgcagaacgtgcacgtgtgcggcggcagcatcatcacccccgagtggatcgtgaccgccgcccactgcgtggagaagcccctgaacaacccctggcactggaccgccttcgccggcatcctgagacagagcttcatgttctacggcgccggctaccaggtggagaaggtgatcagccaccccaactacgacagcaagaccaagaacaacgacatcgccctgatgaagctgcagaagcccctgaccttcaacgacctggtgaagcccgtgtgcctgcccaaccccggcatgatgctgcagcccgagcagctgtgctggatcagcggctggggcgccaccgaggagaagggcaagaccagcgaggtgctgaacgccgccaaggtgctgctgatcgagacccagagatgcaacagcagatacgtgtacgacaacctgatcacccccgccatgatctgcgccggcttcctgcagggcaacgtggacagctgccagggcgacagcggcggccccctggtgaccagcaagaacaacatctggtggctgatcggcgacaccagctggggcagcggctgcgccaaggcctacagacccggcgtgtacggcaacgtgatggtgttcaccgactggatctacagacagatgagagccgacggctag

SEQ ID NO: 13314 - DNA, 1470 bp, Artificial Sequence
  Description of Artificial Sequence: Synthetic coding sequence
atggccctgaacagcggcagcccccccgccatcggcccctactacgagaaccacggctaccagcccgagaacccctaccccgcccagcccaccgtggtgcccaccgtgtacgaggtgcaccccgcccagtactaccccagccccgtgccccagtacgcccccagagtgctgacccaggccagcaaccccgtggtgtgcacccagcccaagagccccagcggcaccgtgtgcaccagcaagaccaagaaggccctgtgcatcaccctgaccctgggcaccttcctggtgggcgccgccctggccgccggcctgctgtggaagttcatgggcagcaagtgcagcaacagcggcatcgagtgcgacagcagcggcacctgcatcaaccccagcaactggtgcgacggcgtgagccactgccccggcggcgaggacgagaacagatgcgtgagactgtacggccccaacttcatcctgcaggtgtacagcagccagagaaagagctggcaccccgtgtgccaggacgactggaacgagaactacggcagagccgcctgcagagacatgggctacaagaacaacttctacagcagccagggcatcgtggacgacagcggcagcaccagcttcatgaagctgaacaccagcgccggcaacgtggacatctacaagaagctgtaccacagcgacgcctgcagcagcaaggccgtggtgagcctgagatgcatcgcctgcggcgtgaacctgaacagcagcagacagagcagaatcgtgggcggcgagagcgccctgcccggcgcctggccctggcaggtgagcctgcacgtgcagaacgtgcacgtgtgcggcggcagcatcatcacccccgagtggatcgtgaccgccgcccactgcgtggagaagcccctgaacaacccctggcactggaccgccttcgccggcatcctgagacagagcttcatgttctacggcgccggctaccaggtggagaaggtgatcagccaccccaactacgacagcaagaccaagaacaacgacatcgccctgatgaagctgcagaagcccctgaccttcaacgacctggtgaagcccgtgtgcctgcccaaccccggcatgatgctgcagcccgagcagctgtgctggatcagcggctggggcgccaccgaggagaagggcaagaccagcgaggtgctgaacgccgccaaggtgctgctgatcgagacccagagatgcaacagcagatacgtgtacgacaacctgatcacccccgccatgatctgcgccggcttcctgcagggcaacgtggacagctgccagggcgacagcggcggccccctggtgaccagcaagaacaacatctggtggctgatcggcgacaccagctggggcagcggctgcgccaaggcctacagacccggcgtgtacggcaacgtgatggtgttcaccgactggatctacagacagatgagatag

SEQ ID NO: 13315 - DNA, 240 bp, Artificial Sequence
  Description of Artificial Sequence: Synthetic coding sequence
atggccctgaacagcggcagcccccccgccatcggcccctactacgagaaccacggctaccagcccgagaacccctaccccgcccagcccaccgtggtgcccaccgtgtacgaggtgcaccccgcccagtactaccccagccccgtgccccagtacgcccccagagtgctgacccaggccagcaaccccgtggtgtgcacccagcccaagagccccagcggcaccgtgtgcaccagctag

SEQ ID NO: 13316 - DNA, 1479 bp, Artificial Sequence; identical to SEQ ID NO: 13312
  Description of Artificial Sequence: Synthetic coding sequence

SEQ ID NO: 13317 - DNA, 717 bp, Artificial Sequence
  Description of Artificial Sequence: Synthetic coding sequence
atgtacgcccccggcggcgccggcctgcccggcggcagaagaagaagaagccccggcggcagcgccctgcccaagcagcccgagagaagcctggccagcgccctgcccggcgccctgagcatcaccgccctgtgcaccgccctggccgagcccgcctggctgcacatccacggcggcacctgcagcagacaggagctgggcgtgagcgacgtgctgggctacgtgcaccccgacctgctgaaggacttctgcatgaacccccagaccgtgctgctgctgagagtgatcgccgccttctgcttcctgggcatcctgtgcagcctgagcgccttcctgctggacgtgttcggccccaagcaccccgccctgaagatcaccagaagatacgccttcgcccacatcctgaccgtgctgcagtgcgccaccgtgatcggcttcagctactgggccagcgagctgatcctggcccagcagcagcagcacaagaagtaccacggcagccaggtgtacgtgaccttcgccgtgagcttctacctggtggccggcgccggcggcgccagcatcctggccaccgccgccaacctgctgagacactaccccaccgaggaggaggagcaggccctggagctgctgagcgagatggaggagaacgagccctaccccgccgagtacgaggtgatcaaccagttccagcccccccccgcctacaccccctag

SEQ ID NO: 13318 - DNA, 717 bp, Artificial Sequence; identical to SEQ ID NO: 13317
  Description of Artificial Sequence: Synthetic coding sequence

SEQ ID NO: 13319 - DNA, 3075 bp, Artificial Sequence
  Description of Artificial Sequence: Synthetic coding sequence
atgtgcgccagaatggccggcagaaccaccgccgcccccagaggcccctacggcccctggctgtgcctgctggtggccctggccctggacgtggtgagagtggactgcggccaggcccccctggaccccgtgtacctgcccgccgccctggagctgctggacgcccccgagcacttcagagtgcagcaggtgggccactacccccccgccaacagcagcctgagcagcagaagcgagaccttcctgctgctgcagccctggcccagagcccagcccctgctgagagccagctacccccccttcgccacccagcaggtggtgccccccagagtgaccgagccccaccagagacccgtgccctgggacgtgagagccgtgagcgtggaggccgccgtgacccccgccgagccctacgccagagtgctgttccacctgaagggccaggactggccccccggcagcggcagcctgccctgcgccagactgcacgccacccaccccgccggcaccgcccaccaggcctgcagattccagcccagcctgggcgcctgcgtggtggagctggagctgcccagccactggttcagccaggccagcaccaccagagccgagctggcctacaccctggagcccgccgccgagggccccggcggctgcggcagcggcgaggagaacgaccccggcgagcaggccctgcccgtgggcggcgtggagctgagacccgccgaccccccccagtaccaggaggtgcccctggacgaggccgtgaccctgagagtgcccgacatgcccgtgagacccggccagctgttcagcgccaccctgctgctgagacacaacttcaccgccagcctgctgaccctgagaatcaaggtgaagaagggcctgcacgtgaccgccgccagacccgcccagcccaccctgtggaccgccaagctggacagattcaagggcagcagacaccacaccaccctgatcacctgccacagagccggcctgaccgagcccgacagcagcagccccctggagctgagcgagttcctgtgggtggacttcgtggtggagaacagcaccggcggcggcgtggccgtgaccagacccgtgacctggcagctggagtaccccggccaggcccccgaggccgagaaggacaagatggtgtgggagatcctggtgagcgagagagacatcagagccctgatccccctggccaaggccgaggagctggtgaacaccgcccccctgaccggcgtgccccagcacgtgcccgtgagactggtgaccgtggacggcggcggcgccctggtggaggtgaccgagcacgtgggctgcgagagcgccaacacccaggtgctgcaggtgagcgaggcctgcgacgccgtgttcgtggccggcaaggagagcagaggcgccagaggcgtgagagtggacttctggtggagaagactgagagccagcctgagactgaccgtgtgggcccccctgctgcccctgagaatcgagctgaccgacaccaccctggagcaggtgagaggctggagagtgcccggccccgccgagggccccgccgagcccgccgccgaggccagcgacgaggccgagagaagagccagaggctgccacctgcagtaccagagagccggcgtgagattcctggcccccttcgccgcccaccccctggacggcggcagaagactgacccacctgctgggccccgactggctgctggacgtgagccacctggtggccccccacgccagagtgctggacagcagagtggccagcctggagggcggcagagtggtggtgggcagagagcccggcgtgaccagcatcgaggtgagaagccccctgagcgacagcatcctgggcgagcaggccctggccgtgaccgacgacaaggtgagcgtgctggagctgagagtgcagcccgtgatgggcatcagcctgaccctgagcagaggcaccgcccaccccggcgaggtgaccgccacctgctgggcccagagcgccctgcccgcccccaagcaggaggtggccctgagcctgtggctgagcttcagcgaccacaccgtggcccccgccgagctgtacgacagaagagacctgggcctgagcgtgagcgccgaggagcccggcgccatcctgcccgccgaggagcagggcgcccagctgggcgtggtggtgagcggcgccggcgccgagggcctgcccctgcacgtggccctgcacccccccgagccctgcagaagaggcagacacagagtgcccctggccagcggcaccgcctggctgggcctgccccccgccagcacccccgcccccgccctgcccagcagccccgcctggagcccccccgccaccgaggccaccatgggcggcaagagacaggtggccggcagcgtgggcggcaacaccggcgtgagaggcaagttcgagagagccgaggaggaggccagaaaggaggagaccgaggccagagaggaggaggaggaggaggaggaggagatggtgcccgccccccagcacgtgaccgagctggagctgggcatgtacgccctgctgggcgtgttctgcgtggccatcttcatcttcctggtgaacggcgtggtgttcgtgctgagataccagagaaaggagccccccgacagcgccaccgaccccaccagcccccagccccacaactgggtgtggctgggcaccgaccaggaggagctgagcagacagctggacagacagagccccggcccccccaagggcgagggcagctgcccctgcgagagcggcggcggcggcgaggcccccaccctggcccccggcccccccggcggcaccaccagcagcagcagcaccctggccagaaaggaggccggcggcagaagaaagagagtggagttcgtgaccttcgcccccgccccccccgcccagagccccgaggagcccgtgggcgcccccgccgtgcagagcatcctggtggccggcgaggaggacatcagatgggtgtgcgaggacatgggcctgaaggaccccgaggagctgagaaactacatggagagaatcagaggcagcagctag

SEQ ID NO: 13320 - DNA, 3072 bp, Artificial Sequence
  Description of Artificial Sequence: Synthetic coding sequence
atgtgcgccagaatggccggcagaaccaccgccgcccccagaggcccctacggcccctggctgtgcctgctggtggccctggccctggacgtggtgagagtggactgcggccaggcccccctggaccccgtgtacctgcccgccgccctggagctgctggacgcccccgagcacttcagagtgcagcaggtgggccactacccccccgccaacagcagcctgagcagcagaagcgagaccttcctgctgctgcagccctggcccagagcccagcccctgctgagagccagctacccccccttcgccacccagcaggtggtgccccccagagtgaccgagccccaccagagacccgtgccctgggacgtgagagccgtgagcgtggaggccgccgtgacccccgccgagccctacgccagagtgctgttccacctgaagggccaggactggccccccggcagcggcagcctgccctgcgccagactgcacgccacccaccccgccggcaccgcccaccaggcctgcagattccagcccagcctgggcgcctgcgtggtggagctggagctgcccagccactggttcagccaggccagcaccaccagagccgagctggcctacaccctggagcccgccgccgagggccccggcggctgcggcagcggcgaggagaacgaccccggcgagcaggccctgcccgtgggcggcgtggagctgagacccgccgaccccccccagtaccaggaggtgcccctggacgaggccgtgaccctgagagtgcccgacatgcccgtgagacccggccagctgttcagcgccaccctgctgctgagacacaacttcaccgccagcctgctgaccctgagaatcaaggtgaagaagggcctgcacgtgaccgccgccagacccgcccagcccaccctgtggaccgccaagctggacagattcaagggcagcagacaccacaccaccctgatcacctgccacagagccggcctgaccgagcccgacagcagccccctggagctgagcgagttcctgtgggtggacttcgtggtggagaacagcaccggcggcggcgtggccgtgaccagacccgtgacctggcagctggagtaccccggccaggcccccgaggccgagaaggacaagatggtgtgggagatcctggtgagcgagagagacatcagagccctgatccccctggccaaggccgaggagctggtgaacaccgcccccctgaccggcgtgccccagcacgtgcccgtgagactggtgaccgtggacggcggcggcgccctggtggaggtgaccgagcacgtgggctgcgagagcgccaacacccaggtgctgcaggtgagcgaggcctgcgacgccgtgttcgtggccggcaaggagagcagaggcgccagaggcgtgagagtggacttctggtggagaagactgagagccagcctgagactgaccgtgtgggcccccctgctgcccctgagaatcgagctgaccgacaccaccctggagcaggtgagaggctggagagtgcccggccccgccgagggccccgccgagcccgccgccgaggccagcgacgaggccgagagaagagccagaggctgccacctgcagtaccagagagccggcgtgagattcctggcccccttcgccgcccaccccctggacggcggcagaagactgacccacctgctgggccccgactggctgctggacgtgagccacctggtggccccccacgccagagtgctggacagcagagtggccagcctggagggcggcagagtggtggtgggcagagagcccggcgtgaccagcatcgaggtgagaagccccctgagcgacagcatcctgggcgagcaggccctggccgtgaccgacgacaaggtgagcgtgctggagctgagagtgcagcccgtgatgggcatcagcctgaccctgagcagaggcaccgcccaccccggcgaggtgaccgccacctgctgggcccagagcgccctgcccgcccccaagcaggaggtggccctgagcctgtggctgagcttcagcgaccacaccgtggcccccgccgagctgtacgacagaagagacctgggcctgagcgtgagcgccgaggagcccggcgccatcctgcccgccgaggagcagggcgcccagctgggcgtggtggtgagcggcgccggcgccgagggcctgcccctgcacgtggccctgcacccccccgagccctgcagaagaggcagacacagagtgcccctggccagcggcaccgcctggctgggcctgccccccgccagcacccccgcccccgccctgcccagcagccccgcctggagcccccccgccaccgaggccaccatgggcggcaagagacaggtggccggcagcgtgggcggcaacaccggcgtgagaggcaagttcgagagagccgaggaggaggccagaaaggaggagaccgaggccagagaggaggaggaggaggaggaggaggagatggtgcccgccccccagcacgtgaccgagctggagctgggcatgtacgccctgctgggcgtgttctgcgtggccatcttcatcttcctggtgaacggcgtggtgttcgtgctgagataccagagaaaggagccccccgacagcgccaccgaccccaccagcccccagccccacaactgggtgtggctgggcaccgaccaggaggagctgagcagacagctggacagacagagccccggcccccccaagggcgagggcagctgcccctgcgagagcggcggcggcggcgaggcccccaccctggcccccggcccccccggcggcaccaccagcagcagcagcaccctggccagaaaggaggccggcggcagaagaaagagagtggagttcgtgaccttcgcccccgccccccccgcccagagccccgaggagcccgtgggcgcccccgccgtgcagagcatcctggtggccggcgaggaggacatcagatgggtgtgcgaggacatgggcctgaaggaccccgaggagctgagaaactacatggagagaatcagaggcagcagctag

SEQ ID NO: 13321 - DNA, 1026 bp, Artificial Sequence
  Description of Artificial Sequence: Synthetic coding sequence
atgctgcccgagcagctgtacttcctgcagagcccccccgaggaggagcccgagtaccaccccgacgccagcgcccaggagctgaacgtgagagagagcgacgtgagagtgtgcgacgagagcagctgcaagtacggcggcgtgtgcaaggaggacggcgacggcctgaagtgcgcctgccagttccagtgccacaccaactacatccccgtgtgcggcagcaacggcgacacctaccagaacgagtgcttcctgagaagagccgcctgcaagcaccagaaggagatcaccgtgatcgccagaggcccctgctacagcgacaacggcagcggcagcggcgagggcgaggaggagggcagcggcgccgaggtgcacagaaagcacagcaagtgcggcccctgcaagtacaaggccgagtgcgacgaggacgccgagaacgtgggctgcgtgtgcaacatcgactgcagcggctacagcttcaaccccgtgtgcgccagcgacggcagcagctacaacaacccctgcttcgtgagagaggccagctgcatcaagcaggagcagatcgacatcagacacctgggccactgcaccgacaccgacgacaccagcctgctgggcaagaaggacgacggcctgcagtacagacccgacgtgaaggacgccagcgaccagagagaggacgtgtacatcggcaaccacatgccctgccccgagaacctgaacggctactgcatccacggcaagtgcgagttcatctacagcacccagaaggccagctgcagatgcgagagcggctacaccggccagcactgcgagaagaccgacttcagcatcctgtacgtggtgcccagcagacagaagctgacccacgtgctgatcgccgccatcatcggcgccgtgcagatcgccatcatcgtggccatcgtgatgtgcatcaccagaaagtgccccaagaacaacagaggcagaagacagaagcagaacctgggccacttcaccagcgacaccagcagcagaatggtgtag

SEQ ID NO: 13322 - DNA, 1143 bp, Artificial Sequence
  Description of Artificial Sequence: Synthetic coding sequence
atgggcgccgccgccgccgaggcccccctgagactgcccgccgccccccccctggccttctgctgctacaccagcgtgctgctgctgttcgccttcagcctgcccggcagcagagccagcaaccagccccccggcggcggcggcggcagcggcggcgactgccccggcggcaagggcaagagcatcaactgcagcgagctgaacgtgagagagagcgacgtgagagtgtgcgacgagagcagctgcaagtacggcggcgtgtgcaaggaggacggcgacggcctgaagtgcgcctgccagttccagtgccacaccaactacatccccgtgtgcggcagcaacggcgacacctaccagaacgagtgcttcctgagaagagccgcctgcaagcaccagaaggagatcaccgtgatcgccagaggcccctgctacagcgacaacggcagcggcagcggcgagggcgaggaggagggcagcggcgccgaggtgcacagaaagcacagcaagtgcggcccctgcaagtacaaggccgagtgcgacgaggacgccgagaacgtgggctgcgtgtgcaacatcgactgcagcggctacagcttcaaccccgtgtgcgccagcgacggcagcagctacaacaacccctgcttcgtgagagaggccagctgcatcaagcaggagcagatcgacatcagacacctgggccactgcaccgacaccgacgacaccagcctgctgggcaagaaggacgacggcctgcagtacagacccgacgtgaaggacgccagcgaccagagagaggacgtgtacatcggcaaccacatgccctgccccgagaacctgaacggctactgcatccacggcaagtgcgagttcatctacagcacccagaaggccagctgcagatgcgagagcggctacaccggccagcactgcgagaagaccgacttcagcatcctgtacgtggtgcccagcagacagaagctgacccacgtgctgatcgccgccatcatcggcgccgtgcagatcgccatcatcgtggccatcgtgatgtgcatcaccagaaagtgccccaagaacaacagaggcagaagacagaagcagaacctgggccacttcaccagcgacaccagcagcagaatggtgtag

SEQ ID NO: 13323 - DNA, 393 bp, Artificial Sequence
  Description of Artificial Sequence: Synthetic coding sequence
atgcaggagagaaccggcgccgccaccgccagaagagagagcctgccccaggccaacaaccccgagcagctgtgcaagcagagatgcatcaacgaggccagctggaccatgaagagagtgctgagctgcgtgcccgagcccaccgtggtgatggccgccagagccctgtgcatgctgggcctggtgctggccctgctgagcagcagcagcgccgaggagtacgtgggcctgagcgccaaccagtgcgccgtgcccgccaaggacagagtggactgcggctacccccacgtgacccccaaggagtgcaacaacagaggctgctgcttcgacagcagaatccccggcgtgccctggtgcttcaagcccctgcaggaggccgagtgcaccttctag

SEQ ID NO: 13324 - DNA, 285 bp, Artificial Sequence
  Description of Artificial Sequence: Synthetic coding sequence
atgaagagagtgctgagctgcgtgcccgagcccaccgtggtgatggccgccagagccctgtgcatgctgggcctggtgctggccctgctgagcagcagcagcgccgaggagtacgtgggcctgagcgccaaccagtgcgccgtgcccgccaaggacagagtggactgcggctacccccacgtgacccccaaggagtgcaacaacagaggctgctgcttcgacagcagaatccccggcgtgccctggtgcttcaagcccctgcaggaggccgagtgcaccttctag

SEQ ID NO: 13325 - DNA, 1497 bp, Artificial Sequence
  Description of Artificial Sequence: Synthetic coding sequence
atggccctgcccaccctgcccagctactggtgcagccagcagagactgaaccagcagctggccagacagagagagcaggaggccagactgagacagcagtgggagcagaacagcagatacttcagaatgagcgacatctgcagcagcaagcaggccgagtggagcagcaagaccagctaccagagaagcatgcacgcctaccagagagagaagatgaaggaggagaagagaagaagcctggaggccagaagagagaagctgagacagctgatgcaggaggagcaggacctgctggccagagagctggaggagctgagactgagcatgaacctgcaggagagaagaatcagagagcagcacggcaagctgaagagcgccaaggaggagcagagaaagctgatcgccgagcagctgctgtacgagcactggaagaagaacaaccccaagctgagagagatggagctggacctgcaccagaagcacgtggtgaacagctgggagatgcagaaggaggagaagaagcagcaggaggccaccgccgagcaggagaacaagagatacgagaacgagtacgagagagccagaagagaggccctggagagaatgaaggccgaggaggagagaagacagctggaggacaagctgcaggccgaggccctgctgcagcagatggaggagctgaagctgaaggaggtggaggccaccaagctgaagaaggagcaggagaacctgctgaagcagagatgggagctggagagactggaggaggagagaaagcagatggaggccttcagacagaaggccgagctgggcagattcctgagacaccagtacaacgcccagctgagcagaagaacccagcagatccaggaggagctggaggccgacagaagaatcctgcaggccctgctggagaaggaggacgagagccagagactgcacctggccagaagagagcaggtgatggccgacgtggcctggatgaagcaggccatcgaggagcagctgcagctggagagagccagagaggccgagctgcagatgctgctgagagaggaggccaaggagatgtgggagaagagagaggccgagtgggccagagagagaagcgccagagacagactgatgagcgaggtgctgaccggcagacagcagcagatccaggagaagatcgagcagaacagaagagcccaggaggagagcctgaagcacagagagcagctgatcagaaacctggaggaggtgagagagctggccagaagagagaaggaggagagcgagaagctgaagagcgccagaaagcaggagctggaggcccaggtggccgagagaagactgcaggcctgggaggccgaccagcaggaggaggaggaggaggaggaggccagaagagtggagcagctgagcgacgccctgctgcagcaggaggccgagaccatggccgagcagggctacagacccaagccctacggccaccccaagatcgcctggaactag

SEQ ID NO: 13326 - DNA, 1497 bp, Artificial Sequence; identical to SEQ ID NO: 13325
  Description of Artificial Sequence: Synthetic coding sequence

SEQ ID NO: 13327 - DNA, 525 bp, Artificial Sequence
  Description of Artificial Sequence: Synthetic coding sequence
atggccctgcccaccctgcccagctactggtgcagccagcagagactgaaccagcagctggccagacagagagagcaggaggccagactgagacagcagtgggagcagaacagcagatacttcagaatgagcgacatctgcagcagcaagcaggccgagtggagcagcaagaccagctaccagagaagcatgcacgcctaccagagagagaagatgaaggaggagaagagaagaagcctggaggccagaagagagaagctgagacagctgatgcaggaggagcaggacctgctggccagagagctggaggagctgagactgagcatgaacctgcaggagagaagaatcagagagcagcacggcaagctgaagagcgccaaggaggagcagagaaagctgatcgccgagcagctgctgtacgagcactggaagaagaacaaccccaagctgagagagatggagctggacctgcaccagaagcacgtggtgaacagctgggagatgcagaaggaggagaagaagtag

SEQ ID NO: 13328 - DNA, 663 bp, Artificial Sequence
  Description of Artificial Sequence: Synthetic coding sequence
atggccctgcccaccctgcccagctactggtgcagccagcagagactgaaccagcagctggccagacagagagagcaggaggccagactgagacagcagtgggagcagaacagcagatacttcagaatgagcgacatctgcagcagcaagcaggccgagtggagcagcaagaccagctaccagagaagcatgcacgcctaccagagagagaagatgaaggaggagaagagaagaagcctggaggccagaagagagaagctgagacagctgatgcaggaggagcaggacctgctggccagagagctggaggagctgagactgagcatgaacctgcaggagagaagaatcagagagcagcacggcaagctgaagagcgccaaggaggagcagagaaagctgatcgccgagcagctgctgtacgagcactggaagaagaacaaccccaagctgagagagatggagctggacctgcaccagaagcacgtggtgaacagctgggagatgcagaaggaggagaagaagcagcaggaggccaccgccgagcaggagaacaagagatacgagaacgagtacgagagagccagaagagaggccctggagagaatgaaggccgaggaggagagaagactgagcagaaccgacggccacaagagaaacccctag

SEQ ID NO: 13329 - DNA, 1497 bp, Artificial Sequence; identical to SEQ ID NO: 13325
  Description of Artificial Sequence: Synthetic coding sequence

SEQ ID NO: 13330 - DNA, 3090 bp, Artificial Sequence
  Description of Artificial Sequence: Synthetic coding sequence
atgcagaccaacgagggcgaggtgagcgaggagagcagcagcaaggtggagcaggaggacttcgtgatggagggccacggcaagacccccccccccggcgaggagagcaagcaggagaaggagcaggagagagaggagcagctgatggaggacaagaagagaaagaaggaggacaagaagaagaaggaggccacccagaaggtgaccgagcagaagaccaaggtgcccgaggtgaccaagcccagcctgagccagcccaccgccgccagccccatcggcagcagccccagcccccccgtgaacggcggcaacaacgccaagagagtggccgtgcccaacggccagccccccagcgccgccagatacatgcccagagaggtgccccccagattcagatgccagcaggaccacaaggtgctgctgaagagaggccagccccccccccccagctgcatgctgctgggcggcggcgccggcccccccccctgcaccgcccccggcgccaaccccaacaacgcccaggtgaccggcgccctgctgcagagcgagagcggcaccgcccccgtgtggagcaagagcaccccccccgcccccgacaacggcaccagcgcctggggcgagcccaacgagagcagccccggctggggcgagatggacgacaccggcgccagcaccaccggctggggcaacacccccgccaacgcccccaacgccatgaagcccaacagcaagagcatgcaggacggctggggcgagagcgacggccccgtgaccggcgccagacaccccagctgggaggaggaggaggacggcggcgtgtggaacaccaccggcagccagggcagcgccagcagccacaacagcgccagctggggccagggcggcaagaagcagatgaagtgcagcctgaagggcggcaacaacgacagctggatgaaccccctggccaagcagttcagcaacatgggcctgctgagccagaccgaggacaaccccagcagcaagatggacctgagcgtgggcagcctgagcgacaagaagttcgacgtggacaagagagccatgaacctgggcgacttcaacgacatcatgagaaaggacagaagcggcttcagaccccccaacagcaaggacatgggcaccaccgacagcggcccctacttcgagaagggcggcagccacggcctgttcggcaacagcaccgcccagagcagaggcctgcacacccccgtgcagcccctgaacagcagccccagcctgagagcccaggtgcccccccagttcatcagcccccaggtgagcgccagcatgctgaagcagttccccaacagcggcctgagccccggcctgttcaacgtgggcccccagctgagcccccagcagatcgccatgctgagccagctgccccagatcccccagttccagctggcctgccagctgctgctgcagcagcagcagcagcagcagctgctgcagaaccagagaaagatcagccaggccgtgagacagcagcaggagcagcagctggccagaatggtgagcgccctgcagcagcagcagcagcagcagcagagacagcccggcatgaagcacagccccagccaccccgtgggccccaagccccacctggacaacatggtgcccaacgccctgaacgtgggcctgcccgacctgcagaccaagggccccatccccggctacggcagcggcttcagcagcggcggcatggactacggcatggtgggcggcaaggaggccggcaccgagagcagattcaagcagtggaccagcatgatggagggcctgcccagcgtggccacccaggaggccaacatgcacaagaacggcgccatcgtggcccccggcaagaccagaggcggcagcccctacaaccagttcgacatcatccccggcgacaccctgggcggccacaccggccccgccggcgacagctggctgcccgccaagagcccccccaccaacaagatcggcagcaagagcagcaacgccagctggccccccgagttccagcccggcgtgccctggaagggcatccagaacatcgaccccgagagcgacccctacgtgacccccggcagcgtgctgggcggcaccgccaccagccccatcgtggacaccgaccaccagctgctgagagacaacaccaccggcagcaacagcagcctgaacaccagcctgcccagccccggcgcctggccctacagcgccagcgacaacagcttcaccaacgtgcacagcaccagcgccaagttccccgactacaagagcacctggagccccgaccccatcggccacaaccccacccacctgagcaacaagatgtggaagaaccacatcagcagcagaaacaccacccccctgcccagacccccccccggcctgaccaaccccaagcccagcagcccctggagcagcaccgcccccagaagcgtgagaggctggggcacccaggacagcagactggccagcgccagcacctggagcgacggcggcagcgtgagacccagctactggctggtgctgcacaacctgaccccccagatcgacggcagcaccctgagaaccatctgcatgcagcacggccccctgctgaccttccacctgaacctgacccagggcaccgccctgatcagatacagcaccaagcaggaggccgccaaggcccagaccgccctgcacatgtgcgtgctgggcaacaccaccatcctggccgagttcgccaccgacgacgaggtgagcagattcctggcccaggcccagccccccacccccgccgccacccccagcgcccccgccgccggctggcagagcctggagaccggccagaaccagagcgaccccgtgggccccgccctgaacctgttcggcggcagcaccggcctgggccagtggagcagcagcgccggcggcagcagcggcgccgacctggccggcgccagcctgtggggcccccccaactacagcagcagcctgtggggcgtgcccaccgtggaggacccccacagaatgggcagccccgcccccctgctgcccggcgacctgctgggcggcggcagcgacagcatctag

SEQ ID NO: 13331 - DNA, 5172 bp, Artificial Sequence
  Description of Artificial Sequence: Synthetic coding sequence
atgagagagaaggagcaggagagagaggagcagctgatggaggacaagaagagaaagaaggaggacaagaagaagaaggaggccacccagaaggtgaccgagcagaagaccaaggtgcccgaggtgaccaagcccagcctgagccagcccaccgccgccagccccatcggcagcagccccagcccccccgtgaacggcggcaacaacgccaagagagtggccgtgcccaacggccagccccccagcgccgccagatacatgcccagagaggtgccccccagattcagatgccagcaggaccacaaggtgctgctgaagagaggccagccccccccccccagctgcatgctgctgggcggcggcgccggcccccccccctgcaccgcccccggcgccaaccccaacaacgcccaggtgaccggcgccctgctgcagagcgagagcggcaccgcccccgacagcaccctgggcggcgccgccgccagcaactacgccaacagcacctggggcagcggcgccagcagcaacaacggcaccagccccaaccccatccacatctgggacaaggtgatcgtggacggcagcgacatggaggagtggccctgcatcgccagcaaggacaccgagagcagcagcgagaacaccaccgacaacaacagcgccagcaaccccggcagcgagaagagcaccctgcccggcagcaccaccagcaacaagggcaagggcagccagtgccagagcgccagcagcggcaacgagtgcaacctgggcgtgtggaagagcgaccccaaggccaagagcgtgcagagcagcaacagcaccaccgagaacaacaacggcctgggcaactggagaaacgtgagcggccaggacagaatcggccccggcagcggcttcagcaacttcaaccccaacagcaaccccagcgcctggcccgccctggtgcaggagggcaccagcagaaagggcgccctggagaccgacaacagcaacagcagcgcccaggtgagcaccgtgggccagaccagcagagagcagcagagcaagatggagaacgccggcgtgaacttcgtggtgagcggcagagagcaggcccagatccacaacaccgacggccccaagaacggcaacaccaacagcctgaacctgagcagccccaaccccatggagaacaagggcatgcccttcggcatgggcctgggcaacaccagcagaagcaccgacgcccccagccagagcaccggcgacagaaagaccggcagcgtgggcagctggggcgccgccagaggccccagcggcaccgacaccgtgagcggccagagcaacagcggcaacaacggcaacaacggcaaggagagagaggacagctggaagggcgccagcgtgcagaagagcaccggcagcaagaacgacagctgggacaacaacaacagaagcaccggcggcagctggaacttcggcccccaggacagcaacgacaacaagtggggcgagggcaacaagatgaccagcggcgtgagccagggcgagtggaagcagcccaccggcagcgacgagctgaagatcggcgagtggagcggccccaaccagcccaacagcagcaccggcgcctgggacaaccagaagggccaccccctgcccgagaaccagggcaacgcccaggccccctgctggggcagaagcagcagcagcaccggcagcgaggtgggcggccagagcaccggcagcaaccacaaggccggcagcagcgacagccacaacagcggcagaagaagctacagacccacccaccccgactgccaggccgtgctgcagaccctgctgagcagaaccgacctggaccccagagtgctgagcaacaccggctggggccagacccagatcaagcaggacaccgtgtgggacatcgaggaggtgcccagacccgagggcaagagcgacaagggcaccgagggctgggagagcgccgccacccagaccaagaacagcggcggctggggcgacgcccccagccagagcaaccagatgaagagcggctggggcgagctgagcgccagcaccgagtggaaggaccccaagaacaccggcggctggaacgactacaagaacaacaacagcagcaactggggcggcggcagacccgacgagaagacccccagcagctggaacgagaaccccagcaaggaccagggctggggcggcggcagacagcccaaccagggctggagcagcggcaagaacggctggggcgaggaggtggaccagaccaagaacagcaactgggagagcagcgccagcaagcccgtgagcggctggggcgagggcggccagaacgagatcggcacctggggcaacggcggcaacgccagcctggccagcaagggcggctgggaggactgcaagagaagccccgcctggaacgagaccggcagacagcccaacagctggaacaagcagcaccagcagcagcagcccccccagcagcccccccccccccagcccgaggccagcggcagctggggcggcccccccccccccccccccggcaacgtgagacccagcaacagcagctggagcagcggcccccagcccgccacccccaaggacgaggagcccagcggctgggaggagcccagcccccagagcatcagcagaaagatggacatcgacgacggcaccagcgcctggggcgaccccaacagctacaactacaagaacgtgaacctgtgggacaagaacagccagggcggccccgcccccagagagcccaacctgcccacccccatgaccagcaagagcgccagcgacagcaagagcatgcaggacggctggggcgagagcgacggccccgtgaccggcgccagacaccccagctgggaggaggaggaggacggcggcgtgtggaacaccaccggcagccagggcagcgccagcagccacaacagcgccagctggggccagggcggcaagaagcagatgaagtgcagcctgaagggcggcaacaacgacagctggatgaaccccctggccaagcagttcagcaacatgggcctgctgagccagaccgaggacaaccccagcagcaagatggacctgagcgtgggcagcctgagcgacaagaagttcgacgtggacaagagagccatgaacctgggcgacttcaacgacatcatgagaaaggacagaagcggcttcagaccccccaacagcaaggacatgggcaccaccgacagcggcccctacttcgagaagggcggcagccacggcctgttcggcaacagcaccgcccagagcagaggcctgcacacccccgtgcagcccctgaacagcagccccagcctgagagcccaggtgcccccccagttcatcagcccccaggtgagcgccagcatgctgaagcagttccccaacagcggcctgagccccggcctgttcaacgtgggcccccagctgagcccccagcagatcgccatgctgagccagctgccccagatcccccagttccagctggcctgccagctgctgctgcagcagcagcagcagcagcagctgctgcagaaccagagaaagatcagccaggccgtgagacagcagcaggagcagcagctggccagaatggtgagcgccctgcagcagcagcagcagcagcagcagagacagcccggcatgaagcacagccccagccaccccgtgggccccaagccccacctggacaacatggtgcccaacgccctgaacgtgggcctgcccgacctgcagaccaagggccccatccccggctacggcagcggcttcagcagcggcggcatggactacggcatggtgggcggcaaggaggccggcaccgagagcagattcaagcagtggaccagcatgatggagggcctgcccagcgtggccacccaggaggccaacatgcacaagaacggcgccatcgtggcccccggcaagaccagaggcggcagcccctacaaccagttcgacatcatccccggcgacaccctgggcggccacaccggccccgccggcgacagctggctgcccgccaagagcccccccaccaacaagatcggcagcaagagcagcaacgccagctggccccccgagttccagcccggcgtgccctggaagggcatccagaacatcgaccccgagagcgacccctacgtgacccccggcagcgtgctgggcggcaccgccaccagccccatcgtggacaccgaccaccagctgctgagagacaacaccaccggcagcaacagcagcctgaacaccagcctgcccagccccggcgcctggccctacagcgccagcgacaacagcttcaccaacgtgcacagcaccagcgccaagttccccgactacaagagcacctggagccccgaccccatcggccacaaccccacccacctgagcaacaagatgtggaagaaccacatcagcagcagaaacaccacccccctgcccagacccccccccggcctgaccaaccccaagcccagcagcccctggagcagcaccgcccccagaagcgtgagaggctggggcacccaggacagcagactggccagcgccagcacctggagcgacggcggcagcgtgagacccagctactggctggtgctgcacaacctgaccccccagatcgacggcagcaccctgagaaccatctgcatgcagcacggccccctgctgaccttccacctgaacctgacccagggcaccgccctgatcagatacagcaccaagcaggaggccgccaaggcccagaccgccctgcacatgtgcgtgctgggcaacaccaccatcctggccgagttcgccaccgacgacgaggtgagcagattcctggcccaggcccagccccccacccccgccgccacccccagcgcccccgccgccggctggcagagcctggagaccggccagaaccagagcgaccccgtgggccccgccctgaacctgttcggcggcagcaccggcctgggccagtggagcagcagcgccggcggcagcagcggcgccgacctggccggcgccagcctgtggggcccccccaactacagcagcagcctgtggggcgtgcccaccgtggaggacccccacagaatgggcagccccgcccccctgctgcccggcgacctgctgggcggcggcagcgacagcatctag

SEQ ID NO: 13332 - DNA, 5172 bp, Artificial Sequence
  Description of Artificial Sequence: Synthetic coding sequence
atgagagagaaggagcaggagagagaggagcagctgatggaggacaagaagagaaagaaggaggacaagaagaagaaggaggccacccagaagcacagcaaccagaagaccgccatgcccgaggtgaccaagcccagcctgagccagcccaccgccgccagccccatcggcagcagccccagcccccccgtgaacggcggcaacaacgccaagagagtggccgtgcccaacggccagccccccagcgccgccagatacatgcccagagaggtgccccccagattcagatgccagcaggaccacaaggtgctgctgaagagaggccagccccccccccccagctgcatgctgctgggcggcggcgccggcccccccccctgcaccgcccccggcgccaaccccaacaacgcccaggtgaccggcgccctgctgcagagcgagagcggcaccgcccccgacagcaccctgggcggcgccgccgccagcaactacgccaacagcacctggggcagcggcgccagcagcaacaacggcaccagccccaaccccatccacatctgggacaaggtgatcgtggacggcagcgacatggaggagtggccctgcatcgccagcaaggacaccgagagcagcagcgagaacaccaccgacaacaacagcgccagcaaccccggcagcgagaagagcaccctgcccggcagcaccaccagcaacaagggcaagggcagccagtgccagagcgccagcagcggcaacgagtgcaacctgggcgtgtggaagagcgaccccaaggccaagagcgtgcagagcagcaacagcaccaccgagaacaacaacggcctgggcaactggagaaacgtgagcggccaggacagaatcggccccggcagcggcttcagcaacttcaaccccaacagcaaccccagcgcctggcccgccctggtgcaggagggcaccagcagaaagggcgccctggagaccgacaacagcaacagcagcgcccaggtgagcaccgtgggccagaccagcagagagcagcagagcaagatggagaacgccggcgtgaacttcgtggtgagcggcagagagcaggcccagatccacaacaccgacggccccaagaacggcaacaccaacagcctgaacctgagcagccccaaccccatggagaacaagggcatgcccttcggcatgggcctgggcaacaccagcagaagcaccgacgcccccagccagagcaccggcgacagaaagaccggcagcgtgggcagctggggcgccgccagaggccccagcggcaccgacaccgtgagcggccagagcaacagcggcaacaacggcaacaacggcaaggagagagaggacagctggaagggcgccagcgtgcagaagagcaccggcagcaagaacgacagctgggacaacaacaacagaagcaccggcggcagctggaacttcggcccccaggacagcaacgacaacaagtggggcgagggcaacaagatgaccagcggcgtgagccagggcgagtggaagcagcccaccggcagcgacgagctgaagatcggcgagtggagcggccccaaccagcccaacagcagcaccggcgcctgggacaaccagaagggccaccccctgcccgagaaccagggcaacgcccaggccccctgctggggcagaagcagcagcagcaccggcagcgaggtgggcggccagagcaccggcagcaaccacaaggccggcagcagcgacagccacaacagcggcagaagaagctacagacccacccaccccgactgccaggccgtgctgcagaccctgctgagcagaaccgacctggaccccagagtgctgagcaacaccggctggggccagacccagatcaagcaggacaccgtgtgggacatcgaggaggtgcccagacccgagggcaagagcgacaagggcaccgagggctgggagagcgccgccacccagaccaagaacagcggcggctggggcgacgcccccagccagagcaaccagatgaagagcggctggggcgagctgagcgccagcaccgagtggaaggaccccaagaacaccggcggctggaacgactacaagaacaacaacagcagcaactggggcggcggcagacccgacgagaagacccccagcagctggaacgagaaccccagcaaggaccagggctggggcggcggcagacagcccaaccagggctggagcagcggcaagaacggctggggcgaggaggtggaccagaccaagaacagcaactgggagagcagcgccagcaagcccgtgagcggctggggcgagggcggccagaacgagatcggcacctggggcaacggcggcaacgccagcctggccagcaagggcggctgggaggactgcaagagaagccccgcctggaacgagaccggcagacagcccaacagctggaacaagcagcaccagcagcagcagcccccccagcagcccccccccccccagcccgaggccagcggcagctggggcggcccccccccccccccccccggcaacgtgagacccagcaacagcagctggagcagcggcccccagcccgccacccccaaggacgaggagcccagcggctgggaggagcccagcccccagagcatcagcagaaagatggacatcgacgacggcaccagcgcctggggcgaccccaacagctacaactacaagaacgtgaacctgtgggacaagaacagccagggcggccccgcccccagagagcccaacctgcccacccccatgaccagcaagagcgccagcgacagcaagagcatgcaggacggctggggcgagagcgacggccccgtgaccggcgccagacaccccagctgggaggaggaggaggacggcggcgtgtggaacaccaccggcagccagggcagcgccagcagccacaacagcgccagctggggccagggcggcaagaagcagatgaagtgcagcctgaagggcggcaacaacgacagctggatgaaccccctggccaagcagttcagcaacatgggcctgctgagccagaccgaggacaaccccagcagcaagatggacctgagcgtgggcagcctgagcgacaagaagttcgacgtggacaagagagccatgaacctgggcgacttcaacgacatcatgagaaaggacagaagcggcttcagaccccccaacagcaaggacatgggcaccaccgacagcggcccctacttcgagaagggcggcagccacggcctgttcggcaacagcaccgcccagagcagaggcctgcacacccccgtgcagcccctgaacagcagccccagcctgagagcccaggtgcccccccagttcatcagcccccaggtgagcgccagcatgctgaagcagttccccaacagcggcctgagccccggcctgttcaacgtgggcccccagctgagcccccagcagatcgccatgctgagccagctgccccagatcccccagttccagctggcctgccagctgctgctgcagcagcagcagcagcagcagctgctgcagaaccagagaaagatcagccaggccgtgagacagcagcaggagcagcagctggccagaatggtgagcgccctgcagcagcagcagcagcagcagcagagacagcccggcatgaagcacagccccagccaccccgtgggccccaagccccacctggacaacatggtgcccaacgccctgaacgtgggcctgcccgacctgcagaccaagggccccatccccggctacggcagcggcttcagcagcggcggcatggactacggcatggtgggcggcaaggaggccggcaccgagagcagattcaagcagtggaccagcatgatggagggcctgcccagcgtggccacccaggaggccaacatgcacaagaacggcgccatcgtggcccccggcaagaccagaggcggcagcccctacaaccagttcgacatcatccccggcgacaccctgggcggccacaccggccccgccggcgacagctggctgcccgccaagagcccccccaccaacaagatcggcagcaagagcagcaacgccagctggccccccgagttccagcccggcgtgccctggaagggcatccagaacatcgaccccgagagcgacccctacgtgacccccggcagcgtgctgggcggcaccgccaccagccccatcgtggacaccgaccaccagctgctgagagacaacaccaccggcagcaacagcagcctgaacaccagcctgcccagccccggcgcctggccctacagcgccagcgacaacagcttcaccaacgtgcacagcaccagcgccaagttccccgactacaagagcacctggagccccgaccccatcggccacaaccccacccacctgagcaacaagatgtggaagaaccacatcagcagcagaaacaccacccccctgcccagacccccccccggcctgaccaaccccaagcccagcagcccctggagcagcaccgcccccagaagcgtgagaggctggggcacccaggacagcagactggccagcgccagcacctggagcgacggcggcagcgtgagacccagctactggctggtgctgcacaacctgaccccccagatcgacggcagcaccctgagaaccatctgcatgcagcacggccccctgctgaccttccacctgaacctgacccagggcaccgccctgatcagatacagcaccaagcaggaggccgccaaggcccagaccgccctgcacatgtgcgtgctgggcaacaccaccatcctggccgagttcgccaccgacgacgaggtgagcagattcctggcccaggcccagccccccacccccgccgccacccccagcgcccccgccgccggctggcagagcctggagaccggccagaaccagagcgaccccgtgggccccgccctgaacctgttcggcggcagcaccggcctgggccagtggagcagcagcgccggcggcagcagcggcgccgacctggccggcgccagcctgtggggcccccccaactacagcagcagcctgtggggcgtgcccaccgtggaggacccccacagaatgggcagccccgcccccctgctgcccggcgacctgctgggcggcggcagcgacagcatctag

SEQ ID NO: 13333 - DNA, 3090 bp, Artificial Sequence; identical to SEQ ID NO: 13330
  Description of Artificial Sequence: Synthetic coding sequence

SEQ ID NO: 13334 - DNA, 114 bp, Artificial Sequence
  Description of Artificial Sequence: Synthetic coding sequence
atgcagaccaacgagggcgaggtgagcgaggagagcagcagcaaggtggagcaggaggacttcgtgatggagggccacggcaagacccccccccccggcgaggagagcaagtag

SEQ ID NO: 13335 - DNA, 5502 bp, Artificial Sequence
  Description of Artificial Sequence: Synthetic coding sequence
atgagagagaaggagcaggagagagaggagcagctgatggaggacaagaagagaaagaaggaggacaagaagaagaaggaggccacccagaaggtgaccgagcagaagaccaaggtgcccgaggtgaccaagcccagcctgagccagcccaccgccgccagccccatcggcagcagccccagcccccccgtgaacggcggcaacaacgccaagagagtggccgtgcccaacggccagccccccagcgccgccagatacatgcccagagaggtgccccccagattcagatgccagcaggaccacaaggtgctgctgaagagaggccagccccccccccccagctgcatgctgctgggcggcggcgccggcccccccccctgcaccgcccccggcgccaaccccaacaacgcccaggtgaccggcgccctgctgcagagcgagagcggcaccgcccccgacagcaccctgggcggcgccgccgccagcaactacgccaacagcacctggggcagcggcgccagcagcaacaacggcaccagccccaaccccatccacatctgggacaaggtgatcgtggacggcagcgacatggaggagtggccctgcatcgccagcaaggacaccgagagcagcagcgagaacaccaccgacaacaacagcgccagcaaccccggcagcgagaagagcaccctgcccggcagcaccaccagcaacaagggcaagggcagccagtgccagagcgccagcagcggcaacgagtgcaacctgggcgtgtggaagagcgaccccaaggccaagagcgtgcagagcagcaacagcaccaccgagaacaacaacggcctgggcaactggagaaacgtgagcggccaggacagaatcggccccggcagcggcttcagcaacttcaaccccaacagcaaccccagcgcctggcccgccctggtgcaggagggcaccagcagaaagggcgccctggagaccgacaacagcaacagcagcgcccaggtgagcaccgtgggccagaccagcagagagcagcagagcaagatggagaacgccggcgtgaacttcgtggtgagcggcagagagcaggcccagatccacaacaccgacggccccaagaacggcaacaccaacagcctgaacctgagcagccccaaccccatggagaacaagggcatgcccttcggcatgggcctgggcaacaccagcagaagcaccgacgcccccagccagagcaccggcgacagaaagaccggcagcgtgggcagctggggcgccgccagaggccccagcggcaccgacaccgtgagcggccagagcaacagcggcaacaacggcaacaacggcaaggagagagaggacagctggaagggcgccagcgtgcagaagagcaccggcagcaagaacgacagctgggacaacaacaacagaagcaccggcggcagctggaacttcggcccccaggacagcaacgacaacaagtggggcgagggcaacaagatgaccagcggcgtgagccagggcgagtggaagcagcccaccggcagcgacgagctgaagatcggcgagtggagcggccccaaccagcccaacagcagcaccggcgcctgggacaaccagaagggccaccccctgcccgagaaccagggcaacgcccaggccccctgctggggcagaagcagcagcagcaccggcagcgaggtgggcggccagagcaccggcagcaaccacaaggccggcagcagcgacagccacaacagcggcagaagaagctacagacccacccaccccgactgccaggccgtgctgcagaccctgctgagcagaaccgacctggaccccagagtgctgagcaacaccggctggggccagacccagatcaagcaggacaccgtgtgggacatcgaggaggtgcccagacccgagggcaagagcgacaagggcaccgagggctgggagagcgccgccacccagaccaagaacagcggcggctggggcgacgcccccagccagagcaaccagatgaagagcggctggggcgagctgagcgccagcaccgagtggaaggaccccaagaacaccggcggctggaacgactacaagaacaacaacagcagcaactggggcggcggcagacccgacgagaagacccccagcagctggaacgagaaccccagcaaggaccagggctggggcggcggcagacagcccaaccagggctggagcagcggcaagaacggctggggcgaggaggtggaccagaccaagaacagcaactgggagagcagcgccagcaagcccgtgagcggctggggcgagggcggccagaacgagatcggcacctggggcaacggcggcaacgccagcctggccagcaagggcggctgggaggactgcaagagaagccccgcctggaacgagaccggcagacagcccaacagctggaacaagcagcaccagcagcagcagcccccccagcagcccccccccccccagcccgaggccagcggcagctggggcggcccccccccccccccccccggcaacgtgagacccagcaacagcagctggagcagcggcccccagcccgccacccccaaggacgaggagcccagcggctgggaggagcccagcccccagagcatcagcagaaagatggacatcgacgacggcaccagcgcctggggcgaccccaacagctacaactacaagaacgtgaacctgtgggacaagaacagccagggcggccccgcccccagagagcccaacctgcccacccccatgaccagcaagagcgccagcgtgtggagcaagagcaccccccccgcccccgacaacggcaccagcgcctggggcgagcccaacgagagcagccccggctggggcgagatggacgacaccggcgccagcaccaccggctggggcaacacccccgccaacgcccccaacgccatgaagcccaacagcaagagcatgcaggacggctggggcgagagcgacggccccgtgaccggcgccagacaccccagctgggaggaggaggaggacggcggcgtgtggaacaccaccggcagccagggcagcgccagcagccacaacagcgccagctggggccagggcggcaagaagcagatgaagtgcagcctgaagggcggcaacaacgacagctggatgaaccccctggccaagcagttcagcaacatgggcctgctgagccagaccgaggacaaccccagcagcaagatggacctgagcgtgggcagcctgagcgacaagaagttcgacgtggacaagagagccatgaacctgggcgacttcaacgacatcatgagaaaggacagaagcggcttcagaccccccaacagcaaggacatgggcaccaccgacagcggcccctacttcgagaagctgaccctgcccttcagcaaccaggacggctgcctgggcgacgaggccccctgcagccccttcagccccagccccagctacaagctgagccccagcggcagcaccctgcccaacgtgagcctgggcgccatcggcaccggcctgaacccccagaacttcgccgccagacagggcggcagccacggcctgttcggcaacagcaccgcccagagcagaggcctgcacacccccgtgcagcccctgaacagcagccccagcctgagagcccaggtgcccccccagttcatcagcccccaggtgagcgccagcatgctgaagcagttccccaacagcggcctgagccccggcctgttcaacgtgggcccccagctgagcccccagcagatcgccatgctgagccagctgccccagatcccccagttccagctggcctgccagctgctgctgcagcagcagcagcagcagcagctgctgcagaaccagagaaagatcagccaggccgtgagacagcagcaggagcagcagctggccagaatggtgagcgccctgcagcagcagcagcagcagcagcagagacagcccggcatgaagcacagccccagccaccccgtgggccccaagccccacctggacaacatggtgcccaacgccctgaacgtgggcctgcccgacctgcagaccaagggccccatccccggctacggcagcggcttcagcagcggcggcatggactacggcatggtgggcggcaaggaggccggcaccgagagcagattcaagcagtggaccagcatgatggagggcctgcccagcgtggccacccaggaggccaacatgcacaagaacggcgccatcgtggcccccggcaagaccagaggcggcagcccctacaaccagttcgacatcatccccggcgacaccctgggcggccacaccggccccgccggcgacagctggctgcccgccaagagcccccccaccaacaagatcggcagcaagagcagcaacgccagctggccccccgagttccagcccggcgtgccctggaagggcatccagaacatcgaccccgagagcgacccctacgtgacccccggcagcgtgctgggcggcaccgccaccagccccatcgtggacaccgaccaccagctgctgagagacaacaccaccggcagcaacagcagcctgaacaccagcctgcccagccccggcgcctggccctacagcgccagcgacaacagcttcaccaacgtgcacagcaccagcgccaagttccccgactacaagagcacctggagccccgaccccatcggccacaaccccacccacctgagcaacaagatgtggaagaaccacatcagcagcagaaacaccacccccctgcccagacccccccccggcctgaccaaccccaagcccagcagcccctggagcagcaccgcccccagaagcgtgagaggctggggcacccaggacagcagactggccagcgccagcacctggagcgacggcggcagcgtgagacccagctactggctggtgctgcacaacctgaccccccagatcgacggcagcaccctgagaaccatctgcatgcagcacggccccctgctgaccttccacctgaacctgacccagggcaccgccctgatcagatacagcaccaagcaggaggccgccaaggcccagaccgccctgcacatgtgcgtgctgggcaacaccaccatcctggccgagttcgccaccgacgacgaggtgagcagattcctggcccaggcccagccccccacccccgccgccacccccagcgcccccgccgccggctggcagagcctggagaccggccagaaccagagcgaccccgtgggccccgccctgaacctgttcggcggcagcaccggcctgggccagtggagcagcagcgccggcggcagcagcggcgccgacctggccggcgccagcctgtggggcccccccaactacagcagcagcctgtggggcgtgcccaccgtggaggacccccacagaatgggcagccccgcccccctgctgcccggcgacctgctgggcggcggcagcgacagcatctag

SEQ ID NO: 13336 - DNA, 3153 bp, Artificial Sequence
  Description of Artificial Sequence: Synthetic coding sequence
atggaggtggccgtggagaaggccgtggccgccgccgccgccgccagcgccgccgccagcggcggccccagcgccgcccccagcggcgagaacgaggccgagagcagacagggccccgacagcgagagaggcggcgaggccgccagactgaacctgctggacacctgcgccgtgtgccaccagaacatccagagcagagcccccaagctgctgccctgcctgcacagcttctgccagagatgcctgcccgccccccagagatacctgatgctgcccgcccccatgctgggcagcgccgagacccccccccccgtgcccgcccccggcagccccgtgagcggcagcagccccttcgccacccaggtgggcgtgatcagatgccccgtgtgcagccaggagtgcgccgagagacacatcatcgacaacttcttcgtgaaggacaccaccgaggtgcccagcagcaccgtggagaagagcaaccaggtgtgcaccagctgcgaggacaacgccgaggccaacggcttctgcgtggagtgcgtggagtggctgtgcaagacctgcatcagagcccaccagagagtgaagttcaccaaggaccacaccgtgagacagaaggaggaggtgagccccgaggccgtgggcgtgaccagccagagacccgtgttctgccccttccacaagaaggagcagctgaagctgtactgcgagacctgcgacaagctgacctgcagagactgccagctgctggagcacaaggagcacagataccagttcatcgaggaggccttccagaaccagaaggtgatcatcgacaccctgatcaccaagctgatggagaagaccaagtacatcaagttcaccggcaaccagatccagaacagaatcatcgaggtgaaccagaaccagaagcaggtggagcaggacatcaaggtggccatcttcaccctgatggtggagatcaacaagaagggcaaggccctgctgcaccagctggagagcctggccaaggaccacagaatgaagctgatgcagcagcagcaggaggtggccggcctgagcaagcagctggagcacgtgatgcacttcagcaagtgggccgtgagcagcggcagcagcaccgccctgctgtacagcaagagactgatcacctacagactgagacacctgctgagagccagatgcgacgccagccccgtgaccaacaacaccatccagttccactgcgaccccagcttctgggcccagaacatcatcaacctgggcagcctggtgatcgaggacaaggagagccagccccagatgcccaagcagaaccccgtggtggagcagaacagccagccccccagcggcctgagcagcaaccagctgagcaagttccccacccagatcagcctggcccagctgagactgcagcacatgcagcagcaggtgatggcccagagacagcaggtgcagagaagacccgcccccgtgggcctgcccaaccccagaatgcagggccccatccagcagcccagcatcagccaccagcagcccccccccagactgatcaacttccagaaccacagccccaagcccaacggccccgtgctgcccccccacccccagcagctgagatacccccccaaccagaacatccccagacaggccatcaagcccaaccccctgcagatggccttcctggcccagcaggccatcaagcagtggcagatcagcagcggccagggcacccccagcaccaccaacagcaccagcagcacccccagcagccccaccatcaccagcgccgccggctacgacggcaaggccttcggcagccccatgatcgacctgagcagccccgtgggcggcagctacaacctgcccagcctgcccgacatcgactgcagcagcaccatcatgctggacaacatcgtgagaaaggacaccaacatcgaccacggccagcccagaccccccagcaacagaaccgtgcagagccccaacagcagcgtgcccagccccggcctggccggccccgtgaccatgaccagcgtgcacccccccatcagaagccccagcgccagcagcgtgggcagcagaggcagcagcggcagcagcagcaagcccgccggcgccgacagcacccacaaggtgcccgtggtgatgctggagcccatcagaatcaagcaggagaacagcggcccccccgagaactacgacttccccgtggtgatcgtgaagcaggagagcgacgaggagagcagaccccagaacgccaactaccccagaagcatcctgaccagcctgctgctgaacagcagccagagcagcaccagcgaggagaccgtgctgagaagcgacgcccccgacagcaccggcgaccagcccggcctgcaccaggacaacagcagcaacggcaagagcgagtggctggaccccagccagaagagccccctgcacgtgggcgagaccagaaaggaggacgaccccaacgaggactggtgcgccgtgtgccagaacggcggcgagctgctgtgctgcgagaagtgccccaaggtgttccacctgagctgccacgtgcccaccctgaccaacttccccagcggcgagtggatctgcaccttctgcagagacctgagcaagcccgaggtggagtacgactgcgacgcccccagccacaacagcgagaagaagaagaccgagggcctggtgaagctgacccccatcgacaagagaaagtgcgagagactgctgctgttcctgtactgccacgagatgagcctggccttccaggaccccgtgcccctgaccgtgcccgactactacaagatcatcaagaaccccatggacctgagcaccatcaagaagagactgcaggaggactacagcatgtacagcaagcccgaggacttcgtggccgacttcagactgatcttccagaactgcgccgagttcaacgagcccgacagcgaggtggccaacgccggcatcaagctggagaactacttcgaggagctgctgaagaacctgtaccccgagaagagattccccaagcccgagttcagaaacgagagcgaggacaacaagttcagcgacgacagcgacgacgacttcgtgcagcccagaaagaagagactgaagagcatcgaggagagacagctgctgaagtag

SEQ ID NO: 13337 - DNA, 1650 bp, Artificial Sequence
  Description of Artificial Sequence: Synthetic coding sequence
atggagggccccagaagcgccgcctgcagagccagacccgccaccagccccggcgccgtggacctgaccgcccccccccccccccccctgctgagaatcctgaacagcagagccgcccccgccaccagaaccttcgccgacctgtgcagaagcctgctgcagcccgagagcagagtgctgtgcagactgcagcccgtgaactgctacccccccgccgccagcaccaagctgtgccccgtgggcgtgatcagatgccccgtgtgcagccaggagtgcgccgagagacacatcatcgacaacttcttcgtgaaggacaccaccgaggtgcccagcagcaccgtggagaagagcaaccaggtgtgcaccagctgcgaggacaacgccgaggccaacggcttctgcgtggagtgcgtggagtggctgtgcaagacctgcatcagagcccaccagagagtgaagttcaccaaggaccacaccgtgagacagaaggaggaggtgagccccgaggccgtgggcgtgaccagccagagacccgtgttctgccccttccacaagaaggagcagctgaagctgtactgcgagacctgcgacaagctgacctgcagagactgccagctgctggagcacaaggagcacagataccagttcatcgaggaggccttccagaaccagaaggtgatcatcgacaccctgatcaccaagctgatggagaagaccaagtacatcaagttcaccggcaaccagatccagaacagaatcatcgaggtgaaccagaaccagaagcaggtggagcaggacatcaaggtggccatcttcaccctgatggtggagatcaacaagaagggcaaggccctgctgcaccagctggagagcctggccaaggaccacagaatgaagctgatgcagcagcagcaggaggtggccggcctgagcaagcagctggagcacgtgatgcacttcagcaagtgggccgtgagcagcggcagcagcaccgccctgctgtacagcaagagactgatcacctacagactgagacacctgctgagagccagatgcgacgccagccccgtgaccaacaacaccatccagttccactgcgaccccagcttctgggcccagaacatcatcaacctgggcagcctggtgatcgaggacaaggagagccagccccagatgcccaagcagaaccccgtggtggagcagaacagccagccccccagcggcctgagcagcaaccagctgagcaagttccccacccagatcagcctggcccagctgagactgcagcacatgcagcagcagcagcccccccccagactgatcaacttccagaaccacagccccaagcccaacggccccgtgctgcccccccacccccagcagctgagatacccccccaaccagaacatccccagacaggccatcaagcccaaccccctgcagatggccttcctggcccagcaggccatcaagcagtggcagatcagcagcggccagggcacccccagcaccacccagaacatcaacaccgccgcctgcaccgtgttcgacgtgagagtgctgcaccacatcccctactgggccctgaacatcagcagcagcgagagagacagcttcctgtggttcagcagcgtgtacaacctggagtag

SEQ ID NO: 13338 - DNA, 3051 bp, Artificial Sequence
  Description of Artificial Sequence: Synthetic coding sequence
atggaggtggccgtggagaaggccgtggccgccgccgccgccgccagcgccgccgccagcggcggccccagcgccgcccccagcggcgagaacgaggccgagagcagacagggccccgacagcgagagaggcggcgaggccgccagactgaacctgctggacacctgcgccgtgtgccaccagaacatccagagcagagcccccaagctgctgccctgcctgcacagcttctgccagagatgcctgcccgccccccagagatacctgatgctgcccgcccccatgctgggcagcgccgagacccccccccccgtgcccgcccccggcagccccgtgagcggcagcagccccttcgccacccaggtgggcgtgatcagatgccccgtgtgcagccaggagtgcgccgagagacacatcatcgacaacttcttcgtgaaggacaccaccgaggtgcccagcagcaccgtggagaagagcaaccaggtgtgcaccagctgcgaggacaacgccgaggccaacggcttctgcgtggagtgcgtggagtggctgtgcaagacctgcatcagagcccaccagagagtgaagttcaccaaggaccacaccgtgagacagaaggaggaggtgagccccgaggccgtgggcgtgaccagccagagacccgtgttctgccccttccacaagaaggagcagctgaagctgtactgcgagacctgcgacaagctgacctgcagagactgccagctgctggagcacaaggagcacagataccagttcatcgaggaggccttccagaaccagaaggtgatcatcgacaccctgatcaccaagctgatggagaagaccaagtacatcaagttcaccggcaaccagatccagaacagaatcatcgaggtgaaccagaaccagaagcaggtggagcaggacatcaaggtggccatcttcaccctgatggtggagatcaacaagaagggcaaggccctgctgcaccagctggagagcctggccaaggaccacagaatgaagctgatgcagcagcagcaggaggtggccggcctgagcaagcagctggagcacgtgatgcacttcagcaagtgggccgtgagcagcggcagcagcaccgccctgctgtacagcaagagactgatcacctacagactgagacacctgctgagagccagatgcgacgccagccccgtgaccaacaacaccatccagttccactgcgaccccagcttctgggcccagaacatcatcaacctgggcagcctggtgatcgaggacaaggagagccagccccagatgcccaagcagaaccccgtggtggagcagaacagccagccccccagcggcctgagcagcaaccagctgagcaagttccccacccagatcagcctggcccagctgagactgcagcacatgcagcagcagcagcccccccccagactgatcaacttccagaaccacagccccaagcccaacggccccgtgctgcccccccacccccagcagctgagatacccccccaaccagaacatccccagacaggccatcaagcccaaccccctgcagatggccttcctggcccagcaggccatcaagcagtggcagatcagcagcggccagggcacccccagcaccaccaacagcaccagcagcacccccagcagccccaccatcaccagcgccgccggctacgacggcaaggccttcggcagccccatgatcgacctgagcagccccgtgggcggcagctacaacctgcccagcctgcccgacatcgactgcagcagcaccatcatgctggacaacatcgtgagaaaggacaccaacatcgaccacggccagcccagaccccccagcaacagaaccgtgcagagccccaacagcagcgtgcccagccccggcctggccggccccgtgaccatgaccagcgtgcacccccccatcagaagccccagcgccagcagcgtgggcagcagaggcagcagcggcagcagcagcaagcccgccggcgccgacagcacccacaaggtgcccgtggtgatgctggagcccatcagaatcaagcaggagaacagcggcccccccgagaactacgacttccccgtggtgatcgtgaagcaggagagcgacgaggagagcagaccccagaacgccaactaccccagaagcatcctgaccagcctgctgctgaacagcagccagagcagcaccagcgaggagaccgtgctgagaagcgacgcccccgacagcaccggcgaccagcccggcctgcaccaggacaacagcagcaacggcaagagcgagtggctggaccccagccagaagagccccctgcacgtgggcgagaccagaaaggaggacgaccccaacgaggactggtgcgccgtgtgccagaacggcggcgagctgctgtgctgcgagaagtgccccaaggtgttccacctgagctgccacgtgcccaccctgaccaacttccccagcggcgagtggatctgcaccttctgcagagacctgagcaagcccgaggtggagtacgactgcgacgcccccagccacaacagcgagaagaagaagaccgagggcctggtgaagctgacccccatcgacaagagaaagtgcgagagactgctgctgttcctgtactgccacgagatgagcctggccttccaggaccccgtgcccctgaccgtgcccgactactacaagatcatcaagaaccccatggacctgagcaccatcaagaagagactgcaggaggactacagcatgtacagcaagcccgaggacttcgtggccgacttcagactgatcttccagaactgcgccgagttcaacgagcccgacagcgaggtggccaacgccggcatcaagctggagaactacttcgaggagctgctgaagaacctgtaccccgagaagagattccccaagcccgagttcagaaacgagagcgaggacaacaagttcagcgacgacagcgacgacgacttcgtgcagcccagaaagaagagactgaagagcatcgaggagagacagctgctgaagtag

SEQ ID NO: 13339 - DNA, 2886 bp, Artificial Sequence
  Description of Artificial Sequence: Synthetic coding sequence
atgctgcccgcccccatgctgggcagcgccgagacccccccccccgtgcccgcccccggcagccccgtgagcggcagcagccccttcgccacccaggtgggcgtgatcagatgccccgtgtgcagccaggagtgcgccgagagacacatcatcgacaacttcttcgtgaaggacaccaccgaggtgcccagcagcaccgtggagaagagcaaccaggtgtgcaccagctgcgaggacaacgccgaggccaacggcttctgcgtggagtgcgtggagtggctgtgcaagacctgcatcagagcccaccagagagtgaagttcaccaaggaccacaccgtgagacagaaggaggaggtgagccccgaggccgtgggcgtgaccagccagagacccgtgttctgccccttccacaagaaggagcagctgaagctgtactgcgagacctgcgacaagctgacctgcagagactgccagctgctggagcacaaggagcacagataccagttcatcgaggaggccttccagaaccagaaggtgatcatcgacaccctgatcaccaagctgatggagaagaccaagtacatcaagttcaccggcaaccagatccagaacagaatcatcgaggtgaaccagaaccagaagcaggtggagcaggacatcaaggtggccatcttcaccctgatggtggagatcaacaagaagggcaaggccctgctgcaccagctggagagcctggccaaggaccacagaatgaagctgatgcagcagcagcaggaggtggccggcctgagcaagcagctggagcacgtgatgcacttcagcaagtgggccgtgagcagcggcagcagcaccgccctgctgtacagcaagagactgatcacctacagactgagacacctgctgagagccagatgcgacgccagccccgtgaccaacaacaccatccagttccactgcgaccccagcttctgggcccagaacatcatcaacctgggcagcctggtgatcgaggacaaggagagccagccccagatgcccaagcagaaccccgtggtggagcagaacagccagccccccagcggcctgagcagcaaccagctgagcaagttccccacccagatcagcctggcccagctgagactgcagcacatgcagcagcaggtgatggcccagagacagcaggtgcagagaagacccgcccccgtgggcctgcccaaccccagaatgcagggccccatccagcagcccagcatcagccaccagcagcccccccccagactgatcaacttccagaaccacagccccaagcccaacggccccgtgctgcccccccacccccagcagctgagatacccccccaaccagaacatccccagacaggccatcaagcccaaccccctgcagatggccttcctggcccagcaggccatcaagcagtggcagatcagcagcggccagggcacccccagcaccaccaacagcaccagcagcacccccagcagccccaccatcaccagcgccgccggctacgacggcaaggccttcggcagccccatgatcgacctgagcagccccgtgggcggcagctacaacctgcccagcctgcccgacatcgactgcagcagcaccatcatgctggacaacatcgtgagaaaggacaccaacatcgaccacggccagcccagaccccccagcaacagaaccgtgcagagccccaacagcagcgtgcccagccccggcctggccggccccgtgaccatgaccagcgtgcacccccccatcagaagccccagcgccagcagcgtgggcagcagaggcagcagcggcagcagcagcaagcccgccggcgccgacagcacccacaaggtgcccgtggtgatgctggagcccatcagaatcaagcaggagaacagcggcccccccgagaactacgacttccccgtggtgatcgtgaagcaggagagcgacgaggagagcagaccccagaacgccaactaccccagaagcatcctgaccagcctgctgctgaacagcagccagagcagcaccagcgaggagaccgtgctgagaagcgacgcccccgacagcaccggcgaccagcccggcctgcaccaggacaacagcagcaacggcaagagcgagtggctggaccccagccagaagagccccctgcacgtgggcgagaccagaaaggaggacgaccccaacgaggactggtgcgccgtgtgccagaacggcggcgagctgctgtgctgcgagaagtgccccaaggtgttccacctgagctgccacgtgcccaccctgaccaacttccccagcggcgagtggatctgcaccttctgcagagacctgagcaagcccgaggtggagtacgactgcgacgcccccagccacaacagcgagaagaagaagaccgagggcctggtgaagctgacccccatcgacaagagaaagtgcgagagactgctgctgttcctgtactgccacgagatgagcctggccttccaggaccccgtgcccctgaccgtgcccgactactacaagatcatcaagaaccccatggacctgagcaccatcaagaagagactgcaggaggactacagcatgtacagcaagcccgaggacttcgtggccgacttcagactgatcttccagaactgcgccgagttcaacgagcccgacagcgaggtggccaacgccggcatcaagctggagaactacttcgaggagctgctgaagaacctgtaccccgagaagagattccccaagcccgagttcagaaacgagagcgaggacaacaagttcagcgacgacagcgacgacgacttcgtgcagcccagaaagaagagactgaagagcatcgaggagagacagctgctgaagtag

SEQ ID NO: 13340 - DNA, 1692 bp, Artificial Sequence
  Description of Artificial Sequence: Synthetic coding sequence
atgggcctgcaggcctgcctgctgggcctgttcgccctgatcctgagcggcaagtgcagctacagccccgagcccgaccagagaagaaccctgccccccggctgggtgagcctgggcagagccgaccccgaggaggagctgagcctgaccttcgccctgagacagcagaacgtggagagactgagcgagctggtgcaggccgtgagcgaccccagcagcccccagtacggcaagtacctgaccctggagaacgtggccgacctggtgagacccagccccctgaccctgcacaccgtgcagaagtggctgctggccgccggcgcccagaagtgccacagcgtgatcacccaggacttcctgacctgctggctgagcatcagacaggccgagctgctgctgcccggcgccgagttccaccactacgtgggcggccccaccgagacccacgtggtgagaagcccccacccctaccagctgccccaggccctggccccccacgtggacttcgtgggcggcctgcacagattcccccccaccagcagcctgagacagagacccgagccccaggtgaccggcaccgtgggcctgcacctgggcgtgacccccagcgtgatcagaaagagatacaacctgaccagccaggacgtgggcagcggcaccagcaacaacagccaggcctgcgcccagttcctggagcagtacttccacgacagcgacctggcccagttcatgagactgttcggcggcaacttcgcccaccaggccagcgtggccagagtggtgggccagcagggcagaggcagagccggcatcgaggccagcctggacgtgcagtacctgatgagcgccggcgccaacatcagcacctgggtgtacagcagccccggcagacacgagggccaggagcccttcctgcagtggctgatgctgctgagcaacgagagcgccctgccccacgtgcacaccgtgagctacggcgacgacgaggacagcctgagcagcgcctacatccagagagtgaacaccgagctgatgaaggccgccgccagaggcctgaccctgctgttcgccagcggcgacagcggcgccggctgctggagcgtgagcggcagacaccagttcagacccaccttccccgccagcagcccctacgtgaccaccgtgggcggcaccagcttccaggagcccttcctgatcaccaacgagatcgtggactacatcagcggcggcggcttcagcaacgtgttccccagacccagctaccaggaggaggccgtgaccaagttcctgagcagcagcccccacctgccccccagcagctacttcaacgccagcggcagagcctaccccgacgtggccgccctgagcgacggctactgggtggtgagcaacagagtgcccatcccctgggtgagcggcaccagcgccagcacccccgtgttcggcggcatcctgagcctgatcaacgagcacagaatcctgagcggcagaccccccctgggcttcctgaaccccagactgtaccagcagcacggcgccggcctgttcgacgtgaccagaggctgccacgagagctgcctggacgaggaggtggagggccagggcttctgcagcggccccggctgggaccccgtgaccggctggggcacccccaacttccccgccctgctgaagaccctgctgaacccctag

SEQ ID NO: 13341 - DNA, 1041 bp, Artificial Sequence
  Description of Artificial Sequence: Synthetic coding sequence
atgggcctgcaggcctgcctgctgggcctgttcgccctgatcctgagcggcaagtgcagctacagccccgagcccgaccagagaagaaccctgccccccggctgggtgagcctgggcagagccgaccccgaggaggagctgagcctgaccttcgccctgagacagcagaacgtggagagactgagcgagctggtgcaggccgtgagcgaccccagcagcccccagtacggcaagtacctgaccctggagaacgtggccgacctggtgagacccagccccctgaccctgcacaccgtgcagaagtggctgctggccgccggcgcccagaagtgccacagcgtgatcacccaggacttcctgacctgctggctgagcatcagacaggccgagctgctgctgcccggcgccgagttccaccactacgtgggcggccccaccgagacccacgtggtgagaagcccccacccctaccagctgccccacatcctggaggtgccctacgtgaccaccgtgggcggcaccagcttccaggagcccttcctgatcaccaacgagatcgtggactacatcagcggcggcggcttcagcaacgtgttccccagacccagctaccaggaggaggccgtgaccaagttcctgagcagcagcccccacctgccccccagcagctacttcaacgccagcggcagagcctaccccgacgtggccgccctgagcgacggctactgggtggtgagcaacagagtgcccatcccctgggtgagcggcaccagcgccagcacccccgtgttcggcggcatcctgagcctgatcaacgagcacagaatcctgagcggcagaccccccctgggcttcctgaaccccagactgtaccagcagcacggcgccggcctgttcgacgtgaccagaggctgccacgagagctgcctggacgaggaggtggagggccagggcttctgcagcggccccggctgggaccccgtgaccggctggggcacccccaacttccccgccctgctgaagaccctgctgaacccctag

SEQ ID NO: 13342 - DNA, 3495 bp, Artificial Sequence
  Description of Artificial Sequence: Synthetic coding sequence
atggcccagcaggccaacgtgggcgagctgctggccatgctggacagccccatgctgggcgtgagagacgacgtgaccgccgtgttcaaggagaacctgaacagcgacagaggccccatgctggtgaacaccctggtggactactacctggagaccagcagccagcccgccctgcacatcctgaccaccctgcaggagccccacgacaagcacctgctggacagaatcaacgagtacgtgggcaaggccgccaccagactgagcatcctgagcctgctgggccacgtgatcagactgcagcccagctggaagcacaagctgagccaggcccccctgctgcccagcctgctgaagtgcctgaagatggacaccgacgtggtggtgctgaccaccggcgtgctggtgctgatcaccatgctgcccatgatcccccagagcggcaagcagcacctgctggacttcttcgacatcttcggcagactgagcagctggtgcctgaagaagcccggccacgtggccgaggtgtacctggtgcacctgcacgccagcgtgtacgccctgttccacagactgtacggcatgtacccctgcaacttcgtgagcttcctgagaagccactacagcatgaaggagaacctggagaccttcgaggaggtggtgaagcccatgatggagcacgtgagaatccaccccgagctggtgaccggcagcaaggaccacgagctggaccccagaagatggaagagactggagacccacgacgtggtgatcgagtgcgccaagatcagcctggaccccaccgaggccagctacgaggacggctacagcgtgagccaccagatcagcgccagattcccccacagaagcgccgacgtgaccaccagcccctacgccgacacccagaacagctacggctgcgccaccagcaccccctacagcaccagcagactgatgctgctgaacatgcccggccagctgccccagaccctgagcagccccagcaccagactgatcaccgagcccccccaggccaccctgtggagccccagcatggtgtgcggcatgaccaccccccccaccagccccggcaacgtgccccccgacctgagccacccctacagcaaggtgttcggcaccaccgccggcggcaagggcacccccctgggcacccccgccaccagccccccccccgcccccctgtgccacagcgacgactacgtgcacatcagcctgccccaggccaccgtgaccccccccagaaaggaggagagaatggacagcgccagaccctgcctgcacagacagcaccacctgctgaacgacagaggcagcgaggagccccccggcagcaagggcagcgtgaccctgagcgacctgcccggcttcctgggcgacctggccagcgaggaggacagcatcgagaaggacaaggaggaggccgccatcagcagagagctgagcgagatcaccaccgccgaggccgagcccgtggtgcccagaggcggcttcgacagccccttctacagagacagcctgcccggcagccagagaaagacccacagcgccgccagcagcagccagggcgccagcgtgaaccccgagcccctgcacagcagcctggacaagctgggccccgacacccccaagcaggccttcacccccatcgacctgccctgcggcagcgccgacgagagccccgccggcgacagagagtgccagaccagcctggagaccagcatcttcacccccagcccctgcaagatccccccccccaccagagtgggcttcggcagcggccagccccccccctacgaccacctgttcgaggtggccctgcccaagaccgcccaccacttcgtgatcagaaagaccgaggagctgctgaagaaggccaagggcaacaccgaggaggacggcgtgcccagcaccagccccatggaggtgctggacagactgatccagcagggcgccgacgcccacagcaaggagctgaacaagctgcccctgcccagcaagagcgtggactggacccacttcggcggcagcccccccagcgacgagatcagaaccctgagagaccagctgctgctgctgcacaaccagctgctgtacgagagattcaagagacagcagcacgccctgagaaacagaagactgctgagaaaggtgatcaaggccgccgccctggaggagcacaacgccgccatgaaggaccagctgaagctgcaggagaaggacatccagatgtggaaggtgagcctgcagaaggagcaggccagatacaaccagctgcaggagcagagagacaccatggtgaccaagctgcacagccagatcagacagctgcagcacgacagagaggagttctacaaccagagccaggagctgcagaccaagctggaggactgcagaaacatgatcgccgagctgagaatcgagctgaagaaggccaacaacaaggtgtgccacaccgagctgctgctgagccaggtgagccagaagctgagcaacagcgagagcgtgcagcagcagatggagttcctgaacagacagctgctggtgctgggcgaggtgaacgagctgtacctggagcagctgcagaacaagcacagcgacaccaccaaggaggtggagatgatgaaggccgcctacagaaaggagctggagaagaacagaagccacgtgctgcagcagacccagagactggacaccagccagaagagaatcctggagctggagagccacctggccaagaaggaccacctgctgctggagcagaagaagtacctggaggacgtgaagctgcaggccagaggccagctgcaggccgccgagagcagatacgaggcccagaagagaatcacccaggtgttcgagctggagatcctggacctgtacggcagactggagaaggacggcctgctgaagaagctggaggaggagaaggccgaggccgccgaggccgccgaggagagactggactgctgcaacgacggctgcagcgacagcatggtgggccacaacgaggaggccagcggccacaacggcgagaccaagacccccagacccagcagcgccagaggcagcagcggcagcagaggcggcggcggcagcagcagcagcagcagcgagctgagcacccccgagaagcccccccaccagagagccggccccttcagcagcagatgggagaccaccatgggcgaggccagcgccagcatccccaccaccgtgggcagcctgcccagcagcaagagcttcctgggcatgaaggccagagagctgttcagaaacaagagcgagagccagtgcgacgaggacggcatgaccagcagcctgagcgagagcctgaagaccgagctgggcaaggacctgggcgtggaggccaagatccccctgaacctggacggcccccaccccagcccccccacccccgacagcgtgggccagctgcacatcatggactacaacgagacccaccacgagcacagctag

SEQ ID NO: 13343 - DNA, 1101 bp, Artificial Sequence
  Description of Artificial Sequence: Synthetic coding sequence
atggcccagcaggccaacgtgggcgagctgctggccatgctggacagccccatgctgggcgtgagagacgacgtgaccgccgtgttcaaggagaacctgaacagcgacagaggccccatgctggtgaacaccctggtggactactacctggagaccagcagccagcccgccctgcacatcctgaccaccctgcaggagccccacgacaagcacctgctggacagaatcaacgagtacgtgggcaaggccgccaccagactgagcatcctgagcctgctgggccacgtgatcagactgcagcccagctggaagcacaagctgagccaggcccccctgctgcccagcctgctgaagtgcctgaagatggacaccgacgtggtggtgctgaccaccggcgtgctggtgctgatcaccatgctgcccatgatcccccagagcggcaagcagcacctgctggacttcttcgacatcttcggcagactgagcagctggtgcctgaagaagcccggccacgtggccgaggtgtacctggtgcacctgcacgccagcgtgtacgccctgttccacagactgtacggcatgtacccctgcaacttcgtgagcttcctgagaagccactacagcatgaaggagaacctggagaccttcgaggaggtggtgaagcccatgatggagcacgtgagaatccaccccgagctggtgaccggcagcaaggaccacgagctggaccccagaagatggaagagactggagacccacgacgtggtgatcgagtgcgccaagatcagcctggaccccaccgaggccagctacgaggacggctacagcgtgagccaccagatcagcgccagattcccccacagaagcgccgacgtgaccaccagcccctacgccgacacccagaacagctacggctgcgccaccagcaccccctacagcaccagcagactgatgctgctgaacatgcccggccagctgccccagaccctgagcagccccagcaccagactgatcaccgagcccccccaggtgtggtgccagctggtgtgcctgctgagccccctgctgagcggcgaggccgaccccctgggccagatctag

SEQ ID NO: 13344 - DNA, 954 bp, Artificial Sequence
  Description of Artificial Sequence: Synthetic coding sequence
atggacaccgacgtggtggtgctgaccaccggcgtgctggtgctgatcaccatgctgcccatgatcccccagagcggcaagcagcacctgctggacttcttcgacatcttcggcagactgagcagctggtgcctgaagaagcccggccacgtggccgaggtgtacctggtgcacctgcacgccagcgtgtacgccctgttccacagactgtacggcatgtacccctgcaacttcgtgagcttcctgagaagccactacagcatgaaggagaacctggagaccttcgaggaggtggtgaagcccatgatggagcacgtgagaatccaccccgagctggtgaccggcagcaaggaccacgagctggaccccagaagatggaagagactggagacccacgacgtggtgatcgagtgcgccaagatcagcctggaccccaccgaggccagctacgaggacggctacagcgtgagccaccagatcagcgccagattcccccacagaagcgccgacgtgaccaccagcccctacgccgacacccagaacagctacggctgcgccaccagcaccccctacagcaccagcagactgatgctgctgaacatgcccggccagctgccccagaccctgagcagccccagcaccagactgatcaccgagcccccccaggccaccctgtggagccccagcatggtgtgcggcatgaccaccccccccaccagccccggcaacgtgccccccgacctgagccacccctacagcaaggtgttcggcaccaccgccggcggcaagggcacccccctgggcacccccgccaccagccccccccccgcccccagcgtgatcagaatgaccacctgcaccttccacagccccagaccccagagccacccccccggcagaaagagagagtggatcctgcaggaccacgtgtacaccgacaacaccatcttctag

SEQ ID NO: 13345 - DNA, 3495 bp, Artificial Sequence; identical to SEQ ID NO: 13342
  Description of Artificial Sequence: Synthetic coding sequence

SEQ ID NO: 13346 - DNA, 849 bp, Artificial Sequence
  Description of Artificial Sequence: Synthetic coding sequence
atggacaccgacgtggtggtgctgaccaccggcgtgctggtgctgatcaccatgctgcccatgatcccccagagcggcaagcagcacctgctggacttcttcgacatcttcggcagactgagcagctggtgcctgaagaagcccggccacgtggccgaggtgtacctggtgcacctgcacgccagcgtgtacgccctgttccacagactgtacggcatgtacccctgcaacttcgtgagcttcctgagaagccactacagcatgaaggagaacctggagaccttcgaggaggtggtgaagcccatgatggagcacgtgagaatccaccccgagctggtgaccggcagcaaggaccacgagctggaccccagaagatggaagagactggagacccacgacgtggtgatcgagtgcgccaagatcagcctggaccccaccgaggccagctacgaggacggctacagcgtgagccaccagatcagcgccagattcccccacagaagcgccgacgtgaccaccagcccctacgccgacacccagaacagctacggctgcgccaccagcaccccctacagcaccagcagactgatgctgctgaacatgcccggccacctggccaccaccgtgagacccagaccccccggccccgccgcccccggcgccgtggtggaggccgaggtggtggaggccgccgccgccgccgccgccagcttcctgccccagagaaacccccacaccagaggccaggcccacagcgccgtgggcggcagaagactgtgggagaagagactgcccgccagcccccccctgtgggcccacttccccgtgcagaaggccagctgggtgtag

SEQ ID NO: 13347 - DNA, 3342 bp, Artificial Sequence
  Description of Artificial Sequence: Synthetic coding sequence
atggcccagcaggccaacgtgggcgagctgctggccatgctggacagccccatgctgggcgtgagagacgacgtgaccgccgtgttcaaggagaacctgaacagcgacagaggccccatgctggtgaacaccctggtggactactacctggagaccagcagccagcccgccctgcacatcctgaccaccctgcaggagccccacgacaagatggacaccgacgtggtggtgctgaccaccggcgtgctggtgctgatcaccatgctgcccatgatcccccagagcggcaagcagcacctgctggacttcttcgacatcttcggcagactgagcagctggtgcctgaagaagcccggccacgtggccgaggtgtacctggtgcacctgcacgccagcgtgtacgccctgttccacagactgtacggcatgtacccctgcaacttcgtgagcttcctgagaagccactacagcatgaaggagaacctggagaccttcgaggaggtggtgaagcccatgatggagcacgtgagaatccaccccgagctggtgaccggcagcaaggaccacgagctggaccccagaagatggaagagactggagacccacgacgtggtgatcgagtgcgccaagatcagcctggaccccaccgaggccagctacgaggacggctacagcgtgagccaccagatcagcgccagattcccccacagaagcgccgacgtgaccaccagcccctacgccgacacccagaacagctacggctgcgccaccagcaccccctacagcaccagcagactgatgctgctgaacatgcccggccagctgccccagaccctgagcagccccagcaccagactgatcaccgagcccccccaggccaccctgtggagccccagcatggtgtgcggcatgaccaccccccccaccagccccggcaacgtgccccccgacctgagccacccctacagcaaggtgttcggcaccaccgccggcggcaagggcacccccctgggcacccccgccaccagccccccccccgcccccctgtgccacagcgacgactacgtgcacatcagcctgccccaggccaccgtgaccccccccagaaaggaggagagaatggacagcgccagaccctgcctgcacagacagcaccacctgctgaacgacagaggcagcgaggagccccccggcagcaagggcagcgtgaccctgagcgacctgcccggcttcctgggcgacctggccagcgaggaggacagcatcgagaaggacaaggaggaggccgccatcagcagagagctgagcgagatcaccaccgccgaggccgagcccgtggtgcccagaggcggcttcgacagccccttctacagagacagcctgcccggcagccagagaaagacccacagcgccgccagcagcagccagggcgccagcgtgaaccccgagcccctgcacagcagcctggacaagctgggccccgacacccccaagcaggccttcacccccatcgacctgccctgcggcagcgccgacgagagccccgccggcgacagagagtgccagaccagcctggagaccagcatcttcacccccagcccctgcaagatccccccccccaccagagtgggcttcggcagcggccagccccccccctacgaccacctgttcgaggtggccctgcccaagaccgcccaccacttcgtgatcagaaagaccgaggagctgctgaagaaggccaagggcaacaccgaggaggacggcgtgcccagcaccagccccatggaggtgctggacagactgatccagcagggcgccgacgcccacagcaaggagctgaacaagctgcccctgcccagcaagagcgtggactggacccacttcggcggcagcccccccagcgacgagatcagaaccctgagagaccagctgctgctgctgcacaaccagctgctgtacgagagattcaagagacagcagcacgccctgagaaacagaagactgctgagaaaggtgatcaaggccgccgccctggaggagcacaacgccgccatgaaggaccagctgaagctgcaggagaaggacatccagatgtggaaggtgagcctgcagaaggagcaggccagatacaaccagctgcaggagcagagagacaccatggtgaccaagctgcacagccagatcagacagctgcagcacgacagagaggagttctacaaccagagccaggagctgcagaccaagctggaggactgcagaaacatgatcgccgagctgagaatcgagctgaagaaggccaacaacaaggtgtgccacaccgagctgctgctgagccaggtgagccagaagctgagcaacagcgagagcgtgcagcagcagatggagttcctgaacagacagctgctggtgctgggcgaggtgaacgagctgtacctggagcagctgcagaacaagcacagcgacaccaccaaggaggtggagatgatgaaggccgcctacagaaaggagctggagaagaacagaagccacgtgctgcagcagacccagagactggacaccagccagaagagaatcctggagctggagagccacctggccaagaaggaccacctgctgctggagcagaagaagtacctggaggacgtgaagctgcaggccagaggccagctgcaggccgccgagagcagatacgaggcccagaagagaatcacccaggtgttcgagctggagatcctggacctgtacggcagactggagaaggacggcctgctgaagaagctggaggaggagaaggccgaggccgccgaggccgccgaggagagactggactgctgcaacgacggctgcagcgacagcatggtgggccacaacgaggaggccagcggccacaacggcgagaccaagacccccagacccagcagcgccagaggcagcagcggcagcagaggcggcggcggcagcagcagcagcagcagcgagctgagcacccccgagaagcccccccaccagagagccggccccttcagcagcagatgggagaccaccatgggcgaggccagcgccagcatccccaccaccgtgggcagcctgcccagcagcaagagcttcctgggcatgaaggccagagagctgttcagaaacaagagcgagagccagtgcgacgaggacggcatgaccagcagcctgagcgagagcctgaagaccgagctgggcaaggacctgggcgtggaggccaagatccccctgaacctggacggcccccaccccagcccccccacccccgacagcgtgggccagctgcacatcatggactacaacgagacccaccacgagcacagctag

SEQ ID NO: 13348 - DNA, 2397 bp, Artificial Sequence
  Description of Artificial Sequence: Synthetic coding sequence
atggccctgcacagcccccagtacatcttcggcgacttcagccccgacgagttcaaccagttcttcgtgacccccagaagcagcgtggagctgcccccctacagcggcaccgtgctgtgcggcacccaggccgtggacaagctgcccgacggccaggagtaccagagaatcgagttcggcgtggacgaggtgatcgagcccagcgacaccctgcccagaacccccagctacagcatcagcagcaccctgaacccccaggcccccgagttcatcctgggctgcaccgccagcaagatcacccccgacggcatcaccaaggaggccagctacggcagcatcgactgccagtaccccggcagcgccctggccctggacggcagcagcaacgtggaggccgaggtgctggagaacgacggcgtgagcggcggcctgggccagagagagagaaagaagaagaagaagagaccccccggctactacagctacctgaaggacggcggcgacgacagcatcagcaccgaggccctggtgaacggccacgccaacagcgccgtgcccaacagcgtgagcgccgaggacgccgagttcatgggcgacatgccccccagcgtgacccccagaacctgcaacagcccccagaacagcaccgacagcgtgagcgacatcgtgcccgacagccccttccccggcgccctgggcagcgacaccagaaccgccggccagcccgagggcggccccggcgccgacttcggccagagctgcttccccgccgaggccggcagagacaccctgagcagaaccgccggcgcccagccctgcgtgggcaccgacaccaccgagaacctgggcgtggccaacggccagatcctggagagcagcggcgagggcaccgccaccaacggcgtggagctgcacaccaccgagagcatcgacctggaccccaccaagcccgagagcgccagcccccccgccgacggcaccggcagcgccagcggcaccctgcccgtgagccagcccaagagctgggccagcctgttccacgacagcaagcccagcagcagcagccccgtggcctacgtggagaccaagtacagcccccccgccatcagccccctggtgagcgagaagcaggtggaggtgaaggagggcctggtgcccgtgagcgaggaccccgtggccatcaagatcgccgagctgctggagaacgtgaccctgatccacaagcccgtgagcctgcagcccagaggcctgatcaacaagggcaactggtgctacatcaacgccaccctgcaggccctggtggcctgcccccccatgtaccacctgatgaagttcatccccctgtacagcaaggtgcagagaccctgcaccagcacccccatgatcgacagcttcgtgagactgatgaacgagttcaccaacatgcccgtgccccccaagcccagacaggccctgggcgacaagatcgtgagagacatcagacccggcgccgccttcgagcccacctacatctacagactgctgaccgtgaacaagagcagcctgagcgagaagggcagacaggaggacgccgaggagtacctgggcttcatcctgaacggcctgcacgaggagatgctgaacctgaagaagctgctgagccccagcaacgagaagctgaccatcagcaacggccccaagaaccacagcgtgaacgaggaggagcaggaggagcagggcgagggcagcgaggacgagtgggagcaggtgggccccagaaacaagaccagcgtgaccagacaggccgacttcgtgcagacccccatcaccggcatcttcggcggccacatcagaagcgtggtgtaccagcagagcagcaaggagagcgccaccctgcagcccttcttcaccctgcagctggacatccagagcgacaagatcagaaccgtgcaggacgccctggagagcctggtggccagagagagcgtgcagggctacaccaccaagaccaagcaggaggtggagatcagcagaagagtgaccctggagaagctgccccccgtgctggtgctgcacctgaagagattcgtgtacgagaagaccggcggctgccagaagctgatcaagaacatcgagtaccccgtggacctggagatcagcaaggagctgctgagccccggcgtgaagaacaagaacttcaagtgccacagaacctacagactgttcgccgtggtgtaccaccacggcaacagcgccaccggcggccactacaccaccgacgtgttccagatcggcctgaacggctggctgagaatcgacgaccagaccgtgaaggtgatcaaccagtaccaggtggtgaagcccaccgccgagagaaccgcctacctgctgtactacagaagagtggacctgctgtag

SEQ ID NO: 13349 - DNA, 5355 bp, Artificial Sequence
  Description of Artificial Sequence: Synthetic coding sequence
atggccaagcccaccagcaaggacagcggcctgaaggagaagttcaagatcctgctgggcctgggcacccccagacccaaccccagaagcgccgagggcaagcagaccgagttcatcatcaccgccgagatcctgagagagctgagcatggagtgcggcctgaacaacagaatcagaatgatcggccagatctgcgaggtggccaagaccaagaagttcgaggagcacgccgtggaggccctgtggaaggccgtggccgacctgctgcagcccgagagacccctggaggccagacacgccgtgctggccctgctgaaggccatcgtgcagggccagggcgagagactgggcgtgctgagagccctgttcttcaaggtgatcaaggactaccccagcaacgaggacctgcacgagagactggaggtgttcaaggccctgaccgacaacggcagacacatcacctacctggaggaggagctggccgacttcgtgctgcagtggatggacgtgggcctgagcagcgagttcctgctggtgctggtgaacctggtgaagttcaacagctgctacctggacgagtacatcgccagaatggtgcagatgatctgcctgctgtgcgtgagaaccgccagcagcgtggacatcgaggtgagcctgcaggtgctggacgccgtggtgtgctacaactgcctgcccgccgagagcctgcccctgttcatcgtgaccctgtgcagaaccatcaacgtgaaggagctgtgcgagccctgctggaagctgatgagaaacctgctgggcacccacctgggccacagcgccatctacaacatgtgccacctgatggaggacagagcctacatggaggacgcccccctgctgagaggcgccgtgttcttcgtgggcatggccctgtggggcgcccacagactgtacagcctgagaaacagccccaccagcgtgctgcccagcttctaccaggccatggcctgccccaacgaggtggtgagctacgagatcgtgctgagcatcaccagactgatcaagaagtacagaaaggagctgcaggtggtggcctgggacatcctgctgaacatcatcgagagactgctgcagcagctgcagaccctggacagccccgagctgagaaccatcgtgcacgacctgctgaccaccgtggaggagctgtgcgaccagaacgagttccacggcagccaggagagatacttcgagctggtggagagatgcgccgaccagagacccgagagcagcctgctgaacctgatcagctacagagcccagagcatccaccccgccaaggacggctggatccagaacctgcaggccctgatggagagattcttcagaagcgagagcagaggcgccgtgagaatcaaggtgctggacgtgctgagcttcgtgctgctgatcaacagacagttctacgaggaggagctgatcaacagcgtggtgatcagccagctgagccacatccccgaggacaaggaccaccaggtgagaaagctggccacccagctgctggtggacctggccgagggctgccacacccaccacttcaacagcctgctggacatcatcgagaaggtgatggccagaagcctgagccccccccccgagctggaggagagagacgtggccgcctacagcgccagcctggaggacgtgaagaccgccgtgctgggcctgctggtgatcctgcagaccaagctgtacaccctgcccgccagccacgccaccagagtgtacgagatgctggtgagccacatccagctgcactacaagcacagctacaccctgcccatcgccagcagcatcagactgcaggccttcgacttcctgctgctgctgagagccgacagcctgcacagactgggcctgcccaacaaggacggcgtggtgagattcagcccctactgcgtgtgcgactacatggagcccgagagaggcagcgagaagaagaccagcggccccctgagcccccccaccggcccccccggccccgcccccgccggccccgccgtgagactgggcagcgtgccctacagcctgctgttcagagtgctgctgcagtgcctgaagcaggagagcgactggaaggtgctgaagctggtgctgggcagactgcccgagagcctgagatacaaggtgctgatcttcaccagcccctgcagcgtggaccagctgtgcagcgccctgtgcagcatgctgagcggccccaagaccctggagagactgagaggcgcccccgagggcttcagcagaaccgacctgcacctggccgtggtgcccgtgctgaccgccctgatcagctaccacaactacctggacaagaccaagcagagagagatggtgtactgcctggagcagggcctgatccacagatgcgccagccagtgcgtggtggccctgagcatctgcagcgtggagatgcccgacatcatcatcaaggccctgcccgtgctggtggtgaagctgacccacatcagcgccaccgccagcatggccgtgcccctgctggagttcctgagcaccctggccagactgccccacctgtacagaaacttcgccgccgagcagtacgccagcgtgttcgccatcagcctgccctacaccaaccccagcaagttcaaccagtacatcgtgtgcctggcccaccacgtgatcgccatgtggttcatcagatgcagactgcccttcagaaaggacttcgtgcccttcatcaccaagggcctgagaagcaacgtgctgctgagcttcgacgacacccccgagaaggacagcttcagagccagaagcaccagcctgaacgagagacccaagagcctgagaatcgccagaccccccaagcagggcctgaacaacagcccccccgtgaaggagttcaaggagagcagcgccgccgaggccttcagatgcagaagcatcagcgtgagcgagcacgtggtgagaagcagaatccagaccagcctgaccagcgccagcctgggcagcgccgacgagaacagcgtggcccaggccgacgacagcctgaagaacctgcacctggagctgaccgagacctgcctggacatgatggccagatacgtgttcagcaacttcaccgccgtgcccaagagaagccccgtgggcgagttcctgctggccggcggcagaaccaagacctggctggtgggcaacaagctggtgaccgtgaccaccagcgtgggcaccggcaccagaagcctgctgggcctggacagcggcgagctgcagagcggccccgagagcagcagcagccccggcgtgcacgtgagacagaccaaggaggcccccgccaagctggagagccaggccggccagcaggtgagcagaggcgccagagacagagtgagaagcatgagcggcggccacggcctgagagtgggcgccctggacgtgcccgccagccagttcctgggcagcgccaccagccccggccccagaaccgcccccgccgccaagcccgagaaggccagcgccggcaccagagtgcccgtgcaggagaagaccaacctggccgcctacgtgcccctgctgacccagggctgggccgagatcctggtgagaagacccaccggcaacaccagctggctgatgagcctggagaaccccctgagccccttcagcagcgacatcaacaacatgcccctgcaggagctgagcaacgccctgatggccgccgagagattcaaggagcacagagacaccgccctgtacaagagcctgagcgtgcccgccgccagcaccgccaagcccccccccctgcccagaagcaacaccgacagcgccgtggtgatggaggagggcagccccggcgaggtgcccgtgctggtggagccccccggcctggaggacgtggaggccgccctgggcatggacagaagaaccgacgcctacagcagaagcagcagcgtgagcagccaggaggagaagagcctgcacgccgaggagctggtgggcagaggcatccccatcgagagagtggtgagcagcgagggcggcagacccagcgtggacctgagcttccagcccagccagcccctgagcaagagcagcagcagccccgagctgcagaccctgcaggacatcctgggcgaccccggcgacaaggccgacgtgggcagactgagccccgaggtgaaggccagaagccagagcggcaccctggacggcgagagcgccgcctggagcgccagcggcgaggacagcagaggccagcccgagggccccctgcccagcagcagccccagaagccccagcggcctgagacccagaggctacaccatcagcgacagcgcccccagcagaagaggcaagagagtggagagagacgccctgaagagcagagccaccgccagcaacgccgagaaggtgcccggcatcaaccccagcttcgtgttcctgcagctgtaccacagccccttcttcggcgacgagagcaacaagcccatcctgctgcccaacgagagccagagcttcgagagaagcgtgcagctgctggaccagatccccagctacgacacccacaagatcgccgtgctgtacgtgggcgagggccagagcaacagcgagctggccatcctgagcaacgagcacggcagctacagatacaccgagttcctgaccggcctgggcagactgatcgagctgaaggactgccagcccgacaaggtgtacctgggcggcctggacgtgtgcggcgaggacggccagttcacctactgctggcacgacgacatcatgcaggccgtgttccacatcgccaccctgatgcccaccaaggacgtggacaagcacagatgcgacaagaagagacacctgggcaacgacttcgtgagcatcgtgtacaacgacagcggcgaggacttcaagctgggcaccatcaagggccagttcaacttcgtgcacgtgatcgtgacccccctggactacgagtgcaacctggtgagcctgcagtgcagaaaggacatggagggcctggtggacaccagcgtggccaagatcgtgagcgacagaaacctgcccttcgtggccagacagatggccctgcacgccaacatggccagccaggtgcaccacagcagaagcaaccccaccgacatctaccccagcaagtggatcgccagactgagacacatcaagagactgagacagagaatctgcgaggaggccgcctacagcaaccccagcctgcccctggtgcacccccccagccacagcaaggcccccgcccagacccccgccgagcccacccccggctacgaggtgggccagagaaagagactgatcagcagcgtggaggacttcaccgagttcgtgtag

SEQ ID NO: 13350 - DNA, 5295 bp, Artificial Sequence
  Description of Artificial Sequence: Synthetic coding sequence
atggccaagcccaccagcaaggacagcggcctgaaggagaagttcaagatcctgctgggcctgggcacccccagacccaaccccagaagcgccgagggcaagcagaccgagttcatcatcaccgccgagatcctgagagagctgagcatggagtgcggcctgaacaacagaatcagaatgatcggccagatctgcgaggtggccaagaccaagaagttcgaggagcacgccgtggaggccctgtggaaggccgtggccgacctgctgcagcccgagagacccctggaggccagacacgccgtgctggccctgctgaaggccatcgtgcagggccagggcgagagactgggcgtgctgagagccctgttcttcaaggtgatcaaggactaccccagcaacgaggacctgcacgagagactggaggtgttcaaggccctgaccgacaacggcagacacatcacctacctggaggaggagctggccgacttcgtgctgcagtggatggacgtgggcctgagcagcgagttcctgctggtgctggtgaacctggtgaagttcaacagctgctacctggacgagtacatcgccagaatggtgcagatgatctgcctgctgtgcgtgagaaccgccagcagcgtggacatcgaggtgagcctgcaggtgctggacgccgtggtgtgctacaactgcctgcccgccgagagcctgcccctgttcatcgtgaccctgtgcagaaccatcaacgtgaaggagctgtgcgagccctgctggaagctgatgagaaacctgctgggcacccacctgggccacagcgccatctacaacatgtgccacctgatggaggacagagcctacatggaggacgcccccctgctgagaggcgccgtgttcttcgtgggcatggccctgtggggcgcccacagactgtacagcctgagaaacagccccaccagcgtgctgcccagcttctaccaggccatggcctgccccaacgaggtggtgagctacgagatcgtgctgagcatcaccagactgatcaagaagtacagaaaggagctgcaggtggtggcctgggacatcctgctgaacatcatcgagagactgctgcagcagctgcagaccctggacagccccgagctgagaaccatcgtgcacgacctgctgaccaccgtggaggagctgtgcgaccagaacgagttccacggcagccaggagagatacttcgagctggtggagagatgcgccgaccagagacccgagagcagcctgctgaacctgatcagctacagagcccagagcatccaccccgccaaggacggctggatccagaacctgcaggccctgatggagagattcttcagaagcgagagcagaggcgccgtgagaatcaaggtgctggacgtgctgagcttcgtgctgctgatcaacagacagttctacgaggaggagctgatcaacagcgtggtgatcagccagctgagccacatccccgaggacaaggaccaccaggtgagaaagctggccacccagctgctggtggacctggccgagggctgccacacccaccacttcaacagcctgctggacatcatcgagaaggtgatggccagaagcctgagccccccccccgagctggaggagagagacgtggccgcctacagcgccagcctggaggacgtgaagaccgccgtgctgggcctgctggtgatcctgcagaccaagctgtacaccctgcccgccagccacgccaccagagtgtacgagatgctggtgagccacatccagctgcactacaagcacagctacaccctgcccatcgccagcagcatcagactgcaggccttcgacttcctgctgctgctgagagccgacagcctgcacagactgggcctgcccaacaaggacggcgtggtgagattcagcccctactgcgtgtgcgactacatggagcccgagagaggcagcgagaagaagaccagcggccccctgagcccccccaccggcccccccggccccgcccccgccggccccgccgtgagactgggcagcgtgccctacagcctgctgttcagagtgctgctgcagtgcctgaagcaggagagcgactggaaggtgctgaagctggtgctgggcagactgcccgagagcctgagatacaaggtgctgatcttcaccagcccctgcagcgtggaccagctgtgcagcgccctgtgcagcatgctgagcggccccaagaccctggagagactgagaggcgcccccgagggcttcagcagaaccgacctgcacctggccgtggtgcccgtgctgaccgccctgatcagctaccacaactacctggacaagaccaagcagagagagatggtgtactgcctggagcagggcctgatccacagatgcgccagccagtgcgtggtggccctgagcatctgcagcgtggagatgcccgacatcatcatcaaggccctgcccgtgctggtggtgaagctgacccacatcagcgccaccgccagcatggccgtgcccctgctggagttcctgagcaccctggccagactgccccacctgtacagaaacttcgccgccgagcagtacgccagcgtgttcgccatcagcctgccctacaccaaccccagcaagttcaaccagtacatcgtgtgcctggcccaccacgtgatcgccatgtggttcatcagatgcagactgcccttcagaaaggacttcgtgcccttcatcaccaagggcctgagaagcaacgtgctgctgagcttcgacgacacccccgagaaggacagcttcagagccagaagcaccagcctgaacgagagacccaagagcagaatccagaccagcctgaccagcgccagcctgggcagcgccgacgagaacagcgtggcccaggccgacgacagcctgaagaacctgcacctggagctgaccgagacctgcctggacatgatggccagatacgtgttcagcaacttcaccgccgtgcccaagagaagccccgtgggcgagttcctgctggccggcggcagaaccaagacctggctggtgggcaacaagctggtgaccgtgaccaccagcgtgggcaccggcaccagaagcctgctgggcctggacagcggcgagctgcagagcggccccgagagcagcagcagccccggcgtgcacgtgagacagaccaaggaggcccccgccaagctggagagccaggccggccagcaggtgagcagaggcgccagagacagagtgagaagcatgagcggcggccacggcctgagagtgggcgccctggacgtgcccgccagccagttcctgggcagcgccaccagccccggccccagaaccgcccccgccgccaagcccgagaaggccagcgccggcaccagagtgcccgtgcaggagaagaccaacctggccgcctacgtgcccctgctgacccagggctgggccgagatcctggtgagaagacccaccggcaacaccagctggctgatgagcctggagaaccccctgagccccttcagcagcgacatcaacaacatgcccctgcaggagctgagcaacgccctgatggccgccgagagattcaaggagcacagagacaccgccctgtacaagagcctgagcgtgcccgccgccagcaccgccaagcccccccccctgcccagaagcaacaccgtggccagcttcagcagcctgtaccagagcagctgccagggccagctgcacagaagcgtgagctgggccgacagcgccgtggtgatggaggagggcagccccggcgaggtgcccgtgctggtggagccccccggcctggaggacgtggaggccgccctgggcatggacagaagaaccgacgcctacagcagaagcagcagcgtgagcagccaggaggagaagagcctgcacgccgaggagctggtgggcagaggcatccccatcgagagagtggtgagcagcgagggcggcagacccagcgtggacctgagcttccagcccagccagcccctgagcaagagcagcagcagccccgagctgcagaccctgcaggacatcctgggcgaccccggcgacaaggccgacgtgggcagactgagccccgaggtgaaggccagaagccagagcggcaccctggacggcgagagcgccgcctggagcgccagcggcgaggacagcagaggccagcccgagggccccctgcccagcagcagccccagaagccccagcggcctgagacccagaggctacaccatcagcgacagcgcccccagcagaagaggcaagagagtggagagagacgccctgaagagcagagccaccgccagcaacgccgagaaggtgcccggcatcaaccccagcttcgtgttcctgcagctgtaccacagccccttcttcggcgacgagagcaacaagcccatcctgctgcccaacgagagccagagcttcgagagaagcgtgcagctgctggaccagatccccagctacgacacccacaagatcgccgtgctgtacgtgggcgagggccagagcaacagcgagctggccatcctgagcaacgagcacggcagctacagatacaccgagttcctgaccggcctgggcagactgatcgagctgaaggactgccagcccgacaaggtgtacctgggcggcctggacgtgtgcggcgaggacggccagttcacctactgctggcacgacgacatcatgcaggccgtgttccacatcgccaccctgatgcccaccaaggacgtggacaagcacagatgcgacaagaagagacacctgggcaacgacttcgtgagcatcgtgtacaacgacagcggcgaggacttcaagctgggcaccatcaagggccagttcaacttcgtgcacgtgatcgtgacccccctggactacgagtgcaacctggtgagcctgcagtgcagaaaggacatggagggcctggtggacaccagcgtggccaagatcgtgagcgacagaaacctgcccttcgtggccagacagatggccctgcacgccaacatggccagccaggtgcaccacagcagaagcaaccccaccgacatctaccccagcaagtggatcgccagactgagacacatcaagagactgagacagagaatctgcgaggaggccgcctacagcaaccccagcctgcccctggtgcacccccccagccacagcaaggcccccgcccagacccccgccgagcccacccccggctacgaggtgggccagagaaagagactgatcagcagcgtggaggacttcaccgagttcgtgtag

SEQ ID NO: 13351 - DNA, 5079 bp, Artificial Sequence
  Description of Artificial Sequence: Synthetic coding sequence
atggagtgcggcctgaacaacagaatcagaatgatcggccagatctgcgaggtggccaagaccaagaagttcgaggagcacgccgtggaggccctgtggaaggccgtggccgacctgctgcagcccgagagacccctggaggccagacacgccgtgctggccctgctgaaggccatcgtgcagggccagggcgagagactgggcgtgctgagagccctgttcttcaaggtgatcaaggactaccccagcaacgaggacctgcacgagagactggaggtgttcaaggccctgaccgacaacggcagacacatcacctacctggaggaggagctggccgacttcgtgctgcagtggatggacgtgggcctgagcagcgagttcctgctggtgctggtgaacctggtgaagttcaacagctgctacctggacgagtacatcgccagaatggtgcagatgatctgcctgctgtgcgtgagaaccgccagcagcgtggacatcgaggtgagcctgcaggtgctggacgccgtggtgtgctacaactgcctgcccgccgagagcctgcccctgttcatcgtgaccctgtgcagaaccatcaacgtgaaggagctgtgcgagccctgctggaagctgatgagaaacctgctgggcacccacctgggccacagcgccatctacaacatgtgccacctgatggaggacagagcctacatggaggacgcccccctgctgagaggcgccgtgttcttcgtgggcatggccctgtggggcgcccacagactgtacagcctgagaaacagccccaccagcgtgctgcccagcttctaccaggccatggcctgccccaacgaggtggtgagctacgagatcgtgctgagcatcaccagactgatcaagaagtacagaaaggagctgcaggtggtggcctgggacatcctgctgaacatcatcgagagactgctgcagcagctgcagaccctggacagccccgagctgagaaccatcgtgcacgacctgctgaccaccgtggaggagctgtgcgaccagaacgagttccacggcagccaggagagatacttcgagctggtggagagatgcgccgaccagagacccgagagcagcctgctgaacctgatcagctacagagcccagagcatccaccccgccaaggacggctggatccagaacctgcaggccctgatggagagattcttcagaagcgagagcagaggcgccgtgagaatcaaggtgctggacgtgctgagcttcgtgctgctgatcaacagacagttctacgaggaggagctgatcaacagcgtggtgatcagccagctgagccacatccccgaggacaaggaccaccaggtgagaaagctggccacccagctgctggtggacctggccgagggctgccacacccaccacttcaacagcctgctggacatcatcgagaaggtgatggccagaagcctgagccccccccccgagctggaggagagagacgtggccgcctacagcgccagcctggaggacgtgaagaccgccgtgctgggcctgctggtgatcctgcagaccaagctgtacaccctgcccgccagccacgccaccagagtgtacgagatgctggtgagccacatccagctgcactacaagcacagctacaccctgcccatcgccagcagcatcagactgcaggccttcgacttcctgctgctgctgagagccgacagcctgcacagactgggcctgcccaacaaggacggcgtggtgagattcagcccctactgcgtgtgcgactacatggagcccgagagaggcagcgagaagaagaccagcggccccctgagcccccccaccggcccccccggccccgcccccgccggccccgccgtgagactgggcagcgtgccctacagcctgctgttcagagtgctgctgcagtgcctgaagcaggagagcgactggaaggtgctgaagctggtgctgggcagactgcccgagagcctgagatacaaggtgctgatcttcaccagcccctgcagcgtggaccagctgtgcagcgccctgtgcagcatgctgagcggccccaagaccctggagagactgagaggcgcccccgagggcttcagcagaaccgacctgcacctggccgtggtgcccgtgctgaccgccctgatcagctaccacaactacctggacaagaccaagcagagagagatggtgtactgcctggagcagggcctgatccacagatgcgccagccagtgcgtggtggccctgagcatctgcagcgtggagatgcccgacatcatcatcaaggccctgcccgtgctggtggtgaagctgacccacatcagcgccaccgccagcatggccgtgcccctgctggagttcctgagcaccctggccagactgccccacctgtacagaaacttcgccgccgagcagtacgccagcgtgttcgccatcagcctgccctacaccaaccccagcaagttcaaccagtacatcgtgtgcctggcccaccacgtgatcgccatgtggttcatcagatgcagactgcccttcagaaaggacttcgtgcccttcatcaccaagggcctgagaagcaacgtgctgctgagcttcgacgacacccccgagaaggacagcttcagagccagaagcaccagcctgaacgagagacccaagagcagaatccagaccagcctgaccagcgccagcctgggcagcgccgacgagaacagcgtggcccaggccgacgacagcctgaagaacctgcacctggagctgaccgagacctgcctggacatgatggccagatacgtgttcagcaacttcaccgccgtgcccaagagaagccccgtgggcgagttcctgctggccggcggcagaaccaagacctggctggtgggcaacaagctggtgaccgtgaccaccagcgtgggcaccggcaccagaagcctgctgggcctggacagcggcgagctgcagagcggccccgagagcagcagcagccccggcgtgcacgtgagacagaccaaggaggcccccgccaagctggagagccaggccggccagcaggtgagcagaggcgccagagacagagtgagaagcatgagcggcggccacggcctgagagtgggcgccctggacgtgcccgccagccagttcctgggcagcgccaccagccccggccccagaaccgcccccgccgccaagcccgagaaggccagcgccggcaccagagtgcccgtgcaggagaagaccaacctggccgcctacgtgcccctgctgacccagggctgggccgagatcctggtgagaagacccaccggcaacaccagctggctgatgagcctggagaaccccctgagccccttcagcagcgacatcaacaacatgcccctgcaggagctgagcaacgccctgatggccgccgagagattcaaggagcacagagacaccgccctgtacaagagcctgagcgtgcccgccgccagcaccgccaagcccccccccctgcccagaagcaacaccgacagcgccgtggtgatggaggagggcagccccggcgaggtgcccgtgctggtggagccccccggcctggaggacgtggaggccgccctgggcatggacagaagaaccgacgcctacagcagaagcagcagcgtgagcagccaggaggagaagagcctgcacgccgaggagctggtgggcagaggcatccccatcgagagagtggtgagcagcgagggcggcagacccagcgtggacctgagcttccagcccagccagcccctgagcaagagcagcagcagccccgagctgcagaccctgcaggacatcctgggcgaccccggcgacaaggccgacgtgggcagactgagccccgaggtgaaggccagaagccagagcggcaccctggacggcgagagcgccgcctggagcgccagcggcgaggacagcagaggccagcccgagggccccctgcccagcagcagccccagaagccccagcggcctgagacccagaggctacaccatcagcgacagcgcccccagcagaagaggcaagagagtggagagagacgccctgaagagcagagccaccgccagcaacgccgagaaggtgcccggcatcaaccccagcttcgtgttcctgcagctgtaccacagccccttcttcggcgacgagagcaacaagcccatcctgctgcccaacgagagccagagcttcgagagaagcgtgcagctgctggaccagatccccagctacgacacccacaagatcgccgtgctgtacgtgggcgagggccagagcaacagcgagctggccatcctgagcaacgagcacggcagctacagatacaccgagttcctgaccggcctgggcagactgatcgagctgaaggactgccagcccgacaaggtgtacctgggcggcctggacgtgtgcggcgaggacggccagttcacctactgctggcacgacgacatcatgcaggccgtgttccacatcgccaccctgatgcccaccaaggacgtggacaagcacagatgcgacaagaagagacacctgggcaacgacttcgtgagcatcgtgtacaacgacagcggcgaggacttcaagctgggcaccatcaagggccagttcaacttcgtgcacgtgatcgtgacccccctggactacgagtgcaacctggtgagcctgcagtgcagaaaggacatggagggcctggtggacaccagcgtggccaagatcgtgagcgacagaaacctgcccttcgtggccagacagatggccctgcacgccaacatggccagccaggtgcaccacagcagaagcaaccccaccgacatctaccccagcaagtggatcgccagactgagacacatcaagagactgagacagagaatctgcgaggaggccgcctacagcaaccccagcctgcccctggtgcacccccccagccacagcaaggcccccgcccagacccccgccgagcccacccccggctacgaggtgggccagagaaagagactgatcagcagcgtggaggacttcaccgagttcgtgtag

SEQ ID NO: 13352 - DNA, 5226 bp, Artificial Sequence
  Description of Artificial Sequence: Synthetic coding sequence
atggccaagcccaccagcaaggacagcggcctgaaggagaagttcaagatcctgctgggcctgggcacccccagacccaaccccagaagcgccgagggcaagcagaccgagttcatcatcaccgccgagatcctgagagagctgagcatggagtgcggcctgaacaacagaatcagaatgatcggccagatctgcgaggtggccaagaccaagaagttcgaggagcacgccgtggaggccctgtggaaggccgtggccgacctgctgcagcccgagagacccctggaggccagacacgccgtgctggccctgctgaaggccatcgtgcagggccagggcgagagactgggcgtgctgagagccctgttcttcaaggtgatcaaggactaccccagcaacgaggacctgcacgagagactggaggtgttcaaggccctgaccgacaacggcagacacatcacctacctggaggaggagctggccgacttcgtgctgcagtggatggacgtgggcctgagcagcgagttcctgctggtgctggtgaacctggtgaagttcaacagctgctacctggacgagtacatcgccagaatggtgcagatgatctgcctgctgtgcgtgagaaccgccagcagcgtggacatcgaggtgagcctgcaggtgctggacgccgtggtgtgctacaactgcctgcccgccgagagcctgcccctgttcatcgtgaccctgtgcagaaccatcaacgtgaaggagctgtgcgagccctgctggaagctgatgagaaacctgctgggcacccacctgggccacagcgccatctacaacatgtgccacctgatggaggacagagcctacatggaggacgcccccctgctgagaggcgccgtgttcttcgtgggcatggccctgtggggcgcccacagactgtacagcctgagaaacagccccaccagcgtgctgcccagcttctaccaggccatggcctgccccaacgaggtggtgagctacgagatcgtgctgagcatcaccagactgatcaagaagtacagaaaggagctgcaggtggtggcctgggacatcctgctgaacatcatcgagagactgctgcagcagctgcagaccctggacagccccgagctgagaaccatcgtgcacgacctgctgaccaccgtggaggagctgtgcgaccagaacgagttccacggcagccaggagagatacttcgagctggtggagagatgcgccgaccagagacccgagagcagcctgctgaacctgatcagctacagagcccagagcatccaccccgccaaggacggctggatccagaacctgcaggccctgatggagagattcttcagaagcgagagcagaggcgccgtgagaatcaaggtgctggacgtgctgagcttcgtgctgctgatcaacagacagttctacgaggaggagctgatcaacagcgtggtgatcagccagctgagccacatccccgaggacaaggaccaccaggtgagaaagctggccacccagctgctggtggacctggccgagggctgccacacccaccacttcaacagcctgctggacatcatcgagaaggtgatggccagaagcctgagccccccccccgagctggaggagagagacgtggccgcctacagcgccagcctggaggacgtgaagaccgccgtgctgggcctgctggtgatcctgcagaccaagctgtacaccctgcccgccagccacgccaccagagtgtacgagatgctggtgagccacatccagctgcactacaagcacagctacaccctgcccatcgccagcagcatcagactgcaggccttcgacttcctgctgctgctgagagccgacagcctgcacagactgggcctgcccaacaaggacggcgtggtgagattcagcccctactgcgtgtgcgactacatggagcccgagagaggcagcgagaagaagaccagcggccccctgagcccccccaccggcccccccggccccgcccccgccggccccgccgtgagactgggcagcgtgccctacagcctgctgttcagagtgctgctgcagtgcctgaagcaggagagcgactggaaggtgctgaagctggtgctgggcagactgcccgagagcctgagatacaaggtgctgatcttcaccagcccctgcagcgtggaccagctgtgcagcgccctgtgcagcatgctgagcggccccaagaccctggagagactgagaggcgcccccgagggcttcagcagaaccgacctgcacctggccgtggtgcccgtgctgaccgccctgatcagctaccacaactacctggacaagaccaagcagagagagatggtgtactgcctggagcagggcctgatccacagatgcgccagccagtgcgtggtggccctgagcatctgcagcgtggagatgcccgacatcatcatcaaggccctgcccgtgctggtggtgaagctgacccacatcagcgccaccgccagcatggccgtgcccctgctggagttcctgagcaccctggccagactgccccacctgtacagaaacttcgccgccgagcagtacgccagcgtgttcgccatcagcctgccctacaccaaccccagcaagttcaaccagtacatcgtgtgcctggcccaccacgtgatcgccatgtggttcatcagatgcagactgcccttcagaaaggacttcgtgcccttcatcaccaagggcctgagaagcaacgtgctgctgagcttcgacgacacccccgagaaggacagcttcagagccagaagcaccagcctgaacgagagacccaagagcagaatccagaccagcctgaccagcgccagcctgggcagcgccgacgagaacagcgtggcccaggccgacgacagcctgaagaacctgcacctggagctgaccgagacctgcctggacatgatggccagatacgtgttcagcaacttcaccgccgtgcccaagagaagccccgtgggcgagttcctgctggccggcggcagaaccaagacctggctggtgggcaacaagctggtgaccgtgaccaccagcgtgggcaccggcaccagaagcctgctgggcctggacagcggcgagctgcagagcggccccgagagcagcagcagccccggcgtgcacgtgagacagaccaaggaggcccccgccaagctggagagccaggccggccagcaggtgagcagaggcgccagagacagagtgagaagcatgagcggcggccacggcctgagagtgggcgccctggacgtgcccgccagccagttcctgggcagcgccaccagccccggccccagaaccgcccccgccgccaagcccgagaaggccagcgccggcaccagagtgcccgtgcaggagaagaccaacctggccgcctacgtgcccctgctgacccagggctgggccgagatcctggtgagaagacccaccggcaacaccagctggctgatgagcctggagaaccccctgagccccttcagcagcgacatcaacaacatgcccctgcaggagctgagcaacgccctgatggccgccgagagattcaaggagcacagagacaccgccctgtacaagagcctgagcgtgcccgccgccagcaccgccaagcccccccccctgcccagaagcaacaccgacagcgccgtggtgatggaggagggcagccccggcgaggtgcccgtgctggtggagccccccggcctggaggacgtggaggccgccctgggcatggacagaagaaccgacgcctacagcagaagcagcagcgtgagcagccaggaggagaagagcctgcacgccgaggagctggtgggcagaggcatccccatcgagagagtggtgagcagcgagggcggcagacccagcgtggacctgagcttccagcccagccagcccctgagcaagagcagcagcagccccgagctgcagaccctgcaggacatcctgggcgaccccggcgacaaggccgacgtgggcagactgagccccgaggtgaaggccagaagccagagcggcaccctggacggcgagagcgccgcctggagcgccagcggcgaggacagcagaggccagcccgagggccccctgcccagcagcagccccagaagccccagcggcctgagacccagaggctacaccatcagcgacagcgcccccagcagaagaggcaagagagtggagagagacgccctgaagagcagagccaccgccagcaacgccgagaaggtgcccggcatcaaccccagcttcgtgttcctgcagctgtaccacagccccttcttcggcgacgagagcaacaagcccatcctgctgcccaacgagagccagagcttcgagagaagcgtgcagctgctggaccagatccccagctacgacacccacaagatcgccgtgctgtacgtgggcgagggccagagcaacagcgagctggccatcctgagcaacgagcacggcagctacagatacaccgagttcctgaccggcctgggcagactgatcgagctgaaggactgccagcccgacaaggtgtacctgggcggcctggacgtgtgcggcgaggacggccagttcacctactgctggcacgacgacatcatgcaggccgtgttccacatcgccaccctgatgcccaccaaggacgtggacaagcacagatgcgacaagaagagacacctgggcaacgacttcgtgagcatcgtgtacaacgacagcggcgaggacttcaagctgggcaccatcaagggccagttcaacttcgtgcacgtgatcgtgacccccctggactacgagtgcaacctggtgagcctgcagtgcagaaaggacatggagggcctggtggacaccagcgtggccaagatcgtgagcgacagaaacctgcccttcgtggccagacagatggccctgcacgccaacatggccagccaggtgcaccacagcagaagcaaccccaccgacatctaccccagcaagtggatcgccagactgagacacatcaagagactgagacagagaatctgcgaggaggccgcctacagcaaccccagcctgcccctggtgcacccccccagccacagcaaggcccccgcccagacccccgccgagcccacccccggctacgaggtgggccagagaaagagactgatcagcagcgtggaggacttcaccgagttcgtgtag

SEQ ID NO: 13353 - DNA, 5115 bp, Artificial Sequence
  Description of Artificial Sequence: Synthetic coding sequence
atggccaagcccaccagcaaggacagcggcctgaaggagaagttcaagatcctgctgggcctgggcacccccagacccaaccccagaagcgccgagggcaagcagaccgagttcatcatcaccgccgagatcctgagagagctgagcatggagtgcggcctgaacaacagaatcagaatgatcggccagatctgcgaggtggccaagaccaagaagttcgaggagggcgagagactgggcgtgctgagagccctgttcttcaaggtgatcaaggactaccccagcaacgaggacctgcacgagagactggaggtgttcaaggccctgaccgacaacggcagacacatcacctacctggaggaggagctggccgacttcgtgctgcagtggatggacgtgggcctgagcagcgagttcctgctggtgctggtgaacctggtgaagttcaacagctgctacctggacgagtacatcgccagaatggtgcagatgatctgcctgctgtgcgtgagaaccgccagcagcgtggacatcgaggtgagcctgcaggtgctggacgccgtggtgtgctacaactgcctgcccgccgagagcctgcccctgttcatcgtgaccctgtgcagaaccatcaacgtgaaggagctgtgcgagccctgctggaagctgatgagaaacctgctgggcacccacctgggccacagcgccatctacaacatgtgccacctgatggaggacagagcctacatggaggacgcccccctgctgagaggcgccgtgttcttcgtgggcatggccctgtggggcgcccacagactgtacagcctgagaaacagccccaccagcgtgctgcccagcttctaccaggccatggcctgccccaacgaggtggtgagctacgagatcgtgctgagcatcaccagactgatcaagaagtacagaaaggagctgcaggtggtggcctgggacatcctgctgaacatcatcgagagactgctgcagcagctgcagaccctggacagccccgagctgagaaccatcgtgcacgacctgctgaccaccgtggaggagctgtgcgaccagaacgagttccacggcagccaggagagatacttcgagctggtggagagatgcgccgaccagagacccgagagcagcctgctgaacctgatcagctacagagcccagagcatccaccccgccaaggacggctggatccagaacctgcaggccctgatggagagattcttcagaagcgagagcagaggcgccgtgagaatcaaggtgctggacgtgctgagcttcgtgctgctgatcaacagacagttctacgaggaggagctgatcaacagcgtggtgatcagccagctgagccacatccccgaggacaaggaccaccaggtgagaaagctggccacccagctgctggtggacctggccgagggctgccacacccaccacttcaacagcctgctggacatcatcgagaaggtgatggccagaagcctgagccccccccccgagctggaggagagagacgtggccgcctacagcgccagcctggaggacgtgaagaccgccgtgctgggcctgctggtgatcctgcagaccaagctgtacaccctgcccgccagccacgccaccagagtgtacgagatgctggtgagccacatccagctgcactacaagcacagctacaccctgcccatcgccagcagcatcagactgcaggccttcgacttcctgctgctgctgagagccgacagcctgcacagactgggcctgcccaacaaggacggcgtggtgagattcagcccctactgcgtgtgcgactacatggagcccgagagaggcagcgagaagaagaccagcggccccctgagcccccccaccggcccccccggccccgcccccgccggccccgccgtgagactgggcagcgtgccctacagcctgctgttcagagtgctgctgcagtgcctgaagcaggagagcgactggaaggtgctgaagctggtgctgggcagactgcccgagagcctgagatacaaggtgctgatcttcaccagcccctgcagcgtggaccagctgtgcagcgccctgtgcagcatgctgagcggccccaagaccctggagagactgagaggcgcccccgagggcttcagcagaaccgacctgcacctggccgtggtgcccgtgctgaccgccctgatcagctaccacaactacctggacaagaccaagcagagagagatggtgtactgcctggagcagggcctgatccacagatgcgccagccagtgcgtggtggccctgagcatctgcagcgtggagatgcccgacatcatcatcaaggccctgcccgtgctggtggtgaagctgacccacatcagcgccaccgccagcatggccgtgcccctgctggagttcctgagcaccctggccagactgccccacctgtacagaaacttcgccgccgagcagtacgccagcgtgttcgccatcagcctgccctacaccaaccccagcaagttcaaccagtacatcgtgtgcctggcccaccacgtgatcgccatgtggttcatcagatgcagactgcccttcagaaaggacttcgtgcccttcatcaccaagggcctgagaagcaacgtgctgctgagcttcgacgacacccccgagaaggacagcttcagagccagaagcaccagcctgaacgagagacccaagagcagaatccagaccagcctgaccagcgccagcctgggcagcgccgacgagaacagcgtggcccaggccgacgacagcctgaagaacctgcacctggagctgaccgagacctgcctggacatgatggccagatacgtgttcagcaacttcaccgccgtgcccaagagaagccccgtgggcgagttcctgctggccggcggcagaaccaagacctggctggtgggcaacaagctggtgaccgtgaccaccagcgtgggcaccggcaccagaagcctgctgggcctggacagcggcgagctgcagagcggccccgagagcagcagcagccccggcgtgcacgtgagacagaccaaggaggcccccgccaagctggagagccaggccggccagcaggtgagcagaggcgccagagacagagtgagaagcatgagcggcggccacggcctgagagtgggcgccctggacgtgcccgccagccagttcctgggcagcgccaccagccccggccccagaaccgcccccgccgccaagcccgagaaggccagcgccggcaccagagtgcccgtgcaggagaagaccaacctggccgcctacgtgcccctgctgacccagggctgggccgagatcctggtgagaagacccaccggcaacaccagctggctgatgagcctggagaaccccctgagccccttcagcagcgacatcaacaacatgcccctgcaggagctgagcaacgccctgatggccgccgagagattcaaggagcacagagacaccgccctgtacaagagcctgagcgtgcccgccgccagcaccgccaagcccccccccctgcccagaagcaacaccgacagcgccgtggtgatggaggagggcagccccggcgaggtgcccgtgctggtggagccccccggcctggaggacgtggaggccgccctgggcatggacagaagaaccgacgcctacagcagaagcagcagcgtgagcagccaggaggagaagagcctgcacgccgaggagctggtgggcagaggcatccccatcgagagagtggtgagcagcgagggcggcagacccagcgtggacctgagcttccagcccagccagcccctgagcaagagcagcagcagccccgagctgcagaccctgcaggacatcctgggcgaccccggcgacaaggccgacgtgggcagactgagccccgaggtgaaggccagaagccagagcggcaccctggacggcgagagcgccgcctggagcgccagcggcgaggacagcagaggccagcccgagggccccctgcccagcagcagccccagaagccccagcggcctgagacccagaggctacaccatcagcgacagcgcccccagcagaagaggcaagagagtggagagagacgccctgaagagcagagccaccgccagcaacgccgagaaggtgcccggcatcaaccccagcttcgtgttcctgcagctgtaccacagccccttcttcggcgacgagagcaacaagcccatcctgctgcccaacgagagccagagcttcgagagaagcgtgcagctgctggaccagatccccagctacgacacccacaagatcgccgtgctgtacgtgggcgagggccagagcaacagcgagctggccatcctgagcaacgagcacggcagctacagatacaccgagttcctgaccggcctgggcagactgatcgagctgaaggactgccagcccgacaaggtgtacctgggcggcctggacgtgtgcggcgaggacggccagttcacctactgctggcacgacgacatcatgcaggccgtgttccacatcgccaccctgatgcccaccaaggacgtggacaagcacagatgcgacaagaagagacacctgggcaacgacttcgtgagcatcgtgtacaacgacagcggcgaggacttcaagctgggcaccatcaagggccagttcaacttcgtgcacgtgatcgtgacccccctggactacgagtgcaacctggtgagcctgcagtgcagaaaggacatggagggcctggtggacaccagcgtggccaagatcgtgagcgacagaaacctgcccttcgtggccagacagatggccctgcacgccaacatggccagccaggtgcaccacagcagaagcaaccccaccgacatctaccccagcaagtggatcgccagactgagacacatcaagagactgagacagagaatctgcgaggaggccgcctacagcaaccccagcctgcccctggtgcacccccccagccacagcaaggcccccgcccagacccccgccgagcccacccccggctacgaggtgggccagagaaagagactgatcagcagcgtggaggacttcaccgagttcgtgtag

SEQ ID NO: 13354 - DNA, 516 bp, Artificial Sequence
  Description of Artificial Sequence: Synthetic coding sequence
ttccccagagacctgagcctgatcagccccctggcccaggccgtgagaagcagcagcagaacccccagcgacaagcccgtggcccacgtggtggccaacccccaggccgagggccagctgcagtggctgaacagaagagccaacgccctgctggccaacggcgtggagctgagagacaaccagctggtggtgcccagcgagggcctgtacctgatctacagccaggtgctgttcaagggccagggctgccccagcacccacgtgctgctgacccacaccatcagcagaatcgccgtgagctaccagaccaaggtgaacctgctgagcgccatcaagagcccctgccagagagagacccccgagggcgccgaggccaagccctggtacgagcccatctacctgggcggcgtgttccagctggagaagggcgacagactgagcgccgagatcaacagacccgactacctggacttcgccgagagcggccaggtgtacttcggcatcatcgccctgtag

SEQ ID NO: 13355 - DNA, 306 bp, Artificial Sequence
  Description of Artificial Sequence: Synthetic coding sequence
atggccatgatggaggtgcagggcggccccagcctgggccagacctgcgtgctgatcgtgatcttcaccgtgctgctgcagagcctgtgcgtggccgtgacctacgtgtacttcaccaacgagctgaagcagatgcaggacaagtacagcaagagcggcatcgcctgcttcctgaaggaggacgacagctactgggaccccaacgacgaggagagcatgaacagcccctgctggcaggtgaagtggcagctgagacagctggtgagaaagacccccagaatgaagagactgtgggccgccaagtag

SEQ ID NO: 13356 - DNA, 846 bp, Artificial Sequence
  Description of Artificial Sequence: Synthetic coding sequence
atggccatgatggaggtgcagggcggccccagcctgggccagacctgcgtgctgatcgtgatcttcaccgtgctgctgcagagcctgtgcgtggccgtgacctacgtgtacttcaccaacgagctgaagcagatgcaggacaagtacagcaagagcggcatcgcctgcttcctgaaggaggacgacagctactgggaccccaacgacgaggagagcatgaacagcccctgctggcaggtgaagtggcagctgagacagctggtgagaaagatgatcctgagaaccagcgaggagaccatcagcaccgtgcaggagaagcagcagaacatcagccccctggtgagagagagaggcccccagagagtggccgcccacatcaccggcaccagaggcagaagcaacaccctgagcagccccaacagcaagaacgagaaggccctgggcagaaagatcaacagctgggagagcagcagaagcggccacagcttcctgagcaacctgcacctgagaaacggcgagctggtgatccacgagaagggcttctactacatctacagccagacctacttcagattccaggaggagatcaaggagaacaccaagaacgacaagcagatggtgcagtacatctacaagtacaccagctaccccgaccccatcctgctgatgaagagcgccagaaacagctgctggagcaaggacgccgagtacggcctgtacagcatctaccagggcggcatcttcgagctgaaggagaacgacagaatcttcgtgagcgtgaccaacgagcacctgatcgacatggaccacgaggccagcttcttcggcgccttcctggtgggctag

SEQ ID NO: 13357 - DNA, 858 bp, Artificial Sequence
  Description of Artificial Sequence: Synthetic coding sequence
atggacgacagcaccgagagagagcagagcagactgaccagctgcctgaagaagagagaggagatgaagctgaaggagtgcgtgagcatcctgcccagaaaggagagccccagcgtgagaagcagcaaggacggcaagctgctggccgccaccctgctgctggccctgctgagctgctgcctgaccgtggtgagcttctaccaggtggccgccctgcagggcgacctggccagcctgagagccgagctgcagggccaccacgccgagaagctgcccgccggcgccggcgcccccaaggccggcctggaggaggcccccgccgtgaccgccggcctgaagatcttcgagccccccgcccccggcgagggcaacagcagccagaacagcagaaacaagagagccgtgcagggccccgaggagaccgtgacccaggactgcctgcagctgatcgccgacagcgagacccccaccatccagaagggcagctacaccttcgtgccctggctgctgagcttcaagagaggcagcgccctggaggagaaggagaacaagatcctggtgaaggagaccggctacttcttcatctacggccaggtgctgtacaccgacaagacctacgccatgggccacctgatccagagaaagaaggtgcacgtgttcggcgacgagctgagcctggtgaccctgttcagatgcatccagaacatgcccgagaccctgcccaacaacagctgctacagcgccggcatcgccaagctggaggagggcgacgagctgcagctggccatccccagagagaacgcccagatcagcctggacggcgacgtgaccttcttcggcgccctgaagctgctgtag

SEQ ID NO: 13358 - DNA, 801 bp, Artificial Sequence
  Description of Artificial Sequence: Synthetic coding sequence
atggacgacagcaccgagagagagcagagcagactgaccagctgcctgaagaagagagaggagatgaagctgaaggagtgcgtgagcatcctgcccagaaaggagagccccagcgtgagaagcagcaaggacggcaagctgctggccgccaccctgctgctggccctgctgagctgctgcctgaccgtggtgagcttctaccaggtggccgccctgcagggcgacctggccagcctgagagccgagctgcagggccaccacgccgagaagctgcccgccggcgccggcgcccccaaggccggcctggaggaggcccccgccgtgaccgccggcctgaagatcttcgagccccccgcccccggcgagggcaacagcagccagaacagcagaaacaagagagccgtgcagggccccgaggagaccggcagctacaccttcgtgccctggctgctgagcttcaagagaggcagcgccctggaggagaaggagaacaagatcctggtgaaggagaccggctacttcttcatctacggccaggtgctgtacaccgacaagacctacgccatgggccacctgatccagagaaagaaggtgcacgtgttcggcgacgagctgagcctggtgaccctgttcagatgcatccagaacatgcccgagaccctgcccaacaacagctgctacagcgccggcatcgccaagctggaggagggcgacgagctgcagctggccatccccagagagaacgcccagatcagcctggacggcgacgtgaccttcttcggcgccctgaagctgctgtag

SEQ ID NO: 13359 - DNA, 495 bp, Artificial Sequence
  Description of Artificial Sequence: Synthetic coding sequence
atggacgacagcaccgagagagagcagagcagactgaccagctgcctgaagaagagagaggagatgaagctgaaggagtgcgtgagcatcctgcccagaaaggagagccccagcgtgagaagcagcaaggacggcaagctgctggccgccaccctgctgctggccctgctgagctgctgcctgaccgtggtgagcttctaccaggtggccgccctgcagggcgacctggccagcctgagagccgagctgcagggccaccacgccgagaagctgcccgccggcgccggcgcccccaaggccggcctggaggaggcccccgccgtgaccgccggcctgaagatcttcgagccccccgcccccggcgagggcaacagcagccagaacagcagaaacaagagagccgtgcagggccccgaggagaccgtgacccaggactgcctgcagctgatcgccgacagcgagacccccaccatccagaagggcttcatctactag

SEQ ID NO: 13360 - DNA, 2700 bp, Artificial Sequence
  Description of Artificial Sequence: Synthetic coding sequence
atgcccaccctgggctggctgcccgagaacagagacatcagcgaggaccagagcagcgccgagcagacccaggccctggccagccaggccagccagttcctggccaaggtggagagcttcgagagactgatccaggccggcagactgatgccccaggaccaggtgaagggcttccagagactgaaggccgcccacgccgccctggaggaggagtacctgaaggcctgcagagagcagcaccccgcccagcccctggccggcagcaagggcacccccggcagattcgaccccagaagagagctggaggccgagatctacagactgggcagctgcctggaggagctgaaggagcacatcgaccagacccagcaggagcccgagccccccggcagcgacagcgccctggacagcacccccgccctgccctgcctgcaccagcccacccacctgcccgcccccagcggccaggcccccatgcccgccatcaagaccagctgccccgagcccgccaccaccaccgccgccgccagcaccggcccctgccccctgcacgtgaacgtggaggtgagcagcggcaacagcgaggtggaggacagaccccaggaccccctggccagactgagacacaaggagctgcagatggagcaggtgtaccacggcctgatggagagatacctgagcgtgaagagcctgcccgaggccatgagaatggaggaggaggaggagggcgaggaggaggaggaggaggagggcggcggcgacagcctggaggtggacggcgtggccgccacccccggcaaggccgaggccaccagagtgctgcccagacagtgccccgtgcaggccgagaagagccacggcgcccccctggaggaggccaccgagaagatggtgagcatgaagccccccggcttccaggccagcctggccagagacggccacatgagcggcctgggcaaggccgaggccgccccccccggccccggcgtgcccccccacccccccggcaccaagagcgccgccagccaccagagcagcatgaccagcctggagggcagcggcatcagcgagagactgccccagaagcccctgcacagaggcggcggcccccacctggaggagacctggatggccagccccgagaccgacagcggcttcgtgggcagcgagaccagcagagtgagccccctgacccagacccccgagcacagactgagccacatcagcaccgccggcaccctggcccagcccttcgccgccagcgtgcccagagacggcgccagctaccccaaggccagaggcagcctgatccccagaagagccaccgagcccagcacccccagaagccaggcccagagatacctgagcagccccagcggccccctgagacagagagcccccaacttcagcctggagagaaccctggccgccgagatggccgtgcccggcagcgagttcgagggccacaagagaatcagcgagcagcccctgcccaacaagaccatcagccccccccccgcccccgcccccgccgccgcccccctgccctgcggccccaccgagaccatccccagcttcctgctgaccagagccggcagagaccaggccatctgcgagctgcaggaggaggtgagcagactgagactgagactggaggacagcctgcaccagcccctgcagggcagccccaccagacccgccagcgccttcgacagacccgccagaaccagaggcagacccgccgacagccccgccacctggggcagccactacggcagcaagagcaccgagagactgcccggcgagcccagaggcgaggagcagatcgtgccccccggcagacagagagccagaagcagcagcgtgcccagagaggtgctgagactgagcctgagcagcgagagcgagctgcccagcctgcccctgttcagcgagaagagcaagaccaccaaggacagcccccaggccgccagagacggcaagagaggcgtgggcagcgccggctggcccgacagagtgaccttcagaggccagtacaccggccacgagtaccacgtgctgagccccaaggccgtgcccaagggcaacggcaccgtgagctgcccccactgcagacccatcagaacccaggacgccggcggcgccgtgaccggcgaccccctgggccccccccccgccgacaccctgcagtgccccctgtgcggccaggtgggcagcccccccgaggccgacggccccggcagcgccaccagcggcgccgagaaggccaccaccagaagaaaggccagcagcacccccagccccaagcagagaagcaagcaggccggcagcagccccagacccccccccggcctgtggtacctggccaccgccccccccgcccccgccccccccgccttcgcctacatcagcagcgtgcccatcatgccctacccccccgccgccgtgtactacgcccccgccggccccaccagcgcccagcccgccgccaagtggccccccaccgccagccccccccccgccagaagacacagacacagcatccagctggacctgggcgacctggaggagctgaacaaggccctgagcagagccgtgcaggccgccgagagcgtgagaagcaccaccagacagatgagaagcagcctgagcgccgacctgagacaggcccacagcctgagaggcagctgcctgttctag

SEQ ID NO: 13361 - DNA, 1569 bp, Artificial Sequence
  Description of Artificial Sequence: Synthetic coding sequence
atggccctgctgcccagagccctgagcgccggcgccggccccagctggagaagagccgccagagccttcagaggcttcctgctgctgctgcccgagcccgccgccctgaccagagccctgagcagagccatggcctgcagacaggagccccagccccagggccccccccccgccgccggcgccgtggccagctacgactacctggtgatcggcggcggcagcggcggcctggccagcgccagaagagccgccgagctgggcgccagagccgccgtggtggagagccacaagctgggcggcacctgcgtgaacgtgggctgcgtgcccaagaaggtgatgtggaacaccgccgtgcacagcgagttcatgcacgaccacgccgactacggcttccccagctgcgagggcaagttcaactggagagtgatcaaggagaagagagacgcctacgtgagcagactgaacgccatctaccagaacaacctgaccaagagccacatcgagatcatcagaggccacgccgccttcaccagcgaccccaagcccaccatcgaggtgagcggcaagaagtacaccgccccccacatcctgatcgccaccggcggcatgcccagcaccccccacgagagccagatccccggcgccagcctgggcatcaccagcgacggcttcttccagctggaggagctgcccggcagaagcgtgatcgtgggcgccggctacatcgccgtggagatggccggcatcctgagcgccctgggcagcaagaccagcctgatgatcagacacgacaaggtgctgagaagcttcgacagcatgatcagcaccaactgcaccgaggagctggagaacgccggcgtggaggtgctgaagttcagccaggtgaaggaggtgaagaagaccctgagcggcctggaggtgagcatggtgaccgccgtgcccggcagactgcccgtgatgaccatgatccccgacgtggactgcctgctgtgggccatcggcagagtgcccaacaccaaggacctgagcctgaacaagctgggcatccagaccgacgacaagggccacatcatcgtggacgagttccagaacaccaacgtgaagggcatctacgccgtgggcgacgtgtgcggcaaggccctgctgacccccgtggccatcgccgccggcagaaagctggcccacagactgttcgagtacaaggaggacagcaagctggactacaacaacatccccaccgtggtgttcagccacccccccatcggcaccgtgggcctgaccgaggacgaggccatccacaagtacggcatcgagaacgtgaagacctacagcaccagcttcacccccatgtaccacgccgtgaccaagagaaagaccaagtgcgtgatgaagatggtgtgcgccaacaaggaggagaaggtggtgggcatccacatgcagggcctgggctgcgacgagatgctgcagggcttcgccgtggccgtgaagatgggcgccaccaaggccgacttcgacaacaccgtggccatccaccccaccagcagcgaggagctggtgaccctgagatag

SEQ ID NO: 13362 - DNA, 1323 bp, Artificial Sequence
  Description of Artificial Sequence: Synthetic coding sequence
atggagcagagaggccagaacgcccccgccgccagcggcgccagaaagagacacggccccggccccagagaggccagaggcgccagacccggccccagagtgcccaagaccctggtgctggtggtggccgccgtgctgctgctggtgagcgccgagagcgccctgatcacccagcaggacctggccccccagcagagagccgccccccagcagaagagaagcagccccagcgagggcctgtgcccccccggccaccacatcagcgaggacggcagagactgcatcagctgcaagtacggccaggactacagcacccactggaacgacctgctgttctgcctgagatgcaccagatgcgacagcggcgaggtggagctgagcccctgcaccaccaccagaaacaccgtgtgccagtgcgaggagggcaccttcagagaggaggacagccccgagatgtgcagaaagtgcagaaccggctgccccagaggcatggtgaaggtgggcgactgcaccccctggagcgacatcgagtgcgtgcacaaggagagcggcaccaagcacagcggcgaggtgcccgccgtggaggagaccgtgaccagcagccccggcacccccgccagcccctgcagcctgagcggcatcatcatcggcgtgaccgtggccgccgtggtgctgatcgtggccgtgttcgtgtgcaagagcctgctgtggaagaaggtgctgccctacctgaagggcatctgcagcggcggcggcggcgaccccgagagagtggacagaagcagccagagacccggcgccgaggacaacgtgctgaacgagatcgtgagcatcctgcagcccacccaggtgcccgagcaggagatggaggtgcaggagcccgccgagcccaccggcgtgaacatgctgagccccggcgagagcgagcacctgctggagcccgccgaggccgagagaagccagagaagaagactgctggtgcccgccaacgagggcgaccccaccgagaccctgagacagtgcttcgacgacttcgccgacctggtgcccttcgacagctgggagcccctgatgagaaagctgggcctgatggacaacgagatcaaggtggccaaggccgaggccgccggccacagagacaccctgtacaccatgctgatcaagtgggtgaacaagaccggcagagacgccagcgtgcacaccctgctggacgccctggagaccctgggcgagagactggccaagcagaagatcgaggaccacctgctgagcagcggcaagttcatgtacctggagggcaacgccgacagcgccatgagctag

SEQ ID NO: 13363 - DNA, 1236 bp, Artificial Sequence
  Description of Artificial Sequence: Synthetic coding sequence
atggagcagagaggccagaacgcccccgccgccagcggcgccagaaagagacacggccccggccccagagaggccagaggcgccagacccggccccagagtgcccaagaccctggtgctggtggtggccgccgtgctgctgctggtgagcgccgagagcgccctgatcacccagcaggacctggccccccagcagagagccgccccccagcagaagagaagcagccccagcgagggcctgtgcccccccggccaccacatcagcgaggacggcagagactgcatcagctgcaagtacggccaggactacagcacccactggaacgacctgctgttctgcctgagatgcaccagatgcgacagcggcgaggtggagctgagcccctgcaccaccaccagaaacaccgtgtgccagtgcgaggagggcaccttcagagaggaggacagccccgagatgtgcagaaagtgcagaaccggctgccccagaggcatggtgaaggtgggcgactgcaccccctggagcgacatcgagtgcgtgcacaaggagagcggcatcatcatcggcgtgaccgtggccgccgtggtgctgatcgtggccgtgttcgtgtgcaagagcctgctgtggaagaaggtgctgccctacctgaagggcatctgcagcggcggcggcggcgaccccgagagagtggacagaagcagccagagacccggcgccgaggacaacgtgctgaacgagatcgtgagcatcctgcagcccacccaggtgcccgagcaggagatggaggtgcaggagcccgccgagcccaccggcgtgaacatgctgagccccggcgagagcgagcacctgctggagcccgccgaggccgagagaagccagagaagaagactgctggtgcccgccaacgagggcgaccccaccgagaccctgagacagtgcttcgacgacttcgccgacctggtgcccttcgacagctgggagcccctgatgagaaagctgggcctgatggacaacgagatcaaggtggccaaggccgaggccgccggccacagagacaccctgtacaccatgctgatcaagtgggtgaacaagaccggcagagacgccagcgtgcacaccctgctggacgccctggagaccctgggcgagagactggccaagcagaagatcgaggaccacctgctgagcagcggcaagttcatgtacctggagggcaacgccgacagcgccatgagctag

SEQ ID NO: 13364 - DNA, 783 bp, Artificial Sequence
  Description of Artificial Sequence: Synthetic coding sequence
atgtgcagaaagtgcagaaccggctgccccagaggcatggtgaaggtgggcgactgcaccccctggagcgacatcgagtgcgtgcacaaggagagcggcatcatcatcggcgtgaccgtggccgccgtggtgctgatcgtggccgtgttcgtgtgcaagagcctgctgtggaagaaggtgctgccctacctgaagggcatctgcagcggcggcggcggcgaccccgagagagtggacagaagcagccagagacccggcgccgaggacaacgtgctgaacgagatcgtgagcatcctgcagcccacccaggtgcccgagcaggagatggaggtgcaggagcccgccgagcccaccggcgtgaacatgctgagccccggcgagagcgagcacctgctggagcccgccgaggccgagagaagccagagaagaagactgctggtgcccgccaacgagggcgaccccaccgagaccctgagacagtgcttcgacgacttcgccgacctggtgcccttcgacagctgggagcccctgatgagaaagctgggcctgatggacaacgagatcaaggtggccaaggccgaggccgccggccacagagacaccctgtacaccatgctgatcaagtgggtgaacaagaccggcagagacgccagcgtgcacaccctgctggacgccctggagaccctgggcgagagactggccaagcagaagatcgaggaccacctgctgagcagcggcaagttcatgtacctggagggcaacgccgacagcgccatgagctag

SEQ ID NO: 13365 - DNA, 1161 bp, Artificial Sequence
  Description of Artificial Sequence: Synthetic coding sequence
atgggcctgtggggccagagcgtgcccaccgccagcagcgccagagccggcagataccccggcgccagaaccgccagcggcaccagaccctggctgctggaccccaagatcctgaagttcgtggtgttcatcgtggccgtgctgctgcccgtgagagtggacagcgccaccatccccagacaggacgaggtgccccagcagaccgtggccccccagcagcagagaagaagcctgaaggaggaggagtgccccgccggcagccacagaagcgagtacaccggcgcctgcaacccctgcaccgagggcgtggactacaccatcgccagcaacaacctgcccagctgcctgctgtgcaccgtgtgcaagagcggccagaccaacaagagcagctgcaccaccaccagagacaccgtgtgccagtgcgagaagggcagcttccaggacaagaacagccccgagatgtgcagaacctgcagaaccggctgccccagaggcatggtgaaggtgagcaactgcacccccagaagcgacatcaagtgcaagaacgagagcgccgccagcagcaccggcaagacccccgccgccgaggagaccgtgaccaccatcctgggcatgctggccagcccctaccactacctgatcatcatcgtggtgctggtgatcatcctggccgtggtggtggtgggcttcagctgcagaaagaagttcatcagctacctgaagggcatctgcagcggcggcggcggcggccccgagagagtgcacagagtgctgttcagaagaagaagctgccccagcagagtgcccggcgccgaggacaacgccagaaacgagaccctgagcaacagatacctgcagcccacccaggtgagcgagcaggagatccagggccaggagctggccgagctgaccggcgtgaccgtggagctgcccgaggagccccagagactgctggagcaggccgaggccgagggctgccagagaagaagactgctggtgcccgtgaacgacgccgacagcgccgacatcagcaccctgctggacgccagcgccaccctggaggagggccacgccaaggagaccatccaggaccagctggtgggcagcgagaagctgttctacgaggaggacgaggccggcagcgccaccagctgcctgtag

SEQ ID NO: 13366 - DNA, 1368 bp, Artificial Sequence
  Description of Artificial Sequence: Synthetic coding sequence
atgggcctgagcaccgtgcccgacctgctgctgcccctggtgctgctggagctgctggtgggcatctaccccagcggcgtgatcggcctggtgccccacctgggcgacagagagaagagagacagcgtgtgcccccagggcaagtacatccacccccagaacaacagcatctgctgcaccaagtgccacaagggcacctacctgtacaacgactgccccggccccggccaggacaccgactgcagagagtgcgagagcggcagcttcaccgccagcgagaaccacctgagacactgcctgagctgcagcaagtgcagaaaggagatgggccaggtggagatcagcagctgcaccgtggacagagacaccgtgtgcggctgcagaaagaaccagtacagacactactggagcgagaacctgttccagtgcttcaactgcagcctgtgcctgaacggcaccgtgcacctgagctgccaggagaagcagaacaccgtgtgcacctgccacgccggcttcttcctgagagagaacgagtgcgtgagctgcagcaactgcaagaagagcctggagtgcaccaagctgtgcctgccccagatcgagaacgtgaagggcaccgaggacagcggcaccaccgtgctgctgcccctggtgatcttcttcggcctgtgcctgctgagcctgctgttcatcggcctgatgtacagataccagagatggaagagcaagctgtacagcatcgtgtgcggcaagagcacccccgagaaggagggcgagctggagggcaccaccaccaagcccctggcccccaaccccagcttcagccccacccccggcttcacccccaccctgggcttcagccccgtgcccagcagcaccttcaccagcagcagcacctacacccccggcgactgccccaacttcgccgcccccagaagagaggtggcccccccctaccagggcgccgaccccatcctggccaccgccctggccagcgaccccatccccaaccccctgcagaagtgggaggacagcgcccacaagccccagagcctggacaccgacgaccccgccaccctgtacgccgtggtggagaacgtgccccccctgagatggaaggagttcgtgagaagactgggcctgagcgaccacgagatcgacagactggagctgcagaacggcagatgcctgagagaggcccagtacagcatgctggccacctggagaagaagaacccccagaagagaggccaccctggagctgctgggcagagtgctgagagacatggacctgctgggctgcctggaggacatcgaggaggccctgtgcggccccgccgccctgccccccgcccccagcctgctgagatag

SEQ ID NO: 13367 - DNA, 657 bp, Artificial Sequence
  Description of Artificial Sequence: Synthetic coding sequence
atgggcctgagcaccgtgcccgacctgctgctgcccctggtgctgctggagctgctggtgggcatctaccccagcggcgtgatcggcctggtgccccacctgggcgacagagagaagagagacagcgtgtgcccccagggcaagtacatccacccccagaacaacagcatctgctgcaccaagtgccacaagggcacctacctgtacaacgactgccccggccccggccaggacaccgactgcagagagtgcgagagcggcagcttcaccgccagcgagaaccacctgagacactgcctgagctgcagcaagtgcagaaaggagatgggccaggtggagatcagcagctgcaccgtggacagagacaccgtgtgcggctgcagaaagaaccagtacagacactactggagcgagaacctgttccagtgcttcaactgcagcctgtgcctgaacggcaccgtgcacctgagctgccaggagaagcagaacaccgtgtgcacctgccacgccggcttcttcctgagagagaacgagtgcgtgagctgcagcaaggtgctgctgtgcagacccggctggaacgccgtggccagaagcagactgaccgccaccagcgccagccagatccaggccatcctgctgctgcagccccccaagtag

SEQ ID NO: 13368 - DNA, 1386 bp, Artificial Sequence
  Description of Artificial Sequence: Synthetic coding sequence
atggcccccgtggccgtgtgggccgccctggccgtgggcctggagctgtgggccgccgcccacgccctgcccgcccaggtggccttcaccccctacgcccccgagcccggcagcacctgcagactgagagagtactacgaccagaccgcccagatgtgctgcagcaagtgcagccccggccagcacgccaaggtgttctgcaccaagaccagcgacaccgtgtgcgacagctgcgaggacagcacctacacccagctgtggaactgggtgcccgagtgcctgagctgcggcagcagatgcagcagcgaccaggtggagacccaggcctgcaccagagagcagaacagaatctgcacctgcagacccggctggtactgcgccctgagcaagcaggagggctgcagactgtgcgcccccctgagaaagtgcagacccggcttcggcgtggccagacccggcaccgagaccagcgacgtggtgtgcaagccctgcgcccccggcaccttcagcaacaccaccagcagcaccgacatctgcagaccccaccagatctgcaacgtggtggccatccccggcaacgccagcatggacgccgtgtgcaccagcaccagccccaccagaagcatggcccccggcgccgtgcacctgccccagcccgtgagcaccagaagccagcacacccagcccacccccgagcccagcaccgcccccagcaccagcttcctgctgcccatgggccccagcccccccgccgagggcagcaccggcgacttcgccctgcccgtgggcctgatcgtgggcgtgaccgccctgggcctgctgatcatcggcgtggtgaactgcgtgatcatgacccaggtgaagaagaagcccctgtgcctgcagagagaggccaaggtgccccacctgcccgccgacaaggccagaggcacccagggccccgagcagcagcacctgctgatcaccgcccccagcagcagcagcagcagcctggagagcagcgccagcgccctggacagaagagcccccaccagaaaccagccccaggcccccggcgtggaggccagcggcgccggcgaggccagagccagcaccggcagcagcgacagcagccccggcggccacggcacccaggtgaacgtgacctgcatcgtgaacgtgtgcagcagcagcgaccacagcagccagtgcagcagccaggccagcagcaccatgggcgacaccgacagcagccccagcgagagccccaaggacgagcaggtgcccttcagcaaggaggagtgcgccttcagaagccagctggagacccccgagaccctgctgggcagcaccgaggagaagcccctgcccctgggcgtgcccgacgccggcatgaagcccagctag

SEQ ID NO: 13369 - DNA, 807 bp, Artificial Sequence
  Description of Artificial Sequence: Synthetic coding sequence
atggcccccgtggccgtgtgggccgccctggccgtgggcctggagctgtgggccgccgcccacgccctgcccgcccaggtggccttcaccccctacgcccccgagcccggcagcacctgcagactgagagagtactacgaccagaccgcccagatgtgctgcagcaagtgcagccccggccagcacgccaaggtgttctgcaccaagaccagcgacaccgtgtgcgacagctgcgaggacagcacctacacccagctgtggaactgggtgcccgagtgcctgagctgcggcagcagatgcagcagcgaccaggtggagacccaggcctgcaccagagagcagaacagaatctgcacctgcagacccggctggtactgcgccctgagcaagcaggagggctgcagactgtgcgcccccctgagaaagtgcagacccggcttcggcgtggccagacccggcaccgagaccagcgacgtggtgtgcaagccctgcgcccccggcaccttcagcaacaccaccagcagcaccgacatctgcagaccccaccagatctgcaacgtggtggccatccccggcaacgccagcatggacgccgtgtgcaccagcaccagccccaccagaagcatggcccccggcgccgtgcacctgccccagcccgtgagcaccagaagccagcacacccagcccacccccgagcccagcaccgcccccagcaccagcttcctgctgcccatgggccccagcccccccgccgagggcagcaccggcgacttcgccctgcccgtggtgagcctgagcagcagctag

SEQ ID NO: 13370 - DNA, 468 bp, Artificial Sequence
  Description of Artificial Sequence: Synthetic coding sequence
atggcccccgtggccgtgtgggccgccctggccgtgggcctggagctgtgggccgccgcccacgccctgcccgcccaggtggccttcaccccctacgcccccgagcccggcagcacctgcagactgagagagtactacgaccagaccgcccagatgtgctgcagcaagtgcagccccggccagcacgccaaggtgttctgcaccaagaccagcgacaccgtgtgcgacagctgcgaggacagcacctacacccagctgtggaactgggtgcccgagtgcctgagctgcggcagcagatgcagcagcgaccaggtggagacccaggcctgcaccagagagcagaacagaatctgcacctgcagacccggctggtactgcgccctgagcaagcaggagggctgcagactgtgcgcccccctgagaaagtgcagacccggcttcggcgtggccagacccgacctgagctag

SEQ ID NO: 13371 - DNA, 114 bp, Artificial Sequence
  Description of Artificial Sequence: Synthetic coding sequence
atggcccccgtggccgtgtgggccgccctggccgtgggcctggagctgtgggccgccgcccacgccctgcccgcccaggtggaccccggccccctgttcccccaccccggctag

SEQ ID NO: 13372 - DNA, 1968 bp, Artificial Sequence
  Description of Artificial Sequence: Synthetic coding sequence
atgggcaccagccccagcagcagcaccgccctggccagctgcagcagaatcgccagaagagccaccgccaccatgatcgccggcagcctgctgctgctgggcttcctgagcaccaccaccgcccagcccgagcagaaggccagcaacctgatcggcacctacagacacgtggacagagccaccggccaggtgctgacctgcgacaagtgccccgccggcacctacgtgagcgagcactgcaccaacaccagcctgagagtgtgcagcagctgccccgtgggcaccttcaccagacacgagaacggcatcgagaagtgccacgactgcagccagccctgcccctggcccatgatcgagaagctgccctgcgccgccctgaccgacagagagtgcacctgcccccccggcatgttccagagcaacgccacctgcgccccccacaccgtgtgccccgtgggctggggcgtgagaaagaagggcaccgagaccgaggacgtgagatgcaagcagtgcgccagaggcaccttcagcgacgtgcccagcagcgtgatgaagtgcaaggcctacaccgactgcctgagccagaacctggtggtgatcaagcccggcaccaaggagaccgacaacgtgtgcggcaccctgcccagcttcagcagcagcaccagccccagccccggcaccgccatcttccccagacccgagcacatggagacccacgaggtgcccagcagcacctacgtgcccaagggcatgaacagcaccgagagcaacagcagcgccagcgtgagacccaaggtgctgagcagcatccaggagggcaccgtgcccgacaacaccagcagcgccagaggcaaggaggacgtgaacaagaccctgcccaacctgcaggtggtgaaccaccagcagggcccccaccacagacacatcctgaagctgctgcccagcatggaggccaccggcggcgagaagagcagcacccccatcaagggccccaagagaggccaccccagacagaacctgcacaagcacttcgacatcaacgagcacctgccctggatgatcgtgctgttcctgctgctggtgctggtggtgatcgtggtgtgcagcatcagaaagagcagcagaaccctgaagaagggccccagacaggaccccagcgccatcgtggagaaggccggcctgaagaagagcatgacccccacccagaacagagagaagtggatctactactgcaacggccacggcatcgacatcctgaagctggtggccgcccaggtgggcagccagtggaaggacatctaccagttcctgtgcaacgccagcgagagagaggtggccgccttcagcaacggctacaccgccgaccacgagagagcctacgccgccctgcagcactggaccatcagaggccccgaggccagcctggcccagctgatcagcgccctgagacagcacagaagaaacgacgtggtggagaagatcagaggcctgatggaggacaccacccagctggagaccgacaagctggccctgcccatgagccccagccccctgagccccagccccatccccagccccaacgccaagctggagaacagcgccctgctgaccgtggagcccagcccccaggacaagaacaagggcttcttcgtggacgagagcgagcccctgctgagatgcgacagcaccagcagcggcagcagcgccctgagcagaaacggcagcttcatcaccaaggagaagaaggacaccgtgctgagacaggtgagactggacccctgcgacctgcagcccatcttcgacgacatgctgcacttcctgaaccccgaggagctgagagtgatcgaggagatcccccaggccgaggacaagctggacagactgttcgagatcatcggcgtgaagagccaggaggccagccagaccctgctggacagcgtgtacagccacctgcccgacctgctgtag

SEQ ID NO: 13373 - DNA, 1035 bp, Artificial Sequence
  Description of Artificial Sequence: Synthetic coding sequence
agctgctgcagaccctggagacccctgggcgccagaagccccgccagacccagcagacccaagagaggccaccccagacagaacctgcacaagcacttcgacatcaacgagcacctgccctggatgatcgtgctgttcctgctgctggtgctggtggtgatcgtggtgtgcagcatcagaaagagcagcagaaccctgaagaagggccccagacaggaccccagcgccatcgtggagaaggccggcctgaagaagagcatgacccccacccagaacagagagaagtggatctactactgcaacggccacggcatcgacatcctgaagctggtggccgcccaggtgggcagccagtggaaggacatctaccagttcctgtgcaacgccagcgagagagaggtggccgccttcagcaacggctacaccgccgaccacgagagagcctacgccgccctgcagcactggaccatcagaggccccgaggccagcctggcccagctgatcagcgccctgagacagcacagaagaaacgacgtggtggagaagatcagaggcctgatggaggacaccacccagctggagaccgacaagctggccctgcccatgagccccagccccctgagccccagccccatccccagccccaacgccaagctggagaacagcgccctgctgaccgtggagcccagcccccaggacaagaacaagggcttcttcgtggacgagagcgagcccctgctgagatgcgacagcaccagcagcggcagcagcgccctgagcagaaacggcagcttcatcaccaaggagaagaaggacaccgtgctgagacaggtgagactggacccctgcgacctgcagcccatcttcgacgacatgctgcacttcctgaaccccgaggagctgagagtgatcgaggagatcccccaggccgaggacaagctggacagactgttcgagatcatcggcgtgaagagccaggaggccagccagaccctgctggacagcgtgtacagccacctgcccgacctgctgtag

SEQ ID NO: 13374 - DNA, 1119 bp, Artificial Sequence
  Description of Artificial Sequence: Synthetic coding sequence
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccgccagccaggtggccctggagaactgcagcgccgtggccgacaccagatgcggctgcaagcccggctggttcgtggagtgccaggtgagccagtgcgtgagcagcagccccttctactgccagccctgcctggactgcggcgccctgcacagacacaccagactgctgtgcagcagaagagacaccgactgcggcacctgcctgcccggcttctacgagcacggcgacggctgcgtgagctgccccaccagcaccctgggcagctgccccgagagatgcgccgccgtgtgcggctggagacagatgttctgggtgcaggtgctgctggccggcctggtggtgcccctgctgctgggcgccaccctgacctacacctacagacactgctggccccacaagcccctggtgaccgccgacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 13375 - DNA, 705 bp, Artificial Sequence
  Description of Artificial Sequence: Synthetic coding sequence
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccgacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 13376 - DNA, 1143 bp, Artificial Sequence
  Description of Artificial Sequence: Synthetic coding sequence
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccggccactacctgaaggccccctgcaccgagccctgcggcaacagcacctgcctggtgtgcccccaggacaccttcctggcctgggagaaccaccacaacagcgagtgcgccagatgccaggcctgcgacgagcaggccagccaggtggccctggagaactgcagcgccgtggccgacaccagatgcggctgcaagcccggctggttcgtggagtgccaggtgagccagtgcgtgagcagcagccccttctactgccagccctgcctggactgcggcgccctgcacagacacaccagactgctgtgcagcagaagagacaccgactgcggcacctgcctgcccggcttctacgagcacggcgacggctgcgtgagctgccccaccagcaccctgggcagctgccccgagagatgcgccgccgtgtgcggctggagacagaacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 13377 - DNA, 1254 bp, Artificial Sequence
  Description of Artificial Sequence: Synthetic coding sequence
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccggccactacctgaaggccccctgcaccgagccctgcggcaacagcacctgcctggtgtgcccccaggacaccttcctggcctgggagaaccaccacaacagcgagtgcgccagatgccaggcctgcgacgagcaggccagccaggtggccctggagaactgcagcgccgtggccgacaccagatgcggctgcaagcccggctggttcgtggagtgccaggtgagccagtgcgtgagcagcagccccttctactgccagccctgcctggactgcggcgccctgcacagacacaccagactgctgtgcagcagaagagacaccgactgcggcacctgcctgcccggcttctacgagcacggcgacggctgcgtgagctgccccaccagcaccctgggcagctgccccgagagatgcgccgccgtgtgcggctggagacagatgttctgggtgcaggtgctgctggccggcctggtggtgcccctgctgctgggcgccaccctgacctacacctacagacactgctggccccacaagcccctggtgaccgccgacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 13378 - DNA, 1281 bp, Artificial Sequence
  Description of Artificial Sequence: Synthetic coding sequence
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccggccactacctgaaggccccctgcaccgagccctgcggcaacagcacctgcctggtgtgcccccaggacaccttcctggcctgggagaaccaccacaacagcgagtgcgccagatgccaggcctgcgacgagcaggccagccaggtggccctggagaactgcagcgccgtggccgacaccagatgcggctgcaagcccggctggttcgtggagtgccaggtgagccagtgcgtgagcagcagccccttctactgccagccctgcctggactgcggcgccctgcacagacacaccagactgctgtgcagcagaagagacaccgactgcggcacctgcctgcccggcttctacgagcacggcgacggctgcgtgagctgccccacccccccccccagcctggccggcgccccctggggcgccgtgcagagcgccgtgcccctgagcgtggccggcggcagagtgggcgtgttctgggtgcaggtgctgctggccggcctggtggtgcccctgctgctgggcgccaccctgacctacacctacagacactgctggccccacaagcccctggtgaccgccgacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 13379 - DNA, 768 bp, Artificial Sequence
  Description of Artificial Sequence: Synthetic coding sequence
atgggcaacagctgctacaacatcgtggccaccctgctgctggtgctgaacttcgagagaaccagaagcctgcaggacccctgcagcaactgccccgccggcaccttctgcgacaacaacagaaaccagatctgcagcccctgcccccccaacagcttcagcagcgccggcggccagagaacctgcgacatctgcagacagtgcaagggcgtgttcagaaccagaaaggagtgcagcagcaccagcaacgccgagtgcgactgcacccccggcttccactgcctgggcgccggctgcagcatgtgcgagcaggactgcaagcagggccaggagctgaccaagaagggctgcaaggactgctgcttcggcaccttcaacgaccagaagagaggcatctgcagaccctggaccaactgcagcctggacggcaagagcgtgctggtgaacggcaccaaggagagagacgtggtgtgcggccccagccccgccgacctgagccccggcgccagcagcgtgaccccccccgcccccgccagagagcccggccacagcccccagatcatcagcttcttcctggccctgaccagcaccgccctgctgttcctgctgttcttcctgaccctgagattcagcgtggtgaagagaggcagaaagaagctgctgtacatcttcaagcagcccttcatgagacccgtgcagaccacccaggaggaggacggctgcagctgcagattccccgaggaggaggagggcggctgcgagctgtag

SEQ ID NO: 13380 - DNA, 5919 bp, Artificial Sequence
  Description of Artificial Sequence: Synthetic coding sequence
atggaccccaccggcagccagctggacagcgacttcagccagcaggacaccccctgcctgatcatcgaggacagccagcccgagagccaggtgctggaggacgacagcggcagccacttcagcatgctgagcagacacctgcccaacctgcagacccacaaggagaaccccgtgctggacgtggtgagcaaccccgagcagaccgccggcgaggagagaggcgacggcaacagcggcttcaacgagcacctgaaggagaacaaggtggccgaccccgtggacagcagcaacctggacacctgcggcagcatcagccaggtgatcgagcagctgccccagcccaacagaaccagcagcgtgctgggcatgagcgtggagagcgcccccgccgtggaggaggagaagggcgaggagctggagcagaaggagaaggagaaggaggaggacaccagcggcaacaccacccacagcctgggcgccgaggacaccgccagcagccagctgggcttcggcgtgctggagctgagccagagccaggacgtggaggagaacaccgtgccctacgaggtggacaaggagcagctgcagagcgtgaccaccaacagcggctacaccagactgagcgacgtggacgccaacaccgccatcaagcacgaggagcagagcaacgaggacatccccatcgccgagcagagcagcaaggacatccccgtgaccgcccagcccagcaaggacgtgcacgtggtgaaggagcagaaccccccccccgccagaagcgaggacatgcccttcagccccaaggccagcgtggccgccatggaggccaaggagcagctgagcgcccaggagctgatggagagcggcctgcagatccagaagagccccgagcccgaggtgctgagcacccaggaggacctgttcgaccagagcaacaagaccgtgagcagcgacggctgcagcacccccagcagagaggagggcggctgcagcctggccagcacccccgccaccaccctgcacctgctgcagctgagcggccagagaagcctggtgcaggacagcctgagcaccaacagcagcgacctggtggcccccagccccgacgccttcagaagcacccccttcatcgtgcccagcagccccaccgagcaggagggcagacaggacaagcccatggacaccagcgtgctgagcgaggagggcggcgagcccttccagaagaagctgcagagcggcgagcccgtggagctggagaacccccccctgctgcccgagagcaccgtgagcccccaggccagcacccccatcagccagagcacccccgtgttcccccccggcagcctgcccatccccagccagccccagttcagccacgacatcttcatccccagccccagcctggaggagcagagcaacgacggcaagaaggacggcgacatgcacagcagcagcctgaccgtggagtgcagcaagaccagcgagatcgagcccaagaacagccccgaggacctgggcctgagcctgaccggcgacagctgcaagctgatgctgagcaccagcgagtacagccagagccccaagatggagagcctgagcagccacagaatcgacgaggacggcgagaacacccagatcgaggacaccgagcccatgagccccgtgctgaacagcaagttcgtgcccgccgagaacgacagcatcctgatgaaccccgcccaggacggcgaggtgcagctgagccagaacgacgacaagaccaagggcgacgacaccgacaccagagacgacatcagcatcctggccaccggctgcaagggcagagaggagaccgtggccgaggacgtgtgcatcgacctgacctgcgacagcggcagccaggccgtgcccagccccgccaccagaagcgaggccctgagcagcgtgctggaccaggaggaggccatggagatcaaggagcaccaccccgaggagggcagcagcggcagcgaggtggaggagatccccgagaccccctgcgagagccagggcgaggagctgaaggaggagaacatggagagcgtgcccctgcacctgagcctgaccgagacccagagccagggcctgtgcctgcagaaggagatgcccaagaaggagtgcagcgaggccatggaggtggagaccagcgtgatcagcatcgacagcccccagaagctggccatcctggaccaggagctggagcacaaggagcaggaggcctgggaggaggccaccagcgaggacagcagcgtggtgatcgtggacgtgaaggagcccagccccagagtggacgtgagctgcgagcccctggagggcgtggagaagtgcagcgacagccagagctgggaggacatcgcccccgagatcgagccctgcgccgagaacagactggacaccaaggaggagaagagcgtggagtacgagggcgacctgaagagcggcaccgccgagaccgagcccgtggagcaggacagcagccagcccagcctgcccctggtgagagccgacgaccccctgagactggaccaggagctgcagcagccccagacccaggagaagaccagcaacagcctgaccgaggacagcaagatggccaacgccaagcagctgagcagcgacgccgaggcccagaagctgggcaagcccagcgcccacgccagccagagcttctgcgagagcagcagcgagacccccttccacttcaccctgcccaaggagggcgacatcatcccccccctgaccggcgccaccccccccctgatcggccacctgaagctggagcccaagagacacagcacccccatcggcatcagcaactaccccgagagcaccatcgccaccagcgacgtgatgagcgagagcatggtggagacccacgaccccatcctgggcagcggcaagggcgacagcggcgccgcccccgacgtggacgacaagctgtgcctgagaatgaagctggtgagccccgagaccgaggccagcgaggagagcctgcagttcaacctggagaagcccgccaccggcgagagaaagaacggcagcaccgccgtggccgagagcgtggccagcccccagaagaccatgagcgtgctgagctgcatctgcgaggccagacaggagaacgaggccagaagcgaggacccccccaccacccccatcagaggcaacctgctgcacttccccagcagccagggcgaggaggagaaggagaagctggagggcgaccacaccatcagacagagccagcagcccatgaagcccatcagccccgtgaaggaccccgtgagccccgccagccagaagatggtgatccagggccccagcagcccccagggcgaggccatggtgaccgacgtgctggaggaccagaaggagggcagaagcaccaacaaggagaaccccagcaaggccctgatcgagagacccagccagaacaacatcggcatccagaccatggagtgcagcctgagagtgcccgagaccgtgagcgccgccacccagaccatcaagaacgtgtgcgagcagggcaccagcaccgtggaccagaacttcggcaagcaggacgccaccgtgcagaccgagagaggcagcggcgagaagcccgtgagcgcccccggcgacgacaccgagagcctgcacagccagggcgaggaggagttcgacatgccccagcccccccacggccacgtgctgcacagacacatgagaaccatcagagaggtgagaaccctggtgaccagagtgatcaccgacgtgtactacgtggacggcaccgaggtggagagaaaggtgaccgaggagaccgaggagcccatcgtggagtgccaggagtgcgagaccgaggtgagccccagccagaccggcggcagcagcggcgacctgggcgacatcagcagcttcagcagcaaggccagcagcctgcacagaaccagcagcggcaccagcctgagcgccatgcacagcagcggcagcagcggcaagggcgccggccccctgagaggcaagaccagcggcaccgagcccgccgacttcgccctgcccagcagcagaggcggccccggcaagctgagccccagaaagggcgtgagccagaccggcacccccgtgtgcgaggaggacggcgacgccggcctgggcatcagacagggcggcaaggcccccgtgacccccagaggcagaggcagaagaggcagaccccccagcagaaccaccggcaccagagagaccgccgtgcccggccccctgggcatcgaggacatcagccccaacctgagccccgacgacaagagcttcagcagagtggtgcccagagtgcccgacagcaccagaagaaccgacgtgggcgccggcgccctgagaagaagcgacagccccgagatccccttccaggccgccgccggccccagcgacggcctggacgccagcagccccggcaacagcttcgtgggcctgagagtggtggccaagtggagcagcaacggctacttctacagcggcaagatcaccagagacgtgggcgccggcaagtacaagctgctgttcgacgacggctacgagtgcgacgtgctgggcaaggacatcctgctgtgcgaccccatccccctggacaccgaggtgaccgccctgagcgaggacgagtacttcagcgccggcgtggtgaagggccacagaaaggagagcggcgagctgtactacagcatcgagaaggagggccagagaaagtggtacaagagaatggccgtgatcctgagcctggagcagggcaacagactgagagagcagtacggcctgggcccctacgaggccgtgacccccctgaccaaggccgccgacatcagcctggacaacctggtggagggcaagagaaagagaagaagcaacgtgagcagccccgccacccccaccgccagcagcagcagcagcaccacccccaccagaaagatcaccgagagccccagagccagcatgggcgtgctgagcggcaagagaaagctgatcaccagcgaggaggagagaagccccgccaagagaggcagaaagagcgccaccgtgaagcccggcgccgtgggcgccggcgagttcgtgagcccctgcgagagcggcgacaacaccggcgagcccagcgccctggaggagcagagaggccccctgcccctgaacaagaccctgttcctgggctacgccttcctgctgaccatggccaccaccagcgacaagctggccagcagaagcaagctgcccgacggccccaccggcagcagcgaggaggaggaggagttcctggagatcccccccttcaacaagcagtacaccgagagccagctgagagccggcgccggctacatcctggaggacttcaacgaggcccagtgcaacaccgcctaccagtgcctgctgatcgccgaccagcactgcagaaccagaaagtacttcctgtgcctggccagcggcatcccctgcgtgagccacgtgtgggtgcacgacagctgccacgccaaccagctgcagaactacagaaactacctgctgcccgccggctacagcctggaggagcagagaatcctggactggcagcccagagagaaccccttccagaacctgaaggtgctgctggtgagcgaccagcagcagaacttcctggagctgtggagcgagatcctgatgaccggcggcgccgccagcgtgaagcagcaccacagcagcgcccacaacaaggacatcgccctgggcgtgttcgacgtggtggtgaccgaccccagctgccccgccagcgtgctgaagtgcgccgaggccctgcagctgcccgtggtgagccaggagtgggtgatccagtgcctgatcgtgggcgagagaatcggcttcaagcagcaccccaagtacaagcacgactacgtgagccactag

SEQ ID NO: 13381 - DNA, 5784 bp, Artificial Sequence
  Description of Artificial Sequence: Synthetic coding sequence
atgcccggcgagcagatggaccccaccggcagccagctggacagcgacttcagccagcaggacaccccctgcctgatcatcgaggacagccagcccgagagccaggtgctggaggacgacagcggcagccacttcagcatgctgagcagacacctgcccaacctgcagacccacaaggagaaccccgtgctggacgtggtgagcaaccccgagcagaccgccggcgaggagagaggcgacggcaacagcggcttcaacgagcacctgaaggagaacaaggtggccgaccccgtggacagcagcaacctggacacctgcggcagcatcagccaggtgatcgagcagctgccccagcccaacagaaccagcagcgtgctgggcatgagcgtggagagcgcccccgccgtggaggaggagaagggcgaggagctggagcagaaggagaaggagaaggaggaggacaccagcggcaacaccacccacagcctgggcgccgaggacaccgccagcagccagctgggcttcggcgtgctggagctgagccagagccaggacgtggaggagaacaccgtgccctacgaggtggacaaggagcagctgcagagcgtgaccaccaacagcggctacaccagactgagcgacgtggacgccaacaccgccatcaagcacgaggagcagagcaacgaggacatccccatcgccgagcagagcagcaaggacatccccgtgaccgcccagcccagcaaggacgtgcacgtggtgaaggagcagaaccccccccccgccagaagcgaggacatgcccttcagccccaaggccagcgtggccgccatggaggccaaggagcagctgagcgcccaggagctgatggagagcggcctgcagatccagaagagccccgagcccgaggtgctgagcacccaggaggacctgttcgaccagagcaacaagaccgtgagcagcgacggctgcagcacccccagcagagaggagggcggctgcagcctggccagcacccccgccaccaccctgcacctgctgcagctgagcggccagagaagcctggtgcaggacagcctgagcaccaacagcagcgacctggtggcccccagccccgacgccttcagaagcacccccttcatcgtgcccagcagccccaccgagcaggagggcagacaggacaagcccatggacaccagcgtgctgagcgaggagggcggcgagcccttccagaagaagctgcagagcggcgagcccgtggagctggagaacccccccctgctgcccgagagcaccgtgagcccccaggccagcacccccatcagccagagcacccccgtgttcccccccggcagcctgcccatccccagccagccccagttcagccacgacatcttcatccccagccccagcctggaggagcagagcaacgacggcaagaaggacggcgacatgcacagcagcagcctgaccgtggagtgcagcaagaccagcgagatcgagcccaagaacagccccgaggacctgggcctgagcctgaccggcgacagctgcaagctgatgctgagcaccagcgagtacagccagagccccaagatggagagcctgagcagccacagaatcgacgaggacggcgagaacacccagatcgaggacaccgagcccatgagccccgtgctgaacagcaagttcgtgcccgccgagaacgacagcatcctgatgaaccccgcccaggacggcgaggtgcagctgagccagaacgacgacaagaccaagggcgacgacaccgacaccagagacgacatcagcatcctggccaccggctgcaagggcagagaggagaccgtggccgaggacgtgtgcatcgacctgacctgcgacagcggcagccaggccgtgcccagccccgccaccagaagcgaggccctgagcagcgtgctggaccaggaggaggccatggagatcaaggagcaccaccccgaggagggcagcagcggcagcgaggtggaggagatccccgagaccccctgcgagagccagggcgaggagctgaaggaggagaacatggagagcgtgcccctgcacctgagcctgaccgagacccagagccagggcctgtgcctgcagaaggagatgcccaagaaggagtgcagcgaggccatggaggtggagaccagcgtgatcagcatcgacagcccccagaagctggccatcctggaccaggagctggagcacaaggagcaggaggcctgggaggaggccaccagcgaggacagcagcgtggtgatcgtggacgtgaaggagcccagccccagagtggacgtgagctgcgagcccctggagggcgtggagaagtgcagcgacagccagagctgggaggacatcgcccccgagatcgagccctgcgccgagaacagactggacaccaaggaggagaagagcgtggagtacgagggcgacctgaagagcggcaccgccgagaccgagcccgtggagcaggacagcagccagcccagcctgcccctggtgagagccgacgaccccctgagactggaccaggagctgcagcagccccagacccaggagaagaccagcaacagcctgaccgaggacagcaagatggccaacgccaagcagctgagcagcgacgccgaggcccagaagctgggcaagcccagcgcccacgccagccagagcttctgcgagagcagcagcgagacccccttccacttcaccctgcccaaggagggcgacatcatcccccccctgaccggcgccaccccccccctgatcggccacctgaagctggagcccaagagacacagcacccccatcggcatcagcaactaccccgagagcaccatcgccaccagcgacgtgatgagcgagagcatggtggagacccacgaccccatcctgggcagcggcaagggcgacagcggcgccgcccccgacgtggacgacaagctgtgcctgagaatgaagctggtgagccccgagaccgaggccagcgaggagagcctgcagttcaacctggagaagcccgccaccggcgagagaaagaacggcagcaccgccgtggccgagagcgtggccagcccccagaagaccatgagcgtgctgagctgcatctgcgaggccagacaggagaacgaggccagaagcgaggacccccccaccacccccatcagaggcaacctgctgcacttccccagcagccagggcgaggaggagaaggagaagctggagggcgaccacaccatcagacagagccagcagcccatgaagcccatcagccccgtgaaggaccccgtgagccccgccagccagaagatggtgatccagggccccagcagcccccagggcgaggccatggtgaccgacgtgctggaggaccagaaggagggcagaagcaccaacaaggagaaccccagcaaggccctgatcgagagacccagccagaacaacatcggcatccagaccatggagtgcagcctgagagtgcccgagaccgtgagcgccgccacccagaccatcaagaacgtgtgcgagcagggcaccagcaccgtggaccagaacttcggcaagcaggacgccaccgtgcagaccgagagaggcagcggcgagaagcccgtgagcgcccccggcgacgacaccgagagcctgcacagccagggcgaggaggagttcgacatgccccagcccccccacggccacgtgctgcacagacacatgagaaccatcagagaggtgagaaccctggtgaccagagtgatcaccgacgtgtactacgtggacggcaccgaggtggagagaaaggtgaccgaggagaccgaggagcccatcgtggagtgccaggagtgcgagaccgaggtgagccccagccagaccggcggcagcagcggcgacctgggcgacatcagcagcttcagcagcaaggccagcagcctgcacagaaccagcagcggcaccagcctgagcgccatgcacagcagcggcagcagcggcaagggcgccggccccctgagaggcaagaccagcggcaccgagcccgccgacttcgccctgcccagcagcagaggcggccccggcaagctgagagagaccgccgtgcccggccccctgggcatcgaggacatcagccccaacctgagccccgacgacaagagcttcagcagagtggtgcccagagtgcccgacagcaccagaagaaccgacgtgggcgccggcgccctgagaagaagcgacagccccgagatccccttccaggccgccgccggccccagcgacggcctggacgccagcagccccggcaacagcttcgtgggcctgagagtggtggccaagtggagcagcaacggctacttctacagcggcaagatcaccagagacgtgggcgccggcaagtacaagctgctgttcgacgacggctacgagtgcgacgtgctgggcaaggacatcctgctgtgcgaccccatccccctggacaccgaggtgaccgccctgagcgaggacgagtacttcagcgccggcgtggtgaagggccacagaaaggagagcggcgagctgtactacagcatcgagaaggagggccagagaaagtggtacaagagaatggccgtgatcctgagcctggagcagggcaacagactgagagagcagtacggcctgggcccctacgaggccgtgacccccctgaccaaggccgccgacatcagcctggacaacctggtggagggcaagagaaagagaagaagcaacgtgagcagccccgccacccccaccgccagcagcagcagcagcaccacccccaccagaaagatcaccgagagccccagagccagcatgggcgtgctgagcggcaagagaaagctgatcaccagcgaggaggagagaagccccgccaagagaggcagaaagagcgccaccgtgaagcccggcgccgtgggcgccggcgagttcgtgagcccctgcgagagcggcgacaacaccggcgagcccagcgccctggaggagcagagaggccccctgcccctgaacaagaccctgttcctgggctacgccttcctgctgaccatggccaccaccagcgacaagctggccagcagaagcaagctgcccgacggccccaccggcagcagcgaggaggaggaggagttcctggagatcccccccttcaacaagcagtacaccgagagccagctgagagccggcgccggctacatcctggaggacttcaacgaggcccagtgcaacaccgcctaccagtgcctgctgatcgccgaccagcactgcagaaccagaaagtacttcctgtgcctggccagcggcatcccctgcgtgagccacgtgtgggtgcacgacagctgccacgccaaccagctgcagaactacagaaactacctgctgcccgccggctacagcctggaggagcagagaatcctggactggcagcccagagagaaccccttccagaacctgaaggtgctgctggtgagcgaccagcagcagaacttcctggagctgtggagcgagatcctgatgaccggcggcgccgccagcgtgaagcagcaccacagcagcgcccacaacaaggacatcgccctgggcgtgttcgacgtggtggtgaccgaccccagctgccccgccagcgtgctgaagtgcgccgaggccctgcagctgcccgtggtgagccaggagtgggtgatccagtgcctgatcgtgggcgagagaatcggcttcaagcagcaccccaagtacaagcacgactacgtgagccactag

SEQ ID NO: 13382 - DNA, 5934 bp, Artificial Sequence
  Description of Artificial Sequence: Synthetic coding sequence
atgcccggcgagcagatggaccccaccggcagccagctggacagcgacttcagccagcaggacaccccctgcctgatcatcgaggacagccagcccgagagccaggtgctggaggacgacagcggcagccacttcagcatgctgagcagacacctgcccaacctgcagacccacaaggagaaccccgtgctggacgtggtgagcaaccccgagcagaccgccggcgaggagagaggcgacggcaacagcggcttcaacgagcacctgaaggagaacaaggtggccgaccccgtggacagcagcaacctggacacctgcggcagcatcagccaggtgatcgagcagctgccccagcccaacagaaccagcagcgtgctgggcatgagcgtggagagcgcccccgccgtggaggaggagaagggcgaggagctggagcagaaggagaaggagaaggaggaggacaccagcggcaacaccacccacagcctgggcgccgaggacaccgccagcagccagctgggcttcggcgtgctggagctgagccagagccaggacgtggaggagaacaccgtgccctacgaggtggacaaggagcagctgcagagcgtgaccaccaacagcggctacaccagactgagcgacgtggacgccaacaccgccatcaagcacgaggagcagagcaacgaggacatccccatcgccgagcagagcagcaaggacatccccgtgaccgcccagcccagcaaggacgtgcacgtggtgaaggagcagaaccccccccccgccagaagcgaggacatgcccttcagccccaaggccagcgtggccgccatggaggccaaggagcagctgagcgcccaggagctgatggagagcggcctgcagatccagaagagccccgagcccgaggtgctgagcacccaggaggacctgttcgaccagagcaacaagaccgtgagcagcgacggctgcagcacccccagcagagaggagggcggctgcagcctggccagcacccccgccaccaccctgcacctgctgcagctgagcggccagagaagcctggtgcaggacagcctgagcaccaacagcagcgacctggtggcccccagccccgacgccttcagaagcacccccttcatcgtgcccagcagccccaccgagcaggagggcagacaggacaagcccatggacaccagcgtgctgagcgaggagggcggcgagcccttccagaagaagctgcagagcggcgagcccgtggagctggagaacccccccctgctgcccgagagcaccgtgagcccccaggccagcacccccatcagccagagcacccccgtgttcccccccggcagcctgcccatccccagccagccccagttcagccacgacatcttcatccccagccccagcctggaggagcagagcaacgacggcaagaaggacggcgacatgcacagcagcagcctgaccgtggagtgcagcaagaccagcgagatcgagcccaagaacagccccgaggacctgggcctgagcctgaccggcgacagctgcaagctgatgctgagcaccagcgagtacagccagagccccaagatggagagcctgagcagccacagaatcgacgaggacggcgagaacacccagatcgaggacaccgagcccatgagccccgtgctgaacagcaagttcgtgcccgccgagaacgacagcatcctgatgaaccccgcccaggacggcgaggtgcagctgagccagaacgacgacaagaccaagggcgacgacaccgacaccagagacgacatcagcatcctggccaccggctgcaagggcagagaggagaccgtggccgaggacgtgtgcatcgacctgacctgcgacagcggcagccaggccgtgcccagccccgccaccagaagcgaggccctgagcagcgtgctggaccaggaggaggccatggagatcaaggagcaccaccccgaggagggcagcagcggcagcgaggtggaggagatccccgagaccccctgcgagagccagggcgaggagctgaaggaggagaacatggagagcgtgcccctgcacctgagcctgaccgagacccagagccagggcctgtgcctgcagaaggagatgcccaagaaggagtgcagcgaggccatggaggtggagaccagcgtgatcagcatcgacagcccccagaagctggccatcctggaccaggagctggagcacaaggagcaggaggcctgggaggaggccaccagcgaggacagcagcgtggtgatcgtggacgtgaaggagcccagccccagagtggacgtgagctgcgagcccctggagggcgtggagaagtgcagcgacagccagagctgggaggacatcgcccccgagatcgagccctgcgccgagaacagactggacaccaaggaggagaagagcgtggagtacgagggcgacctgaagagcggcaccgccgagaccgagcccgtggagcaggacagcagccagcccagcctgcccctggtgagagccgacgaccccctgagactggaccaggagctgcagcagccccagacccaggagaagaccagcaacagcctgaccgaggacagcaagatggccaacgccaagcagctgagcagcgacgccgaggcccagaagctgggcaagcccagcgcccacgccagccagagcttctgcgagagcagcagcgagacccccttccacttcaccctgcccaaggagggcgacatcatcccccccctgaccggcgccaccccccccctgatcggccacctgaagctggagcccaagagacacagcacccccatcggcatcagcaactaccccgagagcaccatcgccaccagcgacgtgatgagcgagagcatggtggagacccacgaccccatcctgggcagcggcaagggcgacagcggcgccgcccccgacgtggacgacaagctgtgcctgagaatgaagctggtgagccccgagaccgaggccagcgaggagagcctgcagttcaacctggagaagcccgccaccggcgagagaaagaacggcagcaccgccgtggccgagagcgtggccagcccccagaagaccatgagcgtgctgagctgcatctgcgaggccagacaggagaacgaggccagaagcgaggacccccccaccacccccatcagaggcaacctgctgcacttccccagcagccagggcgaggaggagaaggagaagctggagggcgaccacaccatcagacagagccagcagcccatgaagcccatcagccccgtgaaggaccccgtgagccccgccagccagaagatggtgatccagggccccagcagcccccagggcgaggccatggtgaccgacgtgctggaggaccagaaggagggcagaagcaccaacaaggagaaccccagcaaggccctgatcgagagacccagccagaacaacatcggcatccagaccatggagtgcagcctgagagtgcccgagaccgtgagcgccgccacccagaccatcaagaacgtgtgcgagcagggcaccagcaccgtggaccagaacttcggcaagcaggacgccaccgtgcagaccgagagaggcagcggcgagaagcccgtgagcgcccccggcgacgacaccgagagcctgcacagccagggcgaggaggagttcgacatgccccagcccccccacggccacgtgctgcacagacacatgagaaccatcagagaggtgagaaccctggtgaccagagtgatcaccgacgtgtactacgtggacggcaccgaggtggagagaaaggtgaccgaggagaccgaggagcccatcgtggagtgccaggagtgcgagaccgaggtgagccccagccagaccggcggcagcagcggcgacctgggcgacatcagcagcttcagcagcaaggccagcagcctgcacagaaccagcagcggcaccagcctgagcgccatgcacagcagcggcagcagcggcaagggcgccggccccctgagaggcaagaccagcggcaccgagcccgccgacttcgccctgcccagcagcagaggcggccccggcaagctgagccccagaaagggcgtgagccagaccggcacccccgtgtgcgaggaggacggcgacgccggcctgggcatcagacagggcggcaaggcccccgtgacccccagaggcagaggcagaagaggcagaccccccagcagaaccaccggcaccagagagaccgccgtgcccggccccctgggcatcgaggacatcagccccaacctgagccccgacgacaagagcttcagcagagtggtgcccagagtgcccgacagcaccagaagaaccgacgtgggcgccggcgccctgagaagaagcgacagccccgagatccccttccaggccgccgccggccccagcgacggcctggacgccagcagccccggcaacagcttcgtgggcctgagagtggtggccaagtggagcagcaacggctacttctacagcggcaagatcaccagagacgtgggcgccggcaagtacaagctgctgttcgacgacggctacgagtgcgacgtgctgggcaaggacatcctgctgtgcgaccccatccccctggacaccgaggtgaccgccctgagcgaggacgagtacttcagcgccggcgtggtgaagggccacagaaaggagagcggcgagctgtactacagcatcgagaaggagggccagagaaagtggtacaagagaatggccgtgatcctgagcctggagcagggcaacagactgagagagcagtacggcctgggcccctacgaggccgtgacccccctgaccaaggccgccgacatcagcctggacaacctggtggagggcaagagaaagagaagaagcaacgtgagcagccccgccacccccaccgccagcagcagcagcagcaccacccccaccagaaagatcaccgagagccccagagccagcatgggcgtgctgagcggcaagagaaagctgatcaccagcgaggaggagagaagccccgccaagagaggcagaaagagcgccaccgtgaagcccggcgccgtgggcgccggcgagttcgtgagcccctgcgagagcggcgacaacaccggcgagcccagcgccctggaggagcagagaggccccctgcccctgaacaagaccctgttcctgggctacgccttcctgctgaccatggccaccaccagcgacaagctggccagcagaagcaagctgcccgacggccccaccggcagcagcgaggaggaggaggagttcctggagatcccccccttcaacaagcagtacaccgagagccagctgagagccggcgccggctacatcctggaggacttcaacgaggcccagtgcaacaccgcctaccagtgcctgctgatcgccgaccagcactgcagaaccagaaagtacttcctgtgcctggccagcggcatcccctgcgtgagccacgtgtgggtgcacgacagctgccacgccaaccagctgcagaactacagaaactacctgctgcccgccggctacagcctggaggagcagagaatcctggactggcagcccagagagaaccccttccagaacctgaaggtgctgctggtgagcgaccagcagcagaacttcctggagctgtggagcgagatcctgatgaccggcggcgccgccagcgtgaagcagcaccacagcagcgcccacaacaaggacatcgccctgggcgtgttcgacgtggtggtgaccgaccccagctgccccgccagcgtgctgaagtgcgccgaggccctgcagctgcccgtggtgagccaggagtgggtgatccagtgcctgatcgtgggcgagagaatcggcttcaagcagcaccccaagtacaagcacgactacgtgagccactag

SEQ ID NO: 13383 - DNA, 5928 bp, Artificial Sequence
  Description of Artificial Sequence: Synthetic coding sequence
atgcccggcgagcagatggaccccaccggcagccagctggacagcgacttcagccagcaggacaccccctgcctgatcatcgaggacagccagcccgagagccaggtgctggaggacgacagcggcagccacttcagcatgctgagcagacacctgcccaacctgcagacccacaaggagaaccccgtgctggacgtggtgagcaaccccgagcagaccgccggcgaggagagaggcgacggcaacagcggcttcaacgagcacctgaaggagaacaaggtggccgaccccgtggacagcagcaacctggacacctgcggcagcatcagccaggtgatcgagcagctgccccagcccaacagaaccagcagcgtgctgggcatgagcgtggagagcgcccccgccgtggaggaggagaagggcgaggagctggagcagaaggagaaggagaaggaggaggacaccagcggcaacaccacccacagcctgggcgccgaggacaccgccagcagccagctgggcttcggcgtgctggagctgagccagagccaggacgtggaggagaacaccgtgccctacgaggtggacaaggagcagctgcagagcgtgaccaccaacagcggctacaccagactgagcgacgtggacgccaacaccgccatcaagcacgaggagcagagcaacgaggacatccccatcgccgagcagagcagcaaggacatccccgtgaccgcccagcccagcaaggacgtgcacgtggtgaaggagcagaaccccccccccgccagaagcgaggacatgcccttcagccccaaggccagcgtggccgccatggaggccaaggagcagctgagcgcccaggagctgatggagagcggcctgcagatccagaagagccccgagcccgaggtgctgagcacccaggaggacctgttcgaccagagcaacaagaccgtgagcagcgacggctgcagcacccccagcagagaggagggcggctgcagcctggccagcacccccgccaccaccctgcacctgctgcagctgagcggccagagaagcctggtgcaggacagcctgagcaccaacagcagcgacctggtggcccccagccccgacgccttcagaagcacccccttcatcgtgcccagcagccccaccgagcaggagggcagacaggacaagcccatggacaccagcgtgctgagcgaggagggcggcgagcccttccagaagaagctgcagagcggcgagcccgtggagctggagaacccccccctgctgcccgagagcaccgtgagcccccaggccagcacccccatcagccagagcacccccgtgttcccccccggcagcctgcccatccccagccagccccagttcagccacgacatcttcatccccagccccagcctggaggagcagagcaacgacggcaagaaggacggcgacatgcacagcagcagcctgaccgtggagtgcagcaagaccagcgagatcgagcccaagaacagccccgaggacctgggcctgagcctgaccggcgacagctgcaagctgatgctgagcaccagcgagtacagccagagccccaagatggagagcctgagcagccacagaatcgacgaggacggcgagaacacccagatcgaggacaccgagcccatgagccccgtgctgaacagcaagttcgtgcccgccgagaacgacagcatcctgatgaaccccgcccaggacggcgaggtgcagctgagccagaacgacgacaagaccaagggcgacgacaccgacaccagagacgacatcagcatcctggccaccggctgcaagggcagagaggagaccgtggccgaggacgtgtgcatcgacctgacctgcgacagcggcagccaggccgtgcccagccccgccaccagaagcgaggccctgagcagcgtgctggaccaggaggaggccatggagatcaaggagcaccaccccgaggagggcagcagcggcagcgaggtggaggagatccccgagaccccctgcgagagccagggcgaggagctgaaggaggagaacatggagagcgtgcccctgcacctgagcctgaccgagacccagagccagggcctgtgcctgcagaaggagatgcccaagaaggagtgcagcgaggccatggaggtggagaccagcgtgatcagcatcgacagcccccagaagctggccatcctggaccaggagctggagcacaaggagcaggaggcctgggaggaggccaccagcgaggacagcagcgtggtgatcgtggacgtgaaggagcccagccccagagtggacgtgagctgcgagcccctggagggcgtggagaagtgcagcgacagccagagctgggaggacatcgcccccgagatcgagccctgcgccgagaacagactggacaccaaggaggagaagagcgtggagtacgagggcgacctgaagagcggcaccgccgagaccgagcccgtggagcaggacagcagccagcccagcctgcccctggtgagagccgacgaccccctgagactggaccaggagctgcagcagccccagacccaggagaagaccagcaacagcctgaccgaggacagcaagatggccaacgccaagcagctgagcagcgacgccgaggcccagaagctgggcaagcccagcgcccacgccagccagagcttctgcgagagcagcagcgagacccccttccacttcaccctgcccaaggagggcgacatcatcccccccctgaccggcgccaccccccccctgatcggccacctgaagctggagcccaagagacacagcacccccatcggcatcagcaactaccccgagagcaccatcgccaccagcgacgtgatgagcgagagcatggtggagacccacgaccccatcctgggcagcggcaagggcgacagcggcgccgcccccgacgtggacgacaagctgtgcctgagaatgaagctggtgagccccgagaccgaggccagcgaggagagcctgcagttcaacctggagaagcccgccaccggcgagagaaagaacggcagcaccgccgtggccgagagcgtggccagcccccagaagaccatgagcgtgctgagctgcatctgcgaggccagacaggagaacgaggccagaagcgaggacccccccaccacccccatcagaggcaacctgctgcacttccccagcagccagggcgaggaggagaaggagaagctggagggcgaccacaccatcagacagagccagcagcccatgaagcccatcagccccgtgaaggaccccgtgagccccgccagccagaagatggtgatccagggccccagcagcccccagggcgaggccatggtgaccgacgtgctggaggaccagaaggagggcagaagcaccaacaaggagaaccccagcaaggccctgatcgagagacccagccagaacaacatcggcatccagaccatggagtgcagcctgagagtgcccgagaccgtgagcgccgccacccagaccatcaagaacgtgtgcgagcagggcaccagcaccgtggaccagaacttcggcaagcaggacgccaccgtgcagaccgagagaggcagcggcgagaagcccgtgagcgcccccggcgacgacaccgagagcctgcacagccagggcgaggaggagttcgacatgccccagcccccccacggccacgtgctgcacagacacatgagaaccatcagagaggtgagaaccctggtgaccagagtgatcaccgacgtgtactacgtggacggcaccgaggtggagagaaaggtgaccgaggagaccgaggagcccatcgtggagtgccaggagtgcgagaccgaggtgagccccagccagaccggcggcagcagcggcgacctgggcgacatcagcagcttcagcagcaaggccagcagcctgcacagaaccagcagcggcaccagcctgagcgccatgcacagcagcggcagcagcggcaagggcgccggccccctgagaggcaagaccagcggcaccgagcccgccgacttcgccctgcccagcagcagaggcggccccggcaagctgagccccagaaagggcgtgagccagaccggcacccccgtgtgcgaggaggacggcgacgccggcctgggcatcagacagggcggcaaggcccccgtgacccccagaggcagaggcagaagaggcagaccccccagcagaaccaccggcaccagagagaccgccgtgcccggccccctgggcatcgaggacatcagccccaacctgagccccgacgacaagagcttcagcagagtggtgcccagagtgcccgacagcaccagaagaaccgacgtgggcgccggcgccctgagaagaagcgacagccccgagatccccttccaggccgccgccggccccagcgacggcctggacgccagcagccccggcaacagcttcgtgggcctgagagtggtggccaagtggagcagcaacggctacttctacagcggcaagatcaccagagacgtgggcgccggcaagtacaagctgctgttcgacgacggctacgagtgcgacgtgctgggcaaggacatcctgctgtgcgaccccatccccctggacaccgaggtgaccgccctgagcgaggacgagtacttcagcgccggcgtggtgaagggccacagaaaggagagcggcgagctgtactacagcatcgagaaggagggccagagaaagtggtacaagagaatggccgtgatcctgagcctggagcagggcaacagactgagagagcagtacggcctgggcccctacgaggccgtgacccccctgaccaaggccgccgacatcagcctggacaacctggtggagggcaagagaaagagaagaagcaacgtgagcagccccgccacccccaccgccagcagcagcagcagcaccacccccaccagaaagatcaccgagagccccagagccagcatgggcgtgctgagcggcaagagaaagctgatcaccagcgaggaggagagaagccccgccaagagaggcagaaagagcgccaccgtgaagcccgtgggcgccggcgagttcgtgagcccctgcgagagcggcgacaacaccggcgagcccagcgccctggaggagcagagaggccccctgcccctgaacaagaccctgttcctgggctacgccttcctgctgaccatggccaccaccagcgacaagctggccagcagaagcaagctgcccgacggccccaccggcagcagcgaggaggaggaggagttcctggagatcccccccttcaacaagcagtacaccgagagccagctgagagccggcgccggctacatcctggaggacttcaacgaggcccagtgcaacaccgcctaccagtgcctgctgatcgccgaccagcactgcagaaccagaaagtacttcctgtgcctggccagcggcatcccctgcgtgagccacgtgtgggtgcacgacagctgccacgccaaccagctgcagaactacagaaactacctgctgcccgccggctacagcctggaggagcagagaatcctggactggcagcccagagagaaccccttccagaacctgaaggtgctgctggtgagcgaccagcagcagaacttcctggagctgtggagcgagatcctgatgaccggcggcgccgccagcgtgaagcagcaccacagcagcgcccacaacaaggacatcgccctgggcgtgttcgacgtggtggtgaccgaccccagctgccccgccagcgtgctgaagtgcgccgaggccctgcagctgcccgtggtgagccaggagtgggtgatccagtgcctgatcgtgggcgagagaatcggcttcaagcagcaccccaagtacaagcacgactacgtgagccactag

SEQ ID NO: 13384 - DNA, 1623 bp, Artificial Sequence
  Description of Artificial Sequence: Synthetic coding sequence
atggcccagagcaccgccaccagccccgacggcggcaccaccttcgagcacctgtggagcagcctggagcccgacagcacctacttcgacctgccccagagcagcagaggcaacaacgaggtggtgggcggcaccgacagcagcatggacgtgttccacctggagggcatgaccaccagcgtgatggcccagttcaacctgctgagcagcaccatggaccagatgagcagcagagccgccagcgccagcccctacacccccgagcacgccgccagcgtgcccacccacagcccctacgcccagcccagcagcaccttcgacaccatgagccccgcccccgtgatccccagcaacaccgactaccccggcccccaccacttcgaggtgaccttccagcagagcagcaccgccaagagcgccacctggacctacagccccctgctgaagaagctgtactgccagatcgccaagacctgccccatccagatcaaggtgagcaccccccccccccccggcaccgccatcagagccatgcccgtgtacaagaaggccgagcacgtgaccgacgtggtgaagagatgccccaaccacgagctgggcagagacttcaacgagggccagagcgcccccgccagccacctgatcagagtggagggcaacaacctgagccagtacgtggacgaccccgtgaccggcagacagagcgtggtggtgccctacgagcccccccaggtgggcaccgagttcaccaccatcctgtacaacttcatgtgcaacagcagctgcgtgggcggcatgaacagaagacccatcctgatcatcatcaccctggagatgagagacggccaggtgctgggcagaagaagcttcgagggcagaatctgcgcctgccccggcagagacagaaaggccgacgaggaccactacagagagcagcaggccctgaacgagagcagcgccaagaacggcgccgccagcaagagagccttcaagcagagcccccccgccgtgcccgccctgggcgccggcgtgaagaagagaagacacggcgacgaggacacctactacctgcaggtgagaggcagagagaacttcgagatcctgatgaagctgaaggagagcctggagctgatggagctggtgccccagcccctggtggacagctacagacagcagcagcagctgctgcagagacccttcctgaccggcctgggctgccccaactgcatcgagtacttcaccagccagggcctgcagagcatctaccacctgcagaacctgaccatcgaggacctgggcgccctgaagatccccgagcagtacagaatgaccatctggagaggcctgcaggacctgaagcagggccacgactacagcaccgcccagcagctgctgagaagcagcaacgccgccaccatcagcatcggcggcagcggcgagctgcagagacagagagtgatggaggccgtgcacttcagagtgagacacaccatcaccatccccaacagaggcggccccggcggcggccccgacgagtgggccgacttcggcttcgacctgcccgactgcaaggccagaaagcagcccatcaaggaggagttcaccgaggccgagatccactag

SEQ ID NO: 13385 - DNA, 1500 bp, Artificial Sequence
  Description of Artificial Sequence: Synthetic coding sequence
atggcccagagcaccgccaccagccccgacggcggcaccaccttcgagcacctgtggagcagcctggagcccgacagcacctacttcgacctgccccagagcagcagaggcaacaacgaggtggtgggcggcaccgacagcagcatggacgtgttccacctggagggcatgaccaccagcgtgatggcccagttcaacctgctgagcagcaccatggaccagatgagcagcagagccgccagcgccagcccctacacccccgagcacgccgccagcgtgcccacccacagcccctacgcccagcccagcagcaccttcgacaccatgagccccgcccccgtgatccccagcaacaccgactaccccggcccccaccacttcgaggtgaccttccagcagagcagcaccgccaagagcgccacctggacctacagccccctgctgaagaagctgtactgccagatcgccaagacctgccccatccagatcaaggtgagcaccccccccccccccggcaccgccatcagagccatgcccgtgtacaagaaggccgagcacgtgaccgacgtggtgaagagatgccccaaccacgagctgggcagagacttcaacgagggccagagcgcccccgccagccacctgatcagagtggagggcaacaacctgagccagtacgtggacgaccccgtgaccggcagacagagcgtggtggtgccctacgagcccccccaggtgggcaccgagttcaccaccatcctgtacaacttcatgtgcaacagcagctgcgtgggcggcatgaacagaagacccatcctgatcatcatcaccctggagatgagagacggccaggtgctgggcagaagaagcttcgagggcagaatctgcgcctgccccggcagagacagaaaggccgacgaggaccactacagagagcagcaggccctgaacgagagcagcgccaagaacggcgccgccagcaagagagccttcaagcagagcccccccgccgtgcccgccctgggcgccggcgtgaagaagagaagacacggcgacgaggacacctactacctgcaggtgagaggcagagagaacttcgagatcctgatgaagctgaaggagagcctggagctgatggagctggtgccccagcccctggtggacagctacagacagcagcagcagctgctgcagagacccagccacctgcagccccccagctacggccccgtgctgagccccatgaacaaggtgcacggcggcatgaacaagctgcccagcgtgaaccagctggtgggccagccccccccccacagcagcgccgccacccccaacctgggccccgtgggccccggcatgctgaacaaccacggccacgccgtgcccgccaacggcgagatgagcagcagccacagcgcccagagcatggtgagcggcagccactgcacccccccccccccctaccacgccgaccccagcctggtgagaacctggggcccctag

SEQ ID NO: 13386 - DNA, 1668 bp, Artificial Sequence
  Description of Artificial Sequence: Synthetic coding sequence
atggcccagagcaccgccaccagccccgacggcggcaccaccttcgagcacctgtggagcagcctggagcccgacagcacctacttcgacctgccccagagcagcagaggcaacaacgaggtggtgggcggcaccgacagcagcatggacgtgttccacctggagggcatgaccaccagcgtgatggcccagttcaacctgctgagcagcaccatggaccagatgagcagcagagccgccagcgccagcccctacacccccgagcacgccgccagcgtgcccacccacagcccctacgcccagcccagcagcaccttcgacaccatgagccccgcccccgtgatccccagcaacaccgactaccccggcccccaccacttcgaggtgaccttccagcagagcagcaccgccaagagcgccacctggacctacagccccctgctgaagaagctgtactgccagatcgccaagacctgccccatccagatcaaggtgagcaccccccccccccccggcaccgccatcagagccatgcccgtgtacaagaaggccgagcacgtgaccgacgtggtgaagagatgccccaaccacgagctgggcagagacttcaacgagggccagagcgcccccgccagccacctgatcagagtggagggcaacaacctgagccagtacgtggacgaccccgtgaccggcagacagagcgtggtggtgccctacgagcccccccaggtgggcaccgagttcaccaccatcctgtacaacttcatgtgcaacagcagctgcgtgggcggcatgaacagaagacccatcctgatcatcatcaccctggagatgagagacggccaggtgctgggcagaagaagcttcgagggcagaatctgcgcctgccccggcagagacagaaaggccgacgaggaccactacagagagcagcaggccctgaacgagagcagcgccaagaacggcgccgccagcaagagagccttcaagcagagcccccccgccgtgcccgccctgggcgccggcgtgaagaagagaagacacggcgacgaggacacctactacctgcaggtgagaggcagagagaacttcgagatcctgatgaagctgaaggagagcctggagctgatggagctggtgccccagcccctggtggacagctacagacagcagcagcagctgctgcagagaccccccagagacgcccagcagccctggcccagaagcgccagccagagaagagacgagcagcagccccagagacccgtgcacggcctgggcgtgcccctgcacagcgccacccccctgcccagaagaccccagcccagacaggacctgggcgccctgaagatccccgagcagtacagaatgaccatctggagaggcctgcaggacctgaagcagggccacgactacagcaccgcccagcagctgctgagaagcagcaacgccgccaccatcagcatcggcggcagcggcgagctgcagagacagagagtgatggaggccgtgcacttcagagtgagacacaccatcaccatccccaacagaggcggccccggcggcggccccgacgagtgggccgacttcggcttcgacctgcccgactgcaaggccagaaagcagcccatcaaggaggagttcaccgaggccgagatccactag

SEQ ID NO: 13387 - DNA, 1281 bp, Artificial Sequence
  Description of Artificial Sequence: Synthetic coding sequence
atgctgtacgtgggcgaccccgccagacacctggccaccgcccagttcaacctgctgagcagcaccatggaccagatgagcagcagagccgccagcgccagcccctacacccccgagcacgccgccagcgtgcccacccacagcccctacgcccagcccagcagcaccttcgacaccatgagccccgcccccgtgatccccagcaacaccgactaccccggcccccaccacttcgaggtgaccttccagcagagcagcaccgccaagagcgccacctggacctacagccccctgctgaagaagctgtactgccagatcgccaagacctgccccatccagatcaaggtgagcaccccccccccccccggcaccgccatcagagccatgcccgtgtacaagaaggccgagcacgtgaccgacgtggtgaagagatgccccaaccacgagctgggcagagacttcaacgagggccagagcgcccccgccagccacctgatcagagtggagggcaacaacctgagccagtacgtggacgaccccgtgaccggcagacagagcgtggtggtgccctacgagcccccccaggtgggcaccgagttcaccaccatcctgtacaacttcatgtgcaacagcagctgcgtgggcggcatgaacagaagacccatcctgatcatcatcaccctggagatgagagacggccaggtgctgggcagaagaagcttcgagggcagaatctgcgcctgccccggcagagacagaaaggccgacgaggaccactacagagagcagcaggccctgaacgagagcagcgccaagaacggcgccgccagcaagagagccttcaagcagagcccccccgccgtgcccgccctgggcgccggcgtgaagaagagaagacacggcgacgaggacacctactacctgcaggtgagaggcagagagaacttcgagatcctgatgaagctgaaggagagcctggagctgatggagctggtgccccagcccctggtggacagctacagacagcagcagcagctgctgcagagaccccccagagacgcccagcagccctggcccagaagcgccagccagagaagagacgagcagcagccccagagacccgtgcacggcctgggcgtgcccctgcacagcgccacccccctgcccagaagaccccagcccagacagttcttcaacagaatcggcgtgagcaagctgcacagagtgttccacctgcccagagtgaccgagcacctgccccccgccgagcccgaccactag

SEQ ID NO: 13388 - DNA, 1353 bp, Artificial Sequence
  Description of Artificial Sequence: Synthetic coding sequence
atgctgtacgtgggcgaccccgccagacacctggccaccgcccagttcaacctgctgagcagcaccatggaccagatgagcagcagagccgccagcgccagcccctacacccccgagcacgccgccagcgtgcccacccacagcccctacgcccagcccagcagcaccttcgacaccatgagccccgcccccgtgatccccagcaacaccgactaccccggcccccaccacttcgaggtgaccttccagcagagcagcaccgccaagagcgccacctggacctacagccccctgctgaagaagctgtactgccagatcgccaagacctgccccatccagatcaaggtgagcaccccccccccccccggcaccgccatcagagccatgcccgtgtacaagaaggccgagcacgtgaccgacgtggtgaagagatgccccaaccacgagctgggcagagacttcaacgagggccagagcgcccccgccagccacctgatcagagtggagggcaacaacctgagccagtacgtggacgaccccgtgaccggcagacagagcgtggtggtgccctacgagcccccccaggtgggcaccgagttcaccaccatcctgtacaacttcatgtgcaacagcagctgcgtgggcggcatgaacagaagacccatcctgatcatcatcaccctggagatgagagacggccaggtgctgggcagaagaagcttcgagggcagaatctgcgcctgccccggcagagacagaaaggccgacgaggaccactacagagagcagcaggccctgaacgagagcagcgccaagaacggcgccgccagcaagagagccttcaagcagagcccccccgccgtgcccgccctgggcgccggcgtgaagaagagaagacacggcgacgaggacacctactacctgcaggtgagaggcagagagaacttcgagatcctgatgaagctgaaggagagcctggagctgatggagctggtgccccagcccctggtggacagctacagacagcagcagcagctgctgcagagacccagccacctgcagccccccagctacggccccgtgctgagccccatgaacaaggtgcacggcggcatgaacaagctgcccagcgtgaaccagctggtgggccagccccccccccacagcagcgccgccacccccaacctgggccccgtgggccccggcatgctgaacaaccacggccacgccgtgcccgccaacggcgagatgagcagcagccacagcgcccagagcatggtgagcggcagccactgcacccccccccccccctaccacgccgaccccagcctggtgagaacctggggcccctag

SEQ ID NO: 13389 - DNA, 1764 bp, Artificial Sequence
  Description of Artificial Sequence: Synthetic coding sequence
atgctgtacgtgggcgaccccgccagacacctggccaccgcccagttcaacctgctgagcagcaccatggaccagatgagcagcagagccgccagcgccagcccctacacccccgagcacgccgccagcgtgcccacccacagcccctacgcccagcccagcagcaccttcgacaccatgagccccgcccccgtgatccccagcaacaccgactaccccggcccccaccacttcgaggtgaccttccagcagagcagcaccgccaagagcgccacctggacctacagccccctgctgaagaagctgtactgccagatcgccaagacctgccccatccagatcaaggtgagcaccccccccccccccggcaccgccatcagagccatgcccgtgtacaagaaggccgagcacgtgaccgacgtggtgaagagatgccccaaccacgagctgggcagagacttcaacgagggccagagcgcccccgccagccacctgatcagagtggagggcaacaacctgagccagtacgtggacgaccccgtgaccggcagacagagcgtggtggtgccctacgagcccccccaggtgggcaccgagttcaccaccatcctgtacaacttcatgtgcaacagcagctgcgtgggcggcatgaacagaagacccatcctgatcatcatcaccctggagatgagagacggccaggtgctgggcagaagaagcttcgagggcagaatctgcgcctgccccggcagagacagaaaggccgacgaggaccactacagagagcagcaggccctgaacgagagcagcgccaagaacggcgccgccagcaagagagccttcaagcagagcccccccgccgtgcccgccctgggcgccggcgtgaagaagagaagacacggcgacgaggacacctactacctgcaggtgagaggcagagagaacttcgagatcctgatgaagctgaaggagagcctggagctgatggagctggtgccccagcccctggtggacagctacagacagcagcagcagctgctgcagagacccagccacctgcagccccccagctacggccccgtgctgagccccatgaacaaggtgcacggcggcatgaacaagctgcccagcgtgaaccagctggtgggccagccccccccccacagcagcgccgccacccccaacctgggccccgtgggccccggcatgctgaacaaccacggccacgccgtgcccgccaacggcgagatgagcagcagccacagcgcccagagcatggtgagcggcagccactgcacccccccccccccctaccacgccgaccccagcctggtgagcttcctgaccggcctgggctgccccaactgcatcgagtacttcaccagccagggcctgcagagcatctaccacctgcagaacctgaccatcgaggacctgggcgccctgaagatccccgagcagtacagaatgaccatctggagaggcctgcaggacctgaagcagggccacgactacagcaccgcccagcagctgctgagaagcagcaacgccgccaccatcagcatcggcggcagcggcgagctgcagagacagagagtgatggaggccgtgcacttcagagtgagacacaccatcaccatccccaacagaggcggccccggcggcggccccgacgagtgggccgacttcggcttcgacctgcccgactgcaaggccagaaagcagcccatcaaggaggagttcaccgaggccgagatccactag

SEQ ID NO: 13390 - DNA, 1698 bp, Artificial Sequence
  Description of Artificial Sequence: Synthetic coding sequence
atggaccagatgagcagcagagccgccagcgccagcccctacacccccgagcacgccgccagcgtgcccacccacagcccctacgcccagcccagcagcaccttcgacaccatgagccccgcccccgtgatccccagcaacaccgactaccccggcccccaccacttcgaggtgaccttccagcagagcagcaccgccaagagcgccacctggacctacagccccctgctgaagaagctgtactgccagatcgccaagacctgccccatccagatcaaggtgagcaccccccccccccccggcaccgccatcagagccatgcccgtgtacaagaaggccgagcacgtgaccgacgtggtgaagagatgccccaaccacgagctgggcagagacttcaacgagggccagagcgcccccgccagccacctgatcagagtggagggcaacaacctgagccagtacgtggacgaccccgtgaccggcagacagagcgtggtggtgccctacgagcccccccaggtgggcaccgagttcaccaccatcctgtacaacttcatgtgcaacagcagctgcgtgggcggcatgaacagaagacccatcctgatcatcatcaccctggagatgagagacggccaggtgctgggcagaagaagcttcgagggcagaatctgcgcctgccccggcagagacagaaaggccgacgaggaccactacagagagcagcaggccctgaacgagagcagcgccaagaacggcgccgccagcaagagagccttcaagcagagcccccccgccgtgcccgccctgggcgccggcgtgaagaagagaagacacggcgacgaggacacctactacctgcaggtgagaggcagagagaacttcgagatcctgatgaagctgaaggagagcctggagctgatggagctggtgccccagcccctggtggacagctacagacagcagcagcagctgctgcagagacccagccacctgcagccccccagctacggccccgtgctgagccccatgaacaaggtgcacggcggcatgaacaagctgcccagcgtgaaccagctggtgggccagccccccccccacagcagcgccgccacccccaacctgggccccgtgggccccggcatgctgaacaaccacggccacgccgtgcccgccaacggcgagatgagcagcagccacagcgcccagagcatggtgagcggcagccactgcacccccccccccccctaccacgccgaccccagcctggtgagcttcctgaccggcctgggctgccccaactgcatcgagtacttcaccagccagggcctgcagagcatctaccacctgcagaacctgaccatcgaggacctgggcgccctgaagatccccgagcagtacagaatgaccatctggagaggcctgcaggacctgaagcagggccacgactacagcaccgcccagcagctgctgagaagcagcaacgccgccaccatcagcatcggcggcagcggcgagctgcagagacagagagtgatggaggccgtgcacttcagagtgagacacaccatcaccatccccaacagaggcggccccggcggcggccccgacgagtgggccgacttcggcttcgacctgcccgactgcaaggccagaaagcagcccatcaaggaggagttcaccgaggccgagatccactag

SEQ ID NO: 13391 - DNA, 1911 bp, Artificial Sequence
  Description of Artificial Sequence: Synthetic coding sequence
atggcccagagcaccgccaccagccccgacggcggcaccaccttcgagcacctgtggagcagcctggagcccgacagcacctacttcgacctgccccagagcagcagaggcaacaacgaggtggtgggcggcaccgacagcagcatggacgtgttccacctggagggcatgaccaccagcgtgatggcccagttcaacctgctgagcagcaccatggaccagatgagcagcagagccgccagcgccagcccctacacccccgagcacgccgccagcgtgcccacccacagcccctacgcccagcccagcagcaccttcgacaccatgagccccgcccccgtgatccccagcaacaccgactaccccggcccccaccacttcgaggtgaccttccagcagagcagcaccgccaagagcgccacctggacctacagccccctgctgaagaagctgtactgccagatcgccaagacctgccccatccagatcaaggtgagcaccccccccccccccggcaccgccatcagagccatgcccgtgtacaagaaggccgagcacgtgaccgacgtggtgaagagatgccccaaccacgagctgggcagagacttcaacgagggccagagcgcccccgccagccacctgatcagagtggagggcaacaacctgagccagtacgtggacgaccccgtgaccggcagacagagcgtggtggtgccctacgagcccccccaggtgggcaccgagttcaccaccatcctgtacaacttcatgtgcaacagcagctgcgtgggcggcatgaacagaagacccatcctgatcatcatcaccctggagatgagagacggccaggtgctgggcagaagaagcttcgagggcagaatctgcgcctgccccggcagagacagaaaggccgacgaggaccactacagagagcagcaggccctgaacgagagcagcgccaagaacggcgccgccagcaagagagccttcaagcagagcccccccgccgtgcccgccctgggcgccggcgtgaagaagagaagacacggcgacgaggacacctactacctgcaggtgagaggcagagagaacttcgagatcctgatgaagctgaaggagagcctggagctgatggagctggtgccccagcccctggtggacagctacagacagcagcagcagctgctgcagagacccagccacctgcagccccccagctacggccccgtgctgagccccatgaacaaggtgcacggcggcatgaacaagctgcccagcgtgaaccagctggtgggccagccccccccccacagcagcgccgccacccccaacctgggccccgtgggccccggcatgctgaacaaccacggccacgccgtgcccgccaacggcgagatgagcagcagccacagcgcccagagcatggtgagcggcagccactgcacccccccccccccctaccacgccgaccccagcctggtgagcttcctgaccggcctgggctgccccaactgcatcgagtacttcaccagccagggcctgcagagcatctaccacctgcagaacctgaccatcgaggacctgggcgccctgaagatccccgagcagtacagaatgaccatctggagaggcctgcaggacctgaagcagggccacgactacagcaccgcccagcagctgctgagaagcagcaacgccgccaccatcagcatcggcggcagcggcgagctgcagagacagagagtgatggaggccgtgcacttcagagtgagacacaccatcaccatccccaacagaggcggccccggcggcggccccgacgagtgggccgacttcggcttcgacctgcccgactgcaaggccagaaagcagcccatcaaggaggagttcaccgaggccgagatccactag

SEQ ID NO: 13392 - DNA, 1053 bp, Artificial Sequence
  Description of Artificial Sequence: Synthetic coding sequence
atgggcgccggcgccagcgccgaggagaagcacagcagagagctggagaagaagctgaaggaggacgccgagaaggacgccagaaccgtgaagctgctgctgctgggcgccggcgagagcggcaagagcaccatcgtgaagcagatgaagatcatccaccaggacggctacagcctggaggagtgcctggagttcatcgccatcatctacggcaacaccctgcagagcatcctggccatcgtgagagccatgaccaccctgaacatccagtacggcgacagcgccagacaggacgacgccagaaagctgatgcacatggccgacaccatcgaggagggcaccatgcccaaggagatgagcgacatcatccagagactgtggaaggacagcggcatccaggcctgcttcgagagagccagcgagtaccagctgaacgacagcgccggctactacctgagcgacctggagagactggtgacccccggctacgtgcccaccgagcaggacgtgctgagaagcagagtgaagaccaccggcatcatcgagacccagttcagcttcaaggacctgaacttcagaatgttcgacgtgggcggccagagaagcgagagaaagaagtggatccactgcttcgagggcgtgacctgcatcatcttcatcgccgccctgagcgcctacgacatggtgctggtggaggacgacgaggtgaacagaatgcacgagagcctgcacctgttcaacagcatctgcaaccacagatacttcgccaccaccagcatcgtgctgttcctgaacaagaaggacgtgttcttcgagaagatcaagaaggcccacctgagcatctgcttccccgactacgacggccccaacacctacgaggacgccggcaactacatcaaggtgcagttcctggagctgaacatgagaagagacgtgaaggagatctacagccacatgacctgcgccaccgacacccagaacgtgaagttcgtgttcgacgccgtgaccgacatcatcatcaaggagaacctgaaggactgcggcctgttctag

SEQ ID NO: 13393 - DNA, 609 bp, Artificial Sequence
  Description of Artificial Sequence: Synthetic coding sequence
atgatgcaggacgtgagcagcagccccgtgagccccgccgacgacagcctgagcaacagcgaggaggagcccgacagacagcagccccccagcggcaagagaggcggcagaaagagaagaagcagcagaagaagcgccggcggcggcgccggccccggcggcgccgccggcggcggcgtgggcggcggcgacgagcccggcagccccgcccagggcaagagaggcaagaagagcgccggctgcggcggcggcggcggcgccggcggcggcggcggcagcagcagcggcggcggcagcccccagagctacgaggagctgcagacccagagagtgatggccaacgtgagagagagacagagaacccagagcctgaacgaggccttcgccgccctgagaaagatcatccccaccctgcccagcgacaagctgagcaagatccagaccctgaagctggccgccagatacatcgacttcctgtaccaggtgctgcagagcgacgagctggacagcaagatggccagctgcagctacgtggcccacgagagactgagctacgccttcagcgtgtggagaatggagggcgcctggagcatgagcgccagccactag

SEQ ID NO: 13394 - DNA, 741 bp, Artificial Sequence
  Description of Artificial Sequence: Synthetic coding sequence
atgggcgacagagagcagctgctgcagagagccagactggccgagcaggccgagagatacgacgacatggccagcgccatgaaggccgtgaccgagctgaacgagcccctgagcaacgaggacagaaacctgctgagcgtggcctacaagaacgtggtgggcgccagaagaagcagctggagagtgatcagcagcatcgagcagaagaccatggccgacggcaacgagaagaagctggagaaggtgaaggcctacagagagaagatcgagaaggagctggagaccgtgtgcaacgacgtgctgagcctgctggacaagttcctgatcaagaactgcaacgacttccagtacgagagcaaggtgttctacctgaagatgaagggcgactactacagatacctggccgaggtggccagcggcgagaagaagaacagcgtggtggaggccagcgaggccgcctacaaggaggccttcgagatcagcaaggagcagatgcagcccacccaccccatcagactgggcctggccctgaacttcagcgtgttctactacgagatccagaacgcccccgagcaggcctgcctgctggccaagcaggccttcgacgacgccatcgccgagctggacaccctgaacgaggacagctacaaggacagcaccctgatcatgcagctgctgagagacaacctgaccctgtggaccagcgaccagcaggacgaggaggccggcgagggcaactag

SEQ ID NO: 13395 - DNA, 1626 bp, Artificial Sequence
  Description of Artificial Sequence: Synthetic coding sequence
atggtgtggagagtgccccccttcctgctgcccatcctgttcctgggcacccactaccagctggacgtgcagctgtaccactgcaccctgctgggccccgccagcccccccgcccacgtgctgctgccccccagcggcccccccgcccccagacacctgcacgcccaggccctgagcgacagcgagatccagctgacctggaagcaccccgaggccctgcccggccccatcagcaagtacgtggtggaggtgcaggtggccggcggcgccggcgaccccctgtggatcgacgtggacagacccgaggagaccagcaccatcatcagaggcctgaacgccagcaccagatacctgttcagaatgagagccagcatccagggcctgggcgactggagcaacaccgtggaggagagcaccctgggcaacggcctgcaggccgagggccccgtgcaggagagcagagccgccgaggagggcctggaccagcagctgatcctggccgtggtgggcagcgtgagcgccacctgcctgaccatcctggccgccctgctgaccctggtgtgcatcagaagaagctgcctgcacagaagaagaaccttcacctaccagagcggcagcggcgaggagaccatcctgcagttcagcagcggcaccctgaccctgaccagaagacccaagctgcagcccgagcccctgagctaccccgtgctggagtgggaggacatcaccttcgaggacctgatcggcgagggcaacttcggccaggtgatcagagccatgatcaagaaggacggcctgaagatgaacgccgccatcaagatgctgaaggagtacgccagcgagaacgaccacagagacttcgccggcgagctggaggtgctgtgcaagctgggccaccaccccaacatcatcaacctgctgggcgcctgcaagaacagaggctacctgtacatcgccatcgagtacgccccctacggcaacctgctggacttcctgagaaagagcagagtgctggagaccgaccccgccttcgccagagagcacggcaccgccagcaccctgagcagcagacagctgctgagattcgccagcgacgccgccaacggcatgcagtacctgagcgagaagcagttcatccacagagacctggccgccagaaacgtgctggtgggcgagaacctggccagcaagatcgccgacttcggcctgagcagaggcgaggaggtgtacgtgaagaagaccatgggcagactgcccgtgagatggatggccatcgagagcctgaactacagcgtgtacaccaccaagagcgacgtgtggagcttcggcgtgctgctgtgggagatcgtgagcctgggcggcaccccctactgcggcatgacctgcgccgagctgtacgagaagctgccccagggctacagaatggagcagcccagaaactgcgacgacgaggtgtacgagctgatgagacagtgctggagagacagaccctacgagagaccccccttcgcccagatcgccctgcagctgggcagaatgctggaggccagaaaggcctacgtgaacatgagcctgttcgagaacttcacctacgccggcatcgacgccaccgccgaggaggcctag

SEQ ID NO: 13396 - DNA, 3417 bp, Artificial Sequence
  Description of Artificial Sequence: Synthetic coding sequence
atggtgtggagagtgccccccttcctgctgcccatcctgttcctggccagccacgtgggcgccgccgtggacctgaccctgctggccaacctgagactgaccgacccccagagattcttcctgacctgcgtgagcggcgaggccggcgccggcagaggcagcgacgcctggggcccccccctgctgctggagaaggacgacagaatcgtgagaaccccccccggcccccccctgagactggccagaaacggcagccaccaggtgaccctgagaggcttcagcaagcccagcgacctggtgggcgtgttcagctgcgtgggcggcgccggcgccagaagaaccagagtgatctacgtgcacaacagccccggcgcccacctgctgcccgacaaggtgacccacaccgtgaacaagggcgacaccgccgtgctgagcgccagagtgcacaaggagaagcagaccgacgtgatctggaagagcaacggcagctacttctacaccctggactggcacgaggcccaggacggcagattcctgctgcagctgcccaacgtgcagccccccagcagcggcatctacagcgccacctacctggaggccagccccctgggcagcgccttcttcagactgatcgtgagaggctgcggcgccggcagatggggccccggctgcaccaaggagtgccccggctgcctgcacggcggcgtgtgccacgaccacgacggcgagtgcgtgtgcccccccggcttcaccggcaccagatgcgagcaggcctgcagagagggcagattcggccagagctgccaggagcagtgccccggcatcagcggctgcagaggcctgaccttctgcctgcccgacccctacggctgcagctgcggcagcggctggagaggcagccagtgccaggaggcctgcgcccccggccacttcggcgccgactgcagactgcagtgccagtgccagaacggcggcacctgcgacagattcagcggctgcgtgtgccccagcggctggcacggcgtgcactgcgagaagagcgacagaatcccccagatcctgaacatggccagcgagctggagttcaacctggagaccatgcccagaatcaactgcgccgccgccggcaaccccttccccgtgagaggcagcatcgagctgagaaagcccgacggcaccgtgctgctgagcaccaaggccatcgtggagcccgagaagaccaccgccgagttcgaggtgcccagactggtgctggccgacagcggcttctgggagtgcagagtgagcaccagcggcggccaggacagcagaagattcaaggtgaacgtgaaggtgccccccgtgcccctggccgcccccagactgctgaccaagcagagcagacagctggtggtgagccccctggtgagcttcagcggcgacggccccatcagcaccgtgagactgcactacagaccccaggacagcaccatggactggagcaccatcgtggtggaccccagcgagaacgtgaccctgatgaacctgagacccaagaccggctacagcgtgagagtgcagctgagcagacccggcgagggcggcgagggcgcctggggcccccccaccctgatgaccaccgactgccccgagcccctgctgcagccctggctggagggctggcacgtggagggcaccgacagactgagagtgagctggagcctgcccctggtgcccggccccctggtgggcgacggcttcctgctgagactgtgggacggcaccagaggccaggagagaagagagaacgtgagcagcccccaggccagaaccgccctgctgaccggcctgacccccggcacccactaccagctggacgtgcagctgtaccactgcaccctgctgggccccgccagcccccccgcccacgtgctgctgccccccagcggcccccccgcccccagacacctgcacgcccaggccctgagcgacagcgagatccagctgacctggaagcaccccgaggccctgcccggccccatcagcaagtacgtggtggaggtgcaggtggccggcggcgccggcgaccccctgtggatcgacgtggacagacccgaggagaccagcaccatcatcagaggcctgaacgccagcaccagatacctgttcagaatgagagccagcatccagggcctgggcgactggagcaacaccgtggaggagagcaccctgggcaacggcctgcaggccgagggccccgtgcaggagagcagagccgccgaggagggcctggaccagcagctgatcctggccgtggtgggcagcgtgagcgccacctgcctgaccatcctggccgccctgctgaccctggtgtgcatcagaagaagctgcctgcacagaagaagaaccttcacctaccagagcggcagcggcgaggagaccatcctgcagttcagcagcggcaccctgaccctgaccagaagacccaagctgcagcccgagcccctgagctaccccgtgctggagtgggaggacatcaccttcgaggacctgatcggcgagggcaacttcggccaggtgatcagagccatgatcaagaaggacggcctgaagatgaacgccgccatcaagatgctgaaggagtacgccagcgagaacgaccacagagacttcgccggcgagctggaggtgctgtgcaagctgggccaccaccccaacatcatcaacctgctgggcgcctgcaagaacagaggctacctgtacatcgccatcgagtacgccccctacggcaacctgctggacttcctgagaaagagcagagtgctggagaccgaccccgccttcgccagagagcacggcaccgccagcaccctgagcagcagacagctgctgagattcgccagcgacgccgccaacggcatgcagtacctgagcgagaagcagttcatccacagagacctggccgccagaaacgtgctggtgggcgagaacctggccagcaagatcgccgacttcggcctgagcagaggcgaggaggtgtacgtgaagaagaccatgggcagactgcccgtgagatggatggccatcgagagcctgaactacagcgtgtacaccaccaagagcgacgtgtggagcttcggcgtgctgctgtgggagatcgtgagcctgggcggcaccccctactgcggcatgacctgcgccgagctgtacgagaagctgccccagggctacagaatggagcagcccagaaactgcgacgacgaggtgtacgagctgatgagacagtgctggagagacagaccctacgagagaccccccttcgcccagatcgccctgcagctgggcagaatgctggaggccagaaaggcctacgtgaacatgagcctgttcgagaacttcacctacgccggcatcgacgccaccgccgaggaggcctag

SEQ ID NO: 13397 - DNA, 2352 bp, Artificial Sequence
  Description of Artificial Sequence: Synthetic coding sequence
atggccagcgagctggagttcaacctggagaccatgcccagaatcaactgcgccgccgccggcaaccccttccccgtgagaggcagcatcgagctgagaaagcccgacggcaccgtgctgctgagcaccaaggccatcgtggagcccgagaagaccaccgccgagttcgaggtgcccagactggtgctggccgacagcggcttctgggagtgcagagtgagcaccagcggcggccaggacagcagaagattcaaggtgaacgtgaaggtgccccccgtgcccctggccgcccccagactgctgaccaagcagagcagacagctggtggtgagccccctggtgagcttcagcggcgacggccccatcagcaccgtgagactgcactacagaccccaggacagcaccatggactggagcaccatcgtggtggaccccagcgagaacgtgaccctgatgaacctgagacccaagaccggctacagcgtgagagtgcagctgagcagacccggcgagggcggcgagggcgcctggggcccccccaccctgatgaccaccgactgccccgagcccctgctgcagccctggctggagggctggcacgtggagggcaccgacagactgagagtgagctggagcctgcccctggtgcccggccccctggtgggcgacggcttcctgctgagactgtgggacggcaccagaggccaggagagaagagagaacgtgagcagcccccaggccagaaccgccctgctgaccggcctgacccccggcacccactaccagctggacgtgcagctgtaccactgcaccctgctgggccccgccagcccccccgcccacgtgctgctgccccccagcggcccccccgcccccagacacctgcacgcccaggccctgagcgacagcgagatccagctgacctggaagcaccccgaggccctgcccggccccatcagcaagtacgtggtggaggtgcaggtggccggcggcgccggcgaccccctgtggatcgacgtggacagacccgaggagaccagcaccatcatcagaggcctgaacgccagcaccagatacctgttcagaatgagagccagcatccagggcctgggcgactggagcaacaccgtggaggagagcaccctgggcaacggcctgcaggccgagggccccgtgcaggagagcagagccgccgaggagggcctggaccagcagctgatcctggccgtggtgggcagcgtgagcgccacctgcctgaccatcctggccgccctgctgaccctggtgtgcatcagaagaagctgcctgcacagaagaagaaccttcacctaccagagcggcagcggcgaggagaccatcctgcagttcagcagcggcaccctgaccctgaccagaagacccaagctgcagcccgagcccctgagctaccccgtgctggagtgggaggacatcaccttcgaggacctgatcggcgagggcaacttcggccaggtgatcagagccatgatcaagaaggacggcctgaagatgaacgccgccatcaagatgctgaaggagtacgccagcgagaacgaccacagagacttcgccggcgagctggaggtgctgtgcaagctgggccaccaccccaacatcatcaacctgctgggcgcctgcaagaacagaggctacctgtacatcgccatcgagtacgccccctacggcaacctgctggacttcctgagaaagagcagagtgctggagaccgaccccgccttcgccagagagcacggcaccgccagcaccctgagcagcagacagctgctgagattcgccagcgacgccgccaacggcatgcagtacctgagcgagaagcagttcatccacagagacctggccgccagaaacgtgctggtgggcgagaacctggccagcaagatcgccgacttcggcctgagcagaggcgaggaggtgtacgtgaagaagaccatgggcagactgcccgtgagatggatggccatcgagagcctgaactacagcgtgtacaccaccaagagcgacgtgtggagcttcggcgtgctgctgtgggagatcgtgagcctgggcggcaccccctactgcggcatgacctgcgccgagctgtacgagaagctgccccagggctacagaatggagcagcccagaaactgcgacgacgaggtgtacgagctgatgagacagtgctggagagacagaccctacgagagaccccccttcgcccagatcgccctgcagctgggcagaatgctggaggccagaaaggcctacgtgaacatgagcctgttcgagaacttcacctacgccggcatcgacgccaccgccgaggaggcctag

SEQ ID NO: 13398 - DNA, 954 bp, Artificial Sequence
  Description of Artificial Sequence: Synthetic coding sequence
atggtgtggagagtgccccccttcctgctgcccatcctgttcctggccagccacgtgggcgccgccgtggacctgaccctgctggccaacctgagactgaccgacccccagagattcttcctgacctgcgtgagcggcgaggccggcgccggcagaggcagcgacgcctggggcccccccctgctgctggagaaggacgacagaatcgtgagaaccccccccggcccccccctgagactggccagaaacggcagccaccaggtgaccctgagaggcttcagcaagcccagcgacctggtgggcgtgttcagctgcgtgggcggcgccggcgccagaagaaccagagtgatctacgtgcacaacagccccggcgcccacctgctgcccgacaaggtgacccacaccgtgaacaagggcgacaccgccgtgctgagcgccagagtgcacaaggagaagcagaccgacgtgatctggaagagcaacggcagctacttctacaccctggactggcacgaggcccaggacggcagattcctgctgcagctgcccaacgtgcagccccccagcagcggcatctacagcgccacctacctggaggccagccccctgggcagcgccttcttcagactgatcgtgagaggctgcggcgccggcagatggggccccggctgcaccaaggagtgccccggctgcctgcacggcggcgtgtgccacgaccacgacggcgagtgcgtgtgcccccccggcttcaccggcaccagatgcgagcaggcctgcagagagggcagattcggccagagctgccaggagcagtgccccggcatcagcggctgcagaggcctgaccttctgcctgcccgacccctacggctgcagctgcggcagcggctggagaggcagccagtgccaggaggtgcaccagggccactgcggcgccagagaggaccacagctag

SEQ ID NO: 13399 - DNA, 1266 bp, Artificial Sequence
  Description of Artificial Sequence: Synthetic coding sequence
atgagagccagcatccagggcctgggcgactggagcaacaccgtggaggagagcaccctgggcaacggcctgcaggccgagggccccgtgcaggagagcagagccgccgaggagggcctggaccagcagctgatcctggccgtggtgggcagcgtgagcgccacctgcctgaccatcctggccgccctgctgaccctggtgtgcatcagaagaagctgcctgcacagaagaagaaccttcacctaccagagcggcagcggcgaggagaccatcctgcagttcagcagcggcaccctgaccctgaccagaagacccaagctgcagcccgagcccctgagctaccccgtgctggagtgggaggacatcaccttcgaggacctgatcggcgagggcaacttcggccaggtgatcagagccatgatcaagaaggacggcctgaagatgaacgccgccatcaagatgctgaaggagtacgccagcgagaacgaccacagagacttcgccggcgagctggaggtgctgtgcaagctgggccaccaccccaacatcatcaacctgctgggcgcctgcaagaacagaggctacctgtacatcgccatcgagtacgccccctacggcaacctgctggacttcctgagaaagagcagagtgctggagaccgaccccgccttcgccagagagcacggcaccgccagcaccctgagcagcagacagctgctgagattcgccagcgacgccgccaacggcatgcagtacctgagcgagaagcagttcatccacagagacctggccgccagaaacgtgctggtgggcgagaacctggccagcaagatcgccgacttcggcctgagcagaggcgaggaggtgtacgtgaagaagaccatgggcagactgcccgtgagatggatggccatcgagagcctgaactacagcgtgtacaccaccaagagcgacgtgtggagcttcggcgtgctgctgtgggagatcgtgagcctgggcggcaccccctactgcggcatgacctgcgccgagctgtacgagaagctgccccagggctacagaatggagcagcccagaaactgcgacgacgaggtgtacgagctgatgagacagtgctggagagacagaccctacgagagaccccccttcgcccagatcgccctgcagctgggcagaatgctggaggccagaaaggcctacgtgaacatgagcctgttcgagaacttcacctacgccggcatcgacgccaccgccgaggaggcctag

SEQ ID NO: 13400 - DNA, 1140 bp, Artificial Sequence
  Description of Artificial Sequence: Synthetic coding sequence
atggtgtggagagtgccccccttcctgctgcccatcctgttcctggccagccacgtgggcgccgccgtggacctgaccctgctggccaacctgagactgaccgacccccagagattcttcctgacctgcgtgagcggcgaggccggcgccggcagaggcagcgacgcctggggcccccccctgctgctggagaaggacgacagaatcgtgagaaccccccccggcccccccctgagactggccagaaacggcagccaccaggtgaccctgagaggcttcagcaagcccagcgacctggtgggcgtgttcagctgcgtgggcggcgccggcgccagaagaaccagagtgatctacgtgcacaacagccccggcgcccacctgctgcccgacaaggtgacccacaccgtgaacaagggcgacaccgccgtgctgagcgccagagtgcacaaggagaagcagaccgacgtgatctggaagagcaacggcagctacttctacaccctggactggcacgaggcccaggacggcagattcctgctgcagctgcccaacgtgcagccccccagcagcggcatctacagcgccacctacctggaggccagccccctgggcagcgccttcttcagactgatcgtgagaggctgcggcgccggcagatggggccccggctgcaccaaggagtgccccggctgcctgcacggcggcgtgtgccacgaccacgacggcgagtgcgtgtgcccccccggcttcaccggcaccagatgcgagcaggcctgcagagagggcagattcggccagagctgccaggagcagtgccccggcatcagcggctgcagaggcctgaccttctgcctgcccgacccctacggctgcagctgcggcagcggctggagaggcagccagtgccaggaggcctgcgcccccggccacttcggcgccgactgcagactgcagtgccagtgccagaacggcggcacctgcgacagattcagcggctgcgtgtgccccagcggctggcacggcgtgcactgcgagaagagcggctggagagactgggtggacaccagcaccgagaagcagaacaccgacgagggcagattcggcggccacgtgagcgcccccgtgggcgcccccggctag

SEQ ID NO: 13401 - DNA, 819 bp, Artificial Sequence
  Description of Artificial Sequence: Synthetic coding sequence
atggccctgctggtgagagtgctgagaaaccagaccagcatcagccagtgggtgcccgtgtgcagcagactgatccccgtgagccccacccagggccagggcgacagagccctgagcagaaccagccagtggccccagatgagccagagcagagcctgcggcggcagcgagcagatccccggcatcgacatccagctgaacagaaagtaccacaccaccagaaagctgagcaccaccaaggacagcccccagcccgtggaggagaaggtgggcgccttcaccaagatcatcgaggccatgggcttcaccggccccctgaagtacagatgccagatgcccgacaccttcaacagctggttcctgatcaccctgctgcacgtgtggatgtgcctggtgagaatgaagcaggagggcagaagcggcaagtacatgtgcagaatcatcgtgcacttcatgtgggaggacgtgcagcagagaggcagagtgatgggcgtgaacccctacatcctgaagaagaacatgatcctgatgaccaaccacttctacgccgccatcctgggctacgacgagggcatcctgagcgacgaccacggcctggccgccgccctgtggagaaccttcttcaacagaaagtgcgaggaccccagacacctggagctgctggtggagtacgtgagaaagcagatccagtacctggacagcatgaacggcgaggacctgctgctgaccggcgaggtgagctggagacccctggtggagaagaacccccagagcatcctgaagccccacagccccacctacaacgacgagggcctgtag

SEQ ID NO: 13402 - DNA, 564 bp, Artificial Sequence
  Description of Artificial Sequence: Synthetic coding sequence
atgcagcccatcgacacctgcgtgagctaccccagaaccggcggccagggcagcgtgagccacttccccggctgccagatgcccgacaccttcaacagctggttcctgatcaccctgctgcacgtgtggatgtgcctggtgagaatgaagcaggagggcagaagcggcaagtacatgtgcagaatcatcgtgcacttcatgtgggaggacgtgcagcagagaggcagagtgatgggcgtgaacccctacatcctgaagaagaacatgatcctgatgaccaaccacttctacgccgccatcctgggctacgacgagggcatcctgagcgacgaccacggcctggccgccgccctgtggagaaccttcttcaacagaaagtgcgaggaccccagacacctggagctgctggtggagtacgtgagaaagcagatccagtacctggacagcatgaacggcgaggacctgctgctgaccggcgaggtgagctggagacccctggtggagaagaacccccagagcatcctgaagccccacagccccacctacaacgacgagggcctgtag

SEQ ID NO: 13403 - DNA, 696 bp, Artificial Sequence
  Description of Artificial Sequence: Synthetic coding sequence
atggccctgctggtgagagtgctgagaaaccagaccagcatcagccagtgggtgcccgtgtgcagcagactgatccccgtgagccccacccagggccagggcgacagagccctgagcagaaccagccagaagatcaagatcgccgccctgagaatgtacaccagctgcgtggagaagaccgacttcgaggagttcttcctgagatgccagatgcccgacaccttcaacagctggttcctgatcaccctgctgcacgtgtggatgtgcctggtgagaatgaagcaggagggcagaagcggcaagtacatgtgcagaatcatcgtgcacttcatgtgggaggacgtgcagcagagaggcagagtgatgggcgtgaacccctacatcctgaagaagaacatgatcctgatgaccaaccacttctacgccgccatcctgggctacgacgagggcatcctgagcgacgaccacggcctggccgccgccctgtggagaaccttcttcaacagaaagtgcgaggaccccagacacctggagctgctggtggagtacgtgagaaagcagatccagtacctggacagcatgaacggcgaggacctgctgctgaccggcgaggtgagctggagacccctggtggagaagaacccccagagcatcctgaagccccacagccccacctacaacgacgagggcctgtag

SEQ ID NO: 13404 - DNA, 822 bp, Artificial Sequence
  Description of Artificial Sequence: Synthetic coding sequence
atggccctgctggtgagagtgctgagaaaccagaccagcatcagccagtgggtgcccgtgtgcagcagactgatccccgtgagccccacccagggccagggcgacagagccctgagcagaaccagccagtggccccagatgagccagagcagagcctgcggcggcagcgagcagatccccggcatcgacatccagctgaacagaaagtaccacaccaccagaaagctgagcaccaccaaggacagcccccagcccgtggaggagaaggtgggcgccttcaccaagatcatcgaggccatgggcttcaccggccccctgaagtacagcaagtggaagatcaagatcgccgccctgagaatgtacaccagctgcgtggagaagaccgacttcgaggagttcttcctgagatgccagatgcccgacaccttcaacagctggttcctgatcaccctgctgcacgtgtggatgtgcctggtgagaatgaagcaggagggcagaagcggcaagtacatgtgcagaatcatcgtgcacttcatgtgggaggacgtgcagcagagaggcagagtgatgggcggcatcctgagcgacgaccacggcctggccgccgccctgtggagaaccttcttcaacagaaagtgcgaggaccccagacacctggagctgctggtggagtacgtgagaaagcagatccagtacctggacagcatgaacggcgaggacctgctgctgaccggcgaggtgagctggagacccctggtggagaagaacccccagagcatcctgaagccccacagccccacctacaacgacgagggcctgtag

SEQ ID NO: 13405 - DNA, 900 bp, Artificial Sequence
  Description of Artificial Sequence: Synthetic coding sequence
atggccctgctggtgagagtgctgagaaaccagaccagcatcagccagtgggtgcccgtgtgcagcagactgatccccgtgagccccacccagggccagggcgacagagccctgagcagaaccagccagtggccccagatgagccagagcagagcctgcggcggcagcgagcagatccccggcatcgacatccagctgaacagaaagtaccacaccaccagaaagctgagcaccaccaaggacagcccccagcccgtggaggagaaggtgggcgccttcaccaagatcatcgaggccatgggcttcaccggccccctgaagtacagcaagtggaagatcaagatcgccgccctgagaatgtacaccagctgcgtggagaagaccgacttcgaggagttcttcctgagatgccagatgcccgacaccttcaacagctggttcctgatcaccctgctgcacgtgtggatgtgcctggtgagaatgaagcaggagggcagaagcggcaagtacatgtgcagaatcatcgtgcacttcatgtgggaggacgtgcagcagagaggcagagtgatgggcgtgaacccctacatcctgaagaagaacatgatcctgatgaccaaccacttctacgccgccatcctgggctacgacgagggcatcctgagcgacgaccacggcctggccgccgccctgtggagaaccttcttcaacagaaagtgcgaggaccccagacacctggagctgctggtggagtacgtgagaaagcagatccagtacctggacagcatgaacggcgaggacctgctgctgaccggcgaggtgagctggagacccctggtggagaagaacccccagagcatcctgaagccccacagccccacctacaacgacgagggcctgtag

SEQ ID NO: 13406 - DNA, 603 bp, Artificial Sequence
  Description of Artificial Sequence: Synthetic coding sequence
atgggcttcaccggccccctgaagtacagcaagtggaagatcaagatcgccgccctgagaatgtacaccagctgcgtggagaagaccgacttcgaggagttcttcctgagatgccagatgcccgacaccttcaacagctggttcctgatcaccctgctgcacgtgtggatgtgcctggtgagaatgaagcaggagggcagaagcggcaagtacatgtgcagaatcatcgtgcacttcatgtgggaggacgtgcagcagagaggcagagtgatgggcgtgaacccctacatcctgaagaagaacatgatcctgatgaccaaccacttctacgccgccatcctgggctacgacgagggcatcctgagcgacgaccacggcctggccgccgccctgtggagaaccttcttcaacagaaagtgcgaggaccccagacacctggagctgctggtggagtacgtgagaaagcagatccagtacctggacagcatgaacggcgaggacctgctgctgaccggcgaggtgagctggagacccctggtggagaagaacccccagagcatcctgaagccccacagccccacctacaacgacgagggcctgtag

SEQ ID NO: 13407 - DNA, 489 bp, Artificial Sequence
  Description of Artificial Sequence: Synthetic coding sequence
atggccctgctggtgagagtgctgagaaaccagaccagcatcagccagtgggtgcccgtgtgcagcagactgatccccgtgagccccacccagggccagggcgacagagccctgagcagaaccagccagtggccccagatgagccagagcagagcctgcggcggcagcgagcagatccccggcatcgacatccagctgaacagaaagtaccacaccacccccatcctgggctacgacgagggcatcctgagcgacgaccacggcctggccgccgccctgtggagaaccttcttcaacagaaagtgcgaggaccccagacacctggagctgctggtggagtacgtgagaaagcagatccagtacctggacagcatgaacggcgaggacctgctgctgaccggcgaggtgagctggagacccctggtggagaagaacccccagagcatcctgaagccccacagccccacctacaacgacgagggcctgtag

SEQ ID NO: 13408 - DNA, 435 bp, Artificial Sequence
  Description of Artificial Sequence: Synthetic coding sequence
atgtgcctggtgagaatgaagcaggagggcagaagcggcaagtacatgtgcagaatcatcgtgcacttcatgtgggaggacgtgcagcagagaggcagagtgatgggcgtgaacccctacatcctgaagaagaacatgatcctgatgaccaaccacttctacgccgccatcctgggctacgacgagggcatcctgagcgacgaccacggcctggccgccgccctgtggagaaccttcttcaacagaaagtgcgaggaccccagacacctggagctgctggtggagtacgtgagaaagcagatccagtacctggacagcatgaacggcgaggacctgctgctgaccggcgaggtgagctggagacccctggtggagaagaacccccagagcatcctgaagccccacagccccacctacaacgacgagggcctgtag

SEQ ID NO: 13409 - DNA, 447 bp, Artificial Sequence
  Description of Artificial Sequence: Synthetic coding sequence
atggccctgctggtgagagtgctgagaaaccagaccagcatcagccagtgggtgcccgtgtgcagcagactgatccccgtgagccccacccagggccagggcgacagagccctgagcagaaccagccagtggccccagatgagccagagcagagcctgcggcggcagcgagcagatccccggcatcgacatccagctgaacagaaagtaccacaccaccagaaagctgagcaccaccaaggacagcccccagcccgtggaggagaaggtgggcgccttcaccaagatcatcgaggccatgggcttcaccggccccctgaagtacagcaagtgggacgtgagcagccccaacgaggccggcagacccgagtgggaggtgcacgtgagctaccacagcagcttctacgtgggcggctgcagcgccgccagacagagccacggcggctag

SEQ ID NO: 13410 - DNA, 825 bp, Artificial Sequence
  Description of Artificial Sequence: Synthetic coding sequence
atgctgagcgtggccagcagaagcggccccttcgcccccgtgctgagcgccaccagcagaggcgtggccggcgccctgagacccctggtgcaggccaccgtgcccgccacccccgagcagcccgtgctggacctgaagagacccttcctgagcagagagagcctgagcggccaggccgtgagaagacccctggtggccagcgtgggcctgaacgtgcccgccagcgtgtgctacagccacaccgacatcaaggtgcccgacttcagcgagtacagaagactggaggtgctggacagcaccaagagcagcagagagagcagcgaggccagaaagggcttcagctacctggtgaccggcgtgaccaccgtgggcgtggcctacgccgccaagaacgccgtgacccagttcgtgagcagcatgagcgccagcgccgacgtgctggccctggccaagatcgagatcaagctgagcgacatccccgagggcaagaacatggccttcaagtggagaggcaagcccctgttcgtgagacacagaacccagaaggagatcgagcaggaggccgccgtggagctgagccagctgagagacccccagcacgacctggacagagtgaagaagcccgagtgggtgatcctgatcggcgtgtgcacccacctgggctgcgtgcccatcgccaacgccggcgacttcggcggctactactgcccctgccacggcagccactacgacgccagcggcagaatcagactgggccccgcccccctgaacctggaggtgcccacctacgagttcaccagcgacgacatggtgatcgtgggctag

SEQ ID NO: 13411 - DNA, 1221 bp, Artificial Sequence
  Description of Artificial Sequence: Synthetic coding sequence
atggccgccggcgccggcgccggcagcgcccccagatggctgagagccctgagcgagcccctgagcgccgcccagctgagaagactggaggagcacagatacagcgccgccggcgtgagcctgctggagccccccctgcagctgtactggacctggctgctgcagtggatccccctgtggatggcccccaacagcatcaccctgctgggcctggccgtgaacgtggtgaccaccctggtgctgatcagctactgccccaccgccaccgaggaggccccctactggacctacctgctgtgcgccctgggcctgttcatctaccagagcctggacgccatcgacggcaagcaggccagaagaaccaacagctgcagccccctgggcgagctgttcgaccacggctgcgacagcctgagcaccgtgttcatggccgtgggcgccagcatcgccgccagactgggcacctaccccgactggttcttcttctgcagcttcatcggcatgttcgtgttctactgcgcccactggcagacctacgtgagcggcatgctgagattcggcaaggtggacgtgaccgagatccagatcgccctggtgatcgtgttcgtgctgagcgccttcggcggcgccaccatgtgggactacaccatccccatcctggagatcaagctgaagatcctgcccgtgctgggcttcctgggcggcgtgatcttcagctgcagcaactacttccacgtgatcctgcacggcggcgtgggcaagaacggcagcaccatcgccggcaccagcgtgctgagccccggcctgcacatcggcctgatcatcatcctggccatcatgatctacaagaagagcgccaccgacgtgttcgagaagcacccctgcctgtacatcctgatgttcggctgcgtgttcgccaaggtgagccagaagctggtggtggcccacatgaccaagagcgagctgtacctgcaggacaccgtgttcctgggccccggcctgctgttcctggaccagtacttcaacaacttcatcgacgagtacgtggtgctgtggatggccatggtgatcagcagcttcgacatggtgatctacttcagcgccctgtgcctgcagatcagcagacacctgcacctgaacatcttcaagaccgcctgccaccaggcccccgagcaggtgcaggtgctgagcagcaagagccaccagaacaacatggactag

SEQ ID NO: 13412 - DNA, 2508 bp, Artificial Sequence
  Description of Artificial Sequence: Synthetic coding sequence
atggccgagctgagcgaggaggccctgctgagcgtgctgcccaccatcagagtgcccaaggccggcgacagagtgcacaaggacgagtgcgccttcagcttcgacacccccgagagcgagggcggcctgtacatctgcatgaacaccttcctgggcttcggcaagcagtacgtggagagacacttcaacaagaccggccagagagtgtacctgcacctgagaagaaccagaagacccaaggaggaggaccccgccaccggcaccggcgacccccccagaaagaagcccaccagactggccatcggcgtggagggcggcttcgacctgagcgaggagaagttcgagctggacgaggacgtgaagatcgtgatcctgcccgactacctggagatcgccagagacggcctgggcggcctgcccgacatcgtgagagacagagtgaccagcgccgtggaggccctgctgagcgccgacagcgccagcagaaagcaggaggtgcaggcctgggacggcgaggtgagacaggtgagcaagcacgccttcagcctgaagcagctggacaaccccgccagaatccccccctgcggctggaagtgcagcaagtgcgacatgagagagaacctgtggctgaacctgaccgacggcagcatcctgtgcggcagaagatacttcgacggcagcggcggcaacaaccacgccgtggagcactacagagagaccggctaccccctggccgtgaagctgggcaccatcacccccgacggcgccgacgtgtacagctacgacgaggacgacatggtgctggaccccagcctggccgagcacctgagccacttcggcatcgacatgctgaagatgcagaagaccgacaagaccatgaccgagctggagatcgacatgaaccagagaatcggcgagtgggagctgatccaggagagcggcgtgcccctgaagcccctgttcggccccggctacaccggcatcagaaacctgggcaacagctgctacctgaacagcgtggtgcaggtgctgttcagcatccccgacttccagagaaagtacgtggacaagctggagaagatcttccagaacgcccccaccgaccccacccaggacttcagcacccaggtggccaagctgggccacggcctgctgagcggcgagtacagcaagcccgtgcccgagagcggcgacggcgagagagtgcccgagcagaaggaggtgcaggacggcatcgcccccagaatgttcaaggccctgatcggcaagggccaccccgagttcagcaccaacagacagcaggacgcccaggagttcttcctgcacctgatcaacatggtggagagaaactgcagaagcagcgagaaccccaacgaggtgttcagattcctggtggaggagaagatcaagtgcctggccaccgagaaggtgaagtacacccagagagtggactacatcatgcagctgcccgtgcccatggacgccgccctgaacaaggaggagctgctggagtacgaggagaagaagagacaggccgaggaggagaagatggccctgcccgagctggtgagagcccaggtgcccttcagcagctgcctggaggcctacggcgcccccgagcaggtggacgacttctggagcaccgccctgcaggccaagagcgtggccgtgaagaccaccagattcgccagcttccccgactacctggtgatccagatcaagaagttcaccttcggcctggactgggtgcccaagaagctggacgtgagcatcgagatgcccgaggagctggacatcagccagctgagaggcaccggcctgcagcccggcgaggaggagctgcccgacatcgccccccccctggtgacccccgacgagcccaaggcccccatgctggacgagagcgtgatcatccagctggtggagatgggcttccccatggacgcctgcagaaaggccgtgtactacaccggcaacagcggcgccgaggccgccatgaactgggtgatgagccacatggacgaccccgacttcgccaaccccctgatcctgcccggcagcagcggccccggcagcaccagcgccgccgccgaccccccccccgaggactgcgtgaccaccatcgtgagcatgggcttcagcagagaccaggccctgaaggccctgagagccaccaacaacagcctggagagagccgtggactggatcttcagccacatcgacgacctggacgccgaggccgccatggacatcagcgagggcagaagcgccgccgacagcatcagcgagagcgtgcccgtgggccccaaggtgagagacggccccggcaagtaccagctgttcgccttcatcagccacatgggcaccagcaccatgtgcggccactacgtgtgccacatcaagaaggagggcagatgggtgatctacaacgaccagaaggtgtgcgccagcgagaagccccccaaggacctgggctacatctacttctaccagagagtggccagctag

SEQ ID NO: 13413 - DNA, 2385 bp, Artificial Sequence
  Description of Artificial Sequence: Synthetic coding sequence
atggccgacgcctgggaggagatcagaagactggccgccgacttccagagagcccagttcgccgaggccacccagagactgagcgagagaaactgcatcgagatcgtgaacaagctgatcgcccagaagcagctggaggtggtgcacaccctggacggcaaggagtacatcacccccgcccagatcagcaaggagatgagagacgagctgcacgtgagaggcggcagagtgaacatcgtggacctgcagcaggtgatcaacgtggacctgatccacatcgagaacagaatcggcgacatcatcaagagcgagaagcacgtgcagctggtgctgggccagctgatcgacgagaactacctggacagactggccgaggaggtgaacgacaagctgcaggagagcggccaggtgaccatcagcgagctgtgcaagacctacgacctgcccggcaacttcctgacccaggccctgacccagagactgggcagaatcatcagcggccacatcgacctggacaacagaggcgtgatcttcaccgaggccttcgtggccagacacaaggccagaatcagaggcctgttcagcgccatcaccagacccaccgccgtgaacagcctgatcagcaagtacggcttccaggagcagctgctgtacagcgtgctggaggagctggtgaacagcggcagactgagaggcaccgtggtgggcggcagacaggacaaggccgtgttcgtgcccgacatctacagcagaacccagagcacctgggtggacagcttcttcagacagaacggctacctggagttcgacgccctgagcagactgggcatccccgacgccgtgagctacatcaagaagagatacaagaccacccagctgctgttcctgaaggccgcctgcgtgggccagggcctggtggaccaggtggaggccagcgtggaggaggccatcagcagcggcacctgggtggacatcgcccccctgctgcccaccagcctgagcgtggaggacgccgccatcctgctgcagcaggtgatgagagccttcagcaagcaggccagcaccgtggtgttcagcgacaccgtggtggtgagcgagaagttcatcaacgactgcaccgagctgttcagagagctgatgcaccagaaggccgagaaggagatgaagaacaaccccgtgcacctgatcaccgaggaggacctgaagcagatcagcaccctggagagcgtgagcaccagcaagaaggacaagaaggacgagagaagaagaaaggccaccgagggcagcggcagcatgagaggcggcggcggcggcaacgccagagagtacaagatcaagaaggtgaagaagaagggcagaaaggacgacgacagcgacgacgagagccagagcagccacaccggcaagaagaagcccgagatcagcttcatgttccaggacgagatcgaggacttcctgagaaagcacatccaggacgcccccgaggagttcatcagcgagctggccgagtacctgatcaagcccctgaacaagacctacctggaggtggtgagaagcgtgttcatgagcagcaccaccagcgccagcggcaccggcagaaagagaaccatcaaggacctgcaggaggaggtgagcaacctgtacaacaacatcagactgttcgagaagggcatgaagttcttcgccgacgacacccaggccgccctgaccaagcacctgctgaagagcgtgtgcaccgacatcaccaacctgatcttcaacttcctggccagcgacctgatgatggccgtggacgaccccgccgccatcaccagcgagatcagaaagaagatcctgagcaagctgagcgaggagaccaaggtggccctgaccaagctgcacaacagcctgaacgagaagagcatcgaggacttcatcagctgcctggacagcgccgccgaggcctgcgacatcatggtgaagagaggcgacaagaagagagagagacagatcctgttccagcacagacaggccctggccgagcagctgaaggtgaccgaggaccccgccctgatcctgcacctgaccagcgtgctgctgttccagttcagcacccacagcatgctgcacgcccccggcagatgcgtgccccagatcatcgccttcctgaacagcaagatccccgaggaccagcacgccctgctggtgaagtaccagggcctggtggtgaagcagctggtgagccagagcaagaagaccggccagggcgactaccccctgaacaacgagctggacaaggagcaggaggacgtggccagcaccaccagaaaggagctgcaggagctgagcagcagcatcaaggacctggtgctgaagagcagaaagagcagcgtgaccgaggagtag

SEQ ID NO: 13414 - DNA, 942 bp, Artificial Sequence
  Description of Artificial Sequence: Synthetic coding sequence
atgatcggccagaagaccctgtacagcttcttcagccccagccccgccagaaagagacacgcccccagccccgagcccgccgtgcagggcaccggcgtggccggcgtgcccgaggagagcggcgacgccgccgccatccccgccaagaaggcccccgccggccaggaggagcccggcaccccccccagcagccccctgagcgccgagcagctggacagaatccagagaaacaaggccgccgccctgctgagactggccgccagaaacgtgcccgtgggcttcggcgagagctggaagaagcacctgagcggcgagttcggcaagccctacttcatcaagctgatgggcttcgtggccgaggagagaaagcactacaccgtgtacccccccccccaccaggtgttcacctggacccagatgtgcgacatcaaggacgtgaaggtggtgatcctgggccaggacccctaccacggccccaaccaggcccacggcctgtgcttcagcgtgcagagacccgtgccccccccccccagcctggagaacatctacaaggagctgagcaccgacatcgaggacttcgtgcaccccggccacggcgacctgagcggctgggccaagcagggcgtgctgctgctgaacgccgtgctgaccgtgagagcccaccaggccaacagccacaaggagagaggctgggagcagttcaccgacgccgtggtgagctggctgaaccagaacagcaacggcctggtgttcctgctgtggggcagctacgcccagaagaagggcagcgccatcgacagaaagagacaccacgtgctgcagaccgcccaccccagccccctgagcgtgtacagaggcttcttcggctgcagacacttcagcaagaccaacgagctgctgcagaagagcggcaagaagcccatcgactggaaggagctgtag

SEQ ID NO: 13415 - DNA, 915 bp, Artificial Sequence
  Description of Artificial Sequence: Synthetic coding sequence
atgggcgtgttctgcctgggcccctggggcctgggcagaaagctgagaacccccggcaagggccccctgcagctgctgagcagactgtgcggcgaccacctgcaggccatccccgccaagaaggcccccgccggccaggaggagcccggcaccccccccagcagccccctgagcgccgagcagctggacagaatccagagaaacaaggccgccgccctgctgagactggccgccagaaacgtgcccgtgggcttcggcgagagctggaagaagcacctgagcggcgagttcggcaagccctacttcatcaagctgatgggcttcgtggccgaggagagaaagcactacaccgtgtacccccccccccaccaggtgttcacctggacccagatgtgcgacatcaaggacgtgaaggtggtgatcctgggccaggacccctaccacggccccaaccaggcccacggcctgtgcttcagcgtgcagagacccgtgccccccccccccagcctggagaacatctacaaggagctgagcaccgacatcgaggacttcgtgcaccccggccacggcgacctgagcggctgggccaagcagggcgtgctgctgctgaacgccgtgctgaccgtgagagcccaccaggccaacagccacaaggagagaggctgggagcagttcaccgacgccgtggtgagctggctgaaccagaacagcaacggcctggtgttcctgctgtggggcagctacgcccagaagaagggcagcgccatcgacagaaagagacaccacgtgctgcagaccgcccaccccagccccctgagcgtgtacagaggcttcttcggctgcagacacttcagcaagaccaacgagctgctgcagaagagcggcaagaagcccatcgactggaaggagctgtag

SEQ ID NO: 13416 - DNA, 813 bp, Artificial Sequence
  Description of Artificial Sequence: Synthetic coding sequence
atgggcgtgttctgcctgggcccctggggcctgggcagaaagctgagaacccccggcaagggccccctgagcgccgagcagctggacagaatccagagaaacaaggccgccgccctgctgagactggccgccagaaacgtgcccgtgggcttcggcgagagctggaagaagcacctgagcggcgagttcggcaagccctacttcatcaagctgatgggcttcgtggccgaggagagaaagcactacaccgtgtacccccccccccaccaggtgttcacctggacccagatgtgcgacatcaaggacgtgaaggtggtgatcctgggccaggacccctaccacggccccaaccaggcccacggcctgtgcttcagcgtgcagagacccgtgccccccccccccagcctggagaacatctacaaggagctgagcaccgacatcgaggacttcgtgcaccccggccacggcgacctgagcggctgggccaagcagggcgtgctgctgctgaacgccgtgctgaccgtgagagcccaccaggccaacagccacaaggagagaggctgggagcagttcaccgacgccgtggtgagctggctgaaccagaacagcaacggcctggtgttcctgctgtggggcagctacgcccagaagaagggcagcgccatcgacagaaagagacaccacgtgctgcagaccgcccaccccagccccctgagcgtgtacagaggcttcttcggctgcagacacttcagcaagaccaacgagctgctgcagaagagcggcaagaagcccatcgactggaaggagctgtag

SEQ ID NO: 13417 - DNA, 9288 bp, Artificial Sequence
  Description of Artificial Sequence: Synthetic coding sequence
atggtgttcgagagcgtggtggtggacgtgctgaacagattcctgggcgactacgtggtggacctggacaccagccagctgagcctgggcatctggaagggcgccgtggccctgaagaacctgcagatcaaggagaacgccctgagccagctggacgtgcccttcaaggtgaaggtgggccacatcggcaacctgaagctgatcatcccctggaagaacctgtacacccagcccgtggaggccgtgctggaggagatctacctgctgatcgtgcccagcagcagaatcaagtacgaccccctgaaggaggagaagcagctgatggaggccaagcagcaggagctgaagagaatcgaggaggccaagcagaaggtggtggaccaggagcagcacctgcccgagaagcaggacaccttcgccgagaagctggtgacccagatcatcaagaacctgcaggtgaagatcagcagcatccacatcagatacgaggacgacatcaccaacagagacaagcccctgagcttcggcatcagcctgcagaacctgagcatgcagaccaccgaccagtactgggtgccctgcctgcacgacgagaccgagaagctggtgagaaagctgatcagactggacaacctgttcgcctactggaacgtgaagagccagatgttctacctgagcgactacgacaacagcctggacgacctgaagaacggcatcgtgaacgagaacatcgtgcccgagggctacgacttcgtgttcagacccatcagcgccaacgccaagctggtgatgaacagaagaagcgacttcgacttcagcgcccccaagatcaacctggagatcgagctgcacaacatcgccatcgagttcaacaagccccagtacttcagcatcatggagctgctggagagcgtggacatgatggcccagaacctgccctacagaaagttcaagcccgacgtgcccctgcaccaccacgccagagagtggtgggcctacgccatccacggcgtgctggaggtgaacgtgtgccccagactgtggatgtggagctggaagcacatcagaaagcacagacagaaggtgaagcagtacaaggagctgtacaagaagaagctgaccagcaagaagccccccggcgagctgctggtgagcctggaggagctggagaagaccctggacgtgttcaacatcaccatcgccagacagaccgccgaggtggaggtgaagaaggccggctacaagatctacaaggagggcgtgaaggaccccgaggacaacaagggctggttcagctggctgtggagctggagcgagcagaacaccaacgagcagcagcccgacgtgcagcccgagaccctggaggagatgctgacccccgaggagaaggccctgctgtacgaggccatcggctacagcgagaccgccgtggaccccaccctgctgaagaccttcgaggccctgaagttcttcgtgcacctgaagagcatgagcatcgtgctgagagagaaccaccagaagcccgagctggtggacatcgtgatcgaggagttcagcaccctgatcgtgcagagacccggcgcccaggccatcaagttcgagaccaagatcgacagcttccacatcaccggcctgcccgacaacagcgagaagcccagactgctgagcagcctggacgacgccatgagcctgttccagatcaccttcgagatcaaccccctggacgagaccgtgagccagagatgcatcatcgaggccgagcccctggagatcatctacgacgccagaaccgtgaacagcatcgtggagttcttcagaccccccaaggaggtgcacctggcccagctgaccgccgccaccctgaccaagctggaggagttcagaagcaagaccgccaccggcctgctgtacatcatcgagacccagaaggtgctggacctgaagatcaacctgaaggccagctacatcatcgtgccccaggacggcatcttcagccccaccagcaacctgctgctgctggacctgggccacctgaaggtgaccagcaagagcagaagcgagctgcccgacgtgaagcagggcgaggccaacctgaaggagatcatggacagagcctacgacagcttcgacatccagctgaccagcgtgcagctgctgtacagcagagtgggcgacaactggagagaggccagaaagctgagcgtgagcacccagcacatcctggtgcccatgcacttcaacctggagctgagcaaggccatggtgttcatggacgtgagaatgcccaagttcaagatctacggcaagctgcccctgatcagcctgagaatcagcgacaagaagctgcagggcatcatggagctgatcgagagcatccccaagcccgagcccgtgaccgaggtgagcgcccccgtgaagagcttccagatccagaccagcaccagcctgggcaccagccagatcagccagaagatcatccccctgctggagctgcccagcgtgagcgaggacgacagcgaggaggagttcttcgacgccccctgcagccccctggaggagcccctgcagttccccaccggcgtgaagagcatcagaaccagaaagctgcagaagcaggactgcagcgtgaacatgaccaccttcaagatcagattcgaggtgcccaaggtgctgatcgagttctaccacctggtgggcgactgcgagctgagcgtggtggagatcctggtgctgggcctgggcgccgagatcgagatcagaacctacgacctgaaggccaacgccttcctgaaggagttctgcctgaagtgccccgagtacctggacgagaacaagaagcccgtgtacctggtgaccaccctggacaacaccatggaggacctgctgaccctggagtacgtgaaggccgagaagaacgtgcccgacctgaagagcacctacaacaacgtgctgcagctgatcaaggtgaacttcagcagcctggacatccacctgcacaccgaggccctgctgaacaccatcaactacctgcacaacatcctgccccagagcgaggagaagagcgcccccgtgagcaccaccgagaccgaggacaagggcgacgtgatcaagaagctggccctgaagctgagcaccaacgaggacatcatcaccctgcagatcctggccgagctgagctgcctgcagatcttcatccaggaccagaagtgcaacatcagcgagatcaagatcgagggcctggacagcgagatgatcatgagacccagcgagaccgagatcaacgccaagctgagaaacatcatcgtgctggacagcgacatcaccgccatctacaagaaggccgtgtacatcaccggcaaggaggtgttcagcttcaagatggtgagctacatggacgccaccgccggcagcgcctacaccgacatgaacgtggtggacatccaggtgaacctgatcgtgggctgcatcgaggtggtgttcgtgaccaagttcctgtacagcatcctggccttcatcgacaacttccaggccgccaagcaggccctggccgaggccaccgtgcaggccgccggcatggccgccaccggcgtgaaggagctggcccagagaagcagcagaatggccctggacatcaacatcaaggcccccgtggtggtgatcccccagagccccgtgagcgagaacgtgttcgtggccgacttcggcctgatcaccatgaccaacaccttccacatgatcaccgagagccagagcagccccccccccgtgatcgacctgatcaccatcaagctgagcgagatgagactgtacagaagcagattcatcaacgacgcctaccaggaggtgctggacctgctgctgcccctgaacctggaggtggtggtggagagaaacctgtgctgggagtggtaccaggaggtgccctgcttcaacgtgaacgcccagctgaagcccatggagttcatcctgagccaggaggacatcaccaccatcttcaagaccctgcacggcaacatctggtacgagaaggacggcagcgccagccccgccgtgaccaaggaccagtacagcgccaccagcggcgtgaccaccaacgccagccaccacagcggcggcgccaccgtggtgaccgccgccgtggtggaggtgcacagcagagccctgctggtgaagaccaccctgaacatcagcttcaagaccgacgacctgaccatggtgctgtacagccccggccccaagcaggccagcttcaccgacgtgagagaccccagcctgaagctggccgagttcaagctggagaacatcatcagcaccctgaagatgtacaccgacggcagcaccttcagcagcttcagcctgaagaactgcatcctggacgacaagagaccccacgtgaagaaggccacccccagaatgatcggcctgaccgtgggcttcgacaagaaggacatgatggacatcaagtacagaaaggtgagagacggctgcgtgaccgacgccgtgttccaggagatgtacatctgcgccagcgtggagttcctgcagaccgtggccaacgtgttcctggaggcctacaccaccggcaccgccgtggagaccagcgtgcagacctggaccgccaaggaggaggtgcccacccaggagagcgtgaagtgggagatcaacgtgatcatcaagaaccccgagatcgtgttcgtggccgacatgaccaagaacgacgcccccgccctggtgatcaccacccagtgcgagatctgctacaagggcaacctggagaacagcaccatgaccgccgccatcaaggacctgcaggtgagagcctgccccttcctgcccgtgaagagaaagggcaagatcaccaccgtgctgcagccctgcgacctgttctaccagaccacccagaagggcaccgacccccaggtgatcgacatgagcgtgaagagcctgaccctgaaggtgagccccgtgatcatcaacaccatgatcaccatcaccagcgccctgtacaccaccaaggagaccatccccgaggagaccgccagcagcaccgcccacctgtgggagaagaaggacaccaagaccctgaagatgtggttcctggaggagagcaacgagaccgagaagatcgcccccaccaccgagctggtgcccaagggcgagatgatcaagatgaacatcgacagcatcttcatcgtgctggaggccggcatcggccacagaaccgtgcccatgctgctggccaagagcagattcagcggcgagggcaagaactggagcagcctgatcaacctgcactgccagctggagctggaggtgcactactacaacgagatgttcggcgtgtgggagcccctgctggagcccctggagatcgaccagaccgaggacttcagaccctggaacctgggcatcaagatgaagaagaaggccaagatggccatcgtggagagcgaccccgaggaggagaactacaaggtgcccgagtacaagaccgtgatcagcttccacagcaaggaccagctgaacatcaccctgagcaagtgcggcctggtgatgctgaacaacctggtgaaggccttcaccgaggccgccaccggcagcagcgccgacttcgtgaaggacctggcccccttcatgatcctgaacagcctgggcctgaccatcagcgtgagccccagcgacagcttcagcgtgctgaacatccccatggccaagagctacgtgctgaagaacggcgagagcctgagcatggactacatcagaaccaaggacaacgaccacttcaacgccatgaccagcctgagcagcaagctgttcttcatcctgctgacccccgtgaaccacagcaccgccgacaagatccccctgaccaaggtgggcagaagactgtacaccgtgagacacagagagagcggcgtggagagaagcatcgtgtgccagatcgacaccgtggagggcagcaagaaggtgaccatcagaagccccgtgcagatcagaaaccacttcagcgtgcccctgagcgtgtacgagggcgacaccctgctgggcaccgccagccccgagaacgagttcaacatccccctgggcagctacagaagcttcatcttcctgaagcccgaggacgagaactaccagatgtgcgagggcatcgacttcgaggagatcatcaagaacgacggcgccctgctgaagaagaagtgcagaagcaagaaccccagcaaggagagcttcctgatcaacatcgtgcccgagaaggacaacctgaccagcctgagcgtgtacagcgaggacggctgggacctgccctacatcatgcacctgtggccccccatcctgctgagaaacctgctgccctacaagatcgcctactacatcgagggcatcgagaacagcgtgttcaccctgagcgagggccacagcgcccagatctgcaccgcccagctgggcaaggccagactgcacctgaagctgctggactacctgaaccacgactggaagagcgagtaccacatcaagcccaaccagcaggacatcagcttcgtgagcttcacctgcgtgaccgagatggagaagaccgacctggacatcgccgtgcacatgacctacaacaccggccagaccgtggtggccttccacagcccctactggatggtgaacaagaccggcagaatgctgcagtacaaggccgacggcatccacagaaagcacccccccaactacaagaagcccgtgctgttcagcttccagcccaaccacttcttcaacaacaacaaggtgcagctgatggtgaccgacagcgagctgagcaaccagttcagcatcgacaccgtgggcagccacggcgccgtgaagtgcaagggcctgaagatggactaccaggtgggcgtgaccatcgacctgagcagcttcaacatcaccagaatcgtgaccttcacccccttctacatgatcaagaacaagagcaagtaccacatcagcgtggccgaggagggcaacgacaagtggctgagcctggacctggagcagtgcatccccttctggcccgagtacgccagcagcaagctgctgatccaggtggagagaagcgaggacccccccaagagaatctacttcaacaagcaggagaactgcatcctgctgagactggacaacgagctgggcggcatcatcgccgaggtgaacctggccgagcacagcaccgtgatcaccttcctggactaccacgacggcgccgccaccttcctgctgatcaaccacaccaagaacgagctggtgcagtacaaccagagcagcctgagcgagatcgaggacagcctgccccccggcaaggccgtgttctacacctgggccgaccccgtgggcagcagaagactgaagtggagatgcagaaagagccacggcgaggtgacccagaaggacgacatgatgatgcccatcgacctgggcgagaagaccatctacctggtgagcttcttcgagggcctgcagagaatcatcctgttcaccgaggaccccagagtgttcaaggtgacctacgagagcgagaaggccgagctggccgagcaggagatcgccgtggccctgcaggacgtgggcatcagcctggtgaacaactacaccaagcaggaggtggcctacatcggcatcaccagcagcgacgtggtgtgggagaccaagcccaagaagaaggccagatggaagcccatgagcgtgaagcacaccgagaagctggagagagagttcaaggagtacaccgagagcagccccagcgaggacaaggtgatccagctggacaccaacgtgcccgtgagactgacccccaccggccacaacatgaagatcctgcagccccacgtgatcgccctgagaagaaactacctgcccgccctgaaggtggagtacaacaccagcgcccaccagagcagcttcagaatccagatctacagaatccagatccagaaccagatccacggcgccgtgttccccttcgtgttctaccccgtgaagccccccaagagcgtgaccatggacagcgcccccaagcccttcaccgacgtgagcatcgtgatgagaagcgccggccacagccagatcagcagaatcaagtacttcaaggtgctgatccaggagatggacctgagactggacctgggcttcatctacgccctgaccgacctgatgaccgaggccgaggtgaccgagaacaccgaggtggagctgttccacaaggacatcgaggccttcaaggaggagtacaagaccgccagcctggtggaccagagccaggtgagcctgtacgagtacttccacatcagccccatcaagctgcacctgagcgtgagcctgagcagcggcagagaggaggccaaggacagcaagcagaacggcggcctgatccccgtgcacagcctgaacctgctgctgaagagcatcggcgccaccctgaccgacgtgcaggacgtggtgttcaagctggccttcttcgagctgaactaccagttccacaccaccagcgacctgcagagcgaggtgatcagacactacagcaagcaggccatcaagcagatgtacgtgctgatcctgggcctggacgtgctgggcaaccccttcggcctgatcagagagttcagcgagggcgtggaggccttcttctacgagccctaccagggcgccatccagggccccgaggagttcgtggagggcatggccctgggcctgaaggccctggtgggcggcgccgtgggcggcctggccggcgccgccagcaagatcaccggcgccatggccaagggcgtggccgccatgaccatggacgaggactaccagcagaagagaagagaggccatgaacaagcagcccgccggcttcagagagggcatcaccagaggcggcaagggcctggtgagcggcttcgtgagcggcatcaccggcatcgtgaccaagcccatcaagggcgcccagaagggcggcgccgccggcttcttcaagggcgtgggcaagggcctggtgggcgccgtggccagacccaccggcggcatcatcgacatggccagcagcaccttccagggcatcaagagagccaccgagaccagcgaggtggagagcctgagaccccccagattcttcaacgaggacggcgtgatcagaccctacagactgagagacggcaccggcaaccagatgctgcagaagatccagttctacagagagtggatcatgacccacagcagcagcagcgacgacgacgacgacgacgacgacgacgacgagagcgacctgaaccactag

SEQ ID NO: 13418 - DNA, 9525 bp, Artificial Sequence
  Description of Artificial Sequence: Synthetic coding sequence
atggtgttcgagagcgtggtggtggacgtgctgaacagattcctgggcgactacgtggtggacctggacaccagccagctgagcctgggcatctggaagggcgccgtggccctgaagaacctgcagatcaaggagaacgccctgagccagctggacgtgcccttcaaggtgaaggtgggccacatcggcaacctgaagctgatcatcccctggaagaacctgtacacccagcccgtggaggccgtgctggaggagatctacctgctgatcgtgcccagcagcagaatcaagtacgaccccctgaaggaggagaagcagctgatggaggccaagcagcaggagctgaagagaatcgaggaggccaagcagaaggtggtggaccaggagcagcacctgcccgagaagcaggacaccttcgccgagaagctggtgacccagatcatcaagaacctgcaggtgaagatcagcagcatccacatcagatacgaggacgacatcaccaacagagacaagcccctgagcttcggcatcagcctgcagaacctgagcatgcagaccaccgaccagtactgggtgccctgcctgcacgacgagaccgagaagctggtgagaaagctgatcagactggacaacctgttcgcctactggaacgtgaagagccagatgttctacctgagcgactacgacaacagcctggacgacctgaagaacggcatcgtgaacgagaacatcgtgcccgagggctacgacttcgtgttcagacccatcagcgccaacgccaagctggtgatgaacagaagaagcgacttcgacttcagcgcccccaagatcaacctggagatcgagctgcacaacatcgccatcgagttcaacaagccccagtacttcagcatcatggagctgctggagagcgtggacatgatggcccagaacctgccctacagaaagttcaagcccgacgtgcccctgcaccaccacgccagagagtggtgggcctacgccatccacggcgtgctggaggtgaacgtgtgccccagactgtggatgtggagctggaagcacatcagaaagcacagacagaaggtgaagcagtacaaggagctgtacaagaagaagctgaccagcaagaagccccccggcgagctgctggtgagcctggaggagctggagaagaccctggacgtgttcaacatcaccatcgccagacagaccgccgaggtggaggtgaagaaggccggctacaagatctacaaggagggcgtgaaggaccccgaggacaacaagggctggttcagctggctgtggagctggagcgagcagaacaccaacgagcagcagcccgacgtgcagcccgagaccctggaggagatgctgacccccgaggagaaggccctgctgtacgaggccatcggctacagcgagaccgccgtggaccccaccctgctgaagaccttcgaggccctgaagttcttcgtgcacctgaagagcatgagcatcgtgctgagagagaaccaccagaagcccgagctggtggacatcgtgatcgaggagttcagcaccctgatcgtgcagagacccggcgcccaggccatcaagttcgagaccaagatcgacagcttccacatcaccggcctgcccgacaacagcgagaagcccagactgctgagcagcctggacgacgccatgagcctgttccagatcaccttcgagatcaaccccctggacgagaccgtgagccagagatgcatcatcgaggccgagcccctggagatcatctacgacgccagaaccgtgaacagcatcgtggagttcttcagaccccccaaggaggtgcacctggcccagctgaccgccgccaccctgaccaagctggaggagttcagaagcaagaccgccaccggcctgctgtacatcatcgagacccagaaggtgctggacctgaagatcaacctgaaggccagctacatcatcgtgccccaggacggcatcttcagccccaccagcaacctgctgctgctggacctgggccacctgaaggtgaccagcaagagcagaagcgagctgcccgacgtgaagcagggcgaggccaacctgaaggagatcatggacagagcctacgacagcttcgacatccagctgaccagcgtgcagctgctgtacagcagagtgggcgacaactggagagaggccagaaagctgagcgtgagcacccagcacatcctggtgcccatgcacttcaacctggagctgagcaaggccatggtgttcatggacgtgagaatgcccaagttcaagatctacggcaagctgcccctgatcagcctgagaatcagcgacaagaagctgcagggcatcatggagctgatcgagagcatccccaagcccgagcccgtgaccgaggtgagcgcccccgtgaagagcttccagatccagaccagcaccagcctgggcaccagccagatcagccagaagatcatccccctgctggagctgcccagcgtgagcgaggacgacagcgaggaggagttcttcgacgccccctgcagccccctggaggagcccctgcagttccccaccggcgtgaagagcatcagaaccagaaagctgcagaagcaggactgcagcgtgaacatgaccaccttcaagatcagattcgaggtgcccaaggtgctgatcgagttctaccacctggtgggcgactgcgagctgagcgtggtggagatcctggtgctgggcctgggcgccgagatcgagatcagaacctacgacctgaaggccaacgccttcctgaaggagttctgcctgaagtgccccgagtacctggacgagaacaagaagcccgtgtacctggtgaccaccctggacaacaccatggaggacctgctgaccctggagtacgtgaaggccgagaagaacgtgcccgacctgaagagcacctacaacaacgtgctgcagctgatcaaggtgaacttcagcagcctggacatccacctgcacaccgaggccctgctgaacaccatcaactacctgcacaacatcctgccccagagcgaggagaagagcgcccccgtgagcaccaccgagaccgaggacaagggcgacgtgatcaagaagctggccctgaagctgagcaccaacgaggacatcatcaccctgcagatcctggccgagctgagctgcctgcagatcttcatccaggaccagaagtgcaacatcagcgagatcaagatcgagggcctggacagcgagatgatcatgagacccagcgagaccgagatcaacgccaagctgagaaacatcatcgtgctggacagcgacatcaccgccatctacaagaaggccgtgtacatcaccggcaaggaggtgttcagcttcaagatggtgagctacatggacgccaccgccggcagcgcctacaccgacatgaacgtggtggacatccaggtgaacctgatcgtgggctgcatcgaggtggtgttcgtgaccaagttcctgtacagcatcctggccttcatcgacaacttccaggccgccaagcaggccctggccgaggccaccgtgcaggccgccggcatggccgccaccggcgtgaaggagctggcccagagaagcagcagaatggccctggacatcaacatcaaggcccccgtggtggtgatcccccagagccccgtgagcgagaacgtgttcgtggccgacttcggcctgatcaccatgaccaacaccttccacatgatcaccgagagccagagcagccccccccccgtgatcgacctgatcaccatcaagctgagcgagatgagactgtacagaagcagattcatcaacgacgcctaccaggaggtgctggacctgctgctgcccctgaacctggaggtggtggtggagagaaacctgtgctgggagtggtaccaggaggtgccctgcttcaacgtgaacgcccagctgaagcccatggagttcatcctgagccaggaggacatcaccaccatcttcaagaccctgcacggcaacatctggtacgagaaggacggcagcgccagccccgccgtgaccaaggaccagtacagcgccaccagcggcgtgaccaccaacgccagccaccacagcggcggcgccaccgtggtgaccgccgccgtggtggaggtgcacagcagagccctgctggtgaagaccaccctgaacatcagcttcaagaccgacgacctgaccatggtgctgtacagccccggccccaagcaggccagcttcaccgacgtgagagaccccagcctgaagctggccgagttcaagctggagaacatcatcagcaccctgaagatgtacaccgacggcagcaccttcagcagcttcagcctgaagaactgcatcctggacgacaagagaccccacgtgaagaaggccacccccagaatgatcggcctgaccgtgggcttcgacaagaaggacatgatggacatcaagtacagaaaggtgagagacggctgcgtgaccgacgccgtgttccaggagatgtacatctgcgccagcgtggagttcctgcagaccgtggccaacgtgttcctggaggcctacaccaccggcaccgccgtggagaccagcgtgcagacctggaccgccaaggaggaggtgcccacccaggagagcgtgaagtgggagatcaacgtgatcatcaagaaccccgagatcgtgttcgtggccgacatgaccaagaacgacgcccccgccctggtgatcaccacccagtgcgagatctgctacaagggcaacctggagaacagcaccatgaccgccgccatcaaggacctgcaggtgagagcctgccccttcctgcccgtgaagagaaagggcaagatcaccaccgtgctgcagccctgcgacctgttctaccagaccacccagaagggcaccgacccccaggtgatcgacatgagcgtgaagagcctgaccctgaaggtgagccccgtgatcatcaacaccatgatcaccatcaccagcgccctgtacaccaccaaggagaccatccccgaggagaccgccagcagcaccgcccacctgtgggagaagaaggacaccaagaccctgaagatgtggttcctggaggagagcaacgagaccgagaagatcgcccccaccaccgagctggtgcccaagggcgagatgatcaagatgaacatcgacagcatcttcatcgtgctggaggccggcatcggccacagaaccgtgcccatgctgctggccaagagcagattcagcggcgagggcaagaactggagcagcctgatcaacctgcactgccagctggagctggaggtgcactactacaacgagatgttcggcgtgtgggagcccctgctggagcccctggagatcgaccagaccgaggacttcagaccctggaacctgggcatcaagatgaagaagaaggccaagatggccatcgtggagagcgaccccgaggaggagaactacaaggtgcccgagtacaagaccgtgatcagcttccacagcaaggaccagctgaacatcaccctgagcaagtgcggcctggtgatgctgaacaacctggtgaaggccttcaccgaggccgccaccggcagcagcgccgacttcgtgaaggacctggcccccttcatgatcctgaacagcctgggcctgaccatcagcgtgagccccagcgacagcttcagcgtgctgaacatccccatggccaagagctacgtgctgaagaacggcgagagcctgagcatggactacatcagaaccaaggacaacgaccacttcaacgccatgaccagcctgagcagcaagctgttcttcatcctgctgacccccgtgaaccacagcaccgccgacaagatccccctgaccaaggtgggcagaagactgtacaccgtgagacacagagagagcggcgtggagagaagcatcgtgtgccagatcgacaccgtggagggcagcaagaaggtgaccatcagaagccccgtgcagatcagaaaccacttcagcgtgcccctgagcgtgtacgagggcgacaccctgctgggcaccgccagccccgagaacgagttcaacatccccctgggcagctacagaagcttcatcttcctgaagcccgaggacgagaactaccagatgtgcgagggcatcgacttcgaggagatcatcaagaacgacggcgccctgctgaagaagaagtgcagaagcaagaaccccagcaaggagagcttcctgatcaacatcgtgcccgagaaggacaacctgaccagcctgagcgtgtacagcgaggacggctgggacctgccctacatcatgcacctgtggccccccatcctgctgagaaacctgctgccctacaagatcgcctactacatcgagggcatcgagaacagcgtgttcaccctgagcgagggccacagcgcccagatctgcaccgcccagctgggcaaggccagactgcacctgaagctgctggactacctgaaccacgactggaagagcgagtaccacatcaagcccaaccagcaggacatcagcttcgtgagcttcacctgcgtgaccgagatggagaagaccgacctggacatcgccgtgcacatgacctacaacaccggccagaccgtggtggccttccacagcccctactggatggtgaacaagaccggcagaatgctgcagtacaaggccgacggcatccacagaaagcacccccccaactacaagaagcccgtgctgttcagcttccagcccaaccacttcttcaacaacaacaaggtgcagctgatggtgaccgacagcgagctgagcaaccagttcagcatcgacaccgtgggcagccacggcgccgtgaagtgcaagggcctgaagatggactaccaggtgggcgtgaccatcgacctgagcagcttcaacatcaccagaatcgtgaccttcacccccttctacatgatcaagaacaagagcaagtaccacatcagcgtggccgaggagggcaacgacaagtggctgagcctggacctggagcagtgcatccccttctggcccgagtacgccagcagcaagctgctgatccaggtggagagaagcgaggacccccccaagagaatctacttcaacaagcaggagaactgcatcctgctgagactggacaacgagctgggcggcatcatcgccgaggtgaacctggccgagcacagcaccgtgatcaccttcctggactaccacgacggcgccgccaccttcctgctgatcaaccacaccaagaacgagctggtgcagtacaaccagagcagcctgagcgagatcgaggacagcctgccccccggcaaggccgtgttctacacctgggccgaccccgtgggcagcagaagactgaagtggagatgcagaaagagccacggcgaggtgacccagaaggacgacatgatgatgcccatcgacctgggcgagaagaccatctacctggtgagcttcttcgagggcctgcagagaatcatcctgttcaccgaggaccccagagtgttcaaggtgacctacgagagcgagaaggccgagctggccgagcaggagatcgccgtggccctgcaggacgtgggcatcagcctggtgaacaactacaccaagcaggaggtggcctacatcggcatcaccagcagcgacgtggtgtgggagaccaagcccaagaagaaggccagatggaagcccatgagcgtgaagcacaccgagaagctggagagagagttcaaggagtacaccgagagcagccccagcgaggacaaggtgatccagctggacaccaacgtgcccgtgagactgacccccaccggccacaacatgaagatcctgcagccccacgtgatcgccctgagaagaaactacctgcccgccctgaaggtggagtacaacaccagcgcccaccagagcagcttcagaatccagatctacagaatccagatccagaaccagatccacggcgccgtgttccccttcgtgttctaccccgtgaagccccccaagagcgtgaccatggacagcgcccccaagcccttcaccgacgtgagcatcgtgatgagaagcgccggccacagccagatcagcagaatcaagtacttcaaggtgctgatccaggagatggacctgagactggacctgggcttcatctacgccctgaccgacctgatgaccgaggccgaggtgaccgagaacaccgaggtggagctgttccacaaggacatcgaggccttcaaggaggagtacaagaccgccagcctggtggaccagagccaggtgagcctgtacgagtacttccacatcagccccatcaagctgcacctgagcgtgagcctgagcagcggcagagaggaggccaaggacagcaagcagaacggcggcctgatccccgtgcacagcctgaacctgctgctgaagagcatcggcgccaccctgaccgacgtgcaggacgtggtgttcaagctggccttcttcgagctgaactaccagttccacaccaccagcgacctgcagagcgaggtgatcagacactacagcaagcaggccatcaagcagatgtacgtgctgatcctgggcctggacgtgctgggcaaccccttcggcctgatcagagagttcagcgagggcgtggaggccttcttctacgagccctaccagggcgccatccagggccccgaggagttcgtggagggcatggccctgggcctgaaggccctggtgggcggcgccgtgggcggcctggccggcgccgccagcaagatcaccggcgccatggccaagggcgtggccgccatgaccatggacgaggactaccagcagaagagaagagaggccatgaacaagcagcccgccggcttcagagagggcatcaccagaggcggcaagggcctggtgagcggcttcgtgagcggcatcaccggcatcgtgaccaagcccatcaagggcgcccagaagggcggcgccgccggcttcttcaagggcgtgggcaagggcctggtgggcgccgtggccagacccaccggcggcatcatcgacatggccagcagcaccttccagggcatcaagagagccaccgagaccagcgaggtggagagcctgagaccccccagattcttcaacgaggacggcgtgatcagaccctacagactgagagacggcaccggcaaccagatgctgcaggtgatggagaacggcagattcgccaagtacaagtacttcacccacgtgatgatcaacaagaccgacatgctgatgatcaccagaagaggcgtgctgttcgtgaccaagggcaccttcggccagctgacctgcgagtggcagtacagcttcgacgagttcaccaaggagcccttcatcgtgcacggcagaagactgagaatcgaggccaaggagagagtgaagagcgtgttccacgccagagagttcggcaagatcatcaacttcaagacccccgaggacgccagatggatcctgaccaagctgcaggaggccagagagcccagccccagcctgtag

SEQ ID NO: 13419 - DNA, 9210 bp, Artificial Sequence
  Description of Artificial Sequence: Synthetic coding sequence
atggtgttcgagagcgtggtggtggacgtgctgaacagattcctgggcgactacgtggtggacctggacaccagccagctgagcctgggcatctggaagggcgccgtggccctgaagaacctgcagatcaaggagaacgccctgagccagctggacgtgcccttcaaggtgaaggtgggccacatcggcaacctgaagctgatcatcccctggaagaacctgtacacccagcccgtggaggccgtgctggaggagatctacctgctgatcgtgcccagcagcagaatcaagtacgaccccctgaaggaggagaagcagctgatggaggccaagcagcaggagctgaagagaatcgaggaggccaagcagaaggtggtggaccaggagcagcacctgcccgagaagcaggacaccttcgccgagaagctggtgacccagatcatcaagaacctgcaggtgaagatcagcagcatccacatcagatacgaggacgacatcaccaacagagacaagcccctgagcttcggcatcagcctgcagaacctgagcatgcagaccaccgaccagtactgggtgccctgcctgcacgacgagaccgagaagctggtgagaaagctgatcagactggacaacctgttcgcctactggaacgtgaagagccagatgttctacctgagcgactacgacaacagcctggacgacctgaagaacggcatcgtgaacgagaacatcgtgcccgagggctacgacttcgtgttcagacccatcagcgccaacgccaagctggtgatgaacagaagaagcgacttcgacttcagcgcccccaagatcaacctggagatcgagctgcacaacatcgccatcgagttcaacaagccccagtacttcagcatcatggagctgctggagagcgtggacatgatggcccagaacctgccctacagaaagttcaagcccgacgtgcccctgcaccaccacgccagagagtggtgggcctacgccatccacggcgtgctggaggtgaacgtgtgccccagactgtggatgtggagctggaagcacatcagaaagcacagacagaaggtgaagcagtacaaggagctgtacaagaagaagctgaccagcaagaagccccccggcgagctgctggtgagcctggaggagctggagaagaccctggacgtgttcaacatcaccatcgccagacagaccgccgaggtggaggtgaagaaggccggctacaagatctacaaggagggcgtgaaggaccccgaggacaacaagggctggttcagctggctgtggagctggagcgagcagaacaccaacgagcagcagcccgacgtgcagcccgagaccctggaggagatgctgacccccgaggagaaggccctgctgtacgaggccatcggctacagcgagaccgccgtggaccccaccctgctgaagaccttcgaggccctgaagttcttcgtgcacctgaagagcatgagcatcgtgctgagagagaaccaccagaagcccgagctggtggacatcgtgatcgaggagttcagcaccctgatcgtgcagagacccggcgcccaggccatcaagttcgagaccaagatcgacagcttccacatcaccggcctgcccgacaacagcgagaagcccagactgctgagcagcctggacgacgccatgagcctgttccagatcaccttcgagatcaaccccctggacgagaccgtgagccagagatgcatcatcgaggccgagcccctggagatcatctacgacgccagaaccgtgaacagcatcgtggagttcttcagaccccccaaggaggtgcacctggcccagctgaccgccgccaccctgaccaagctggaggagttcagaagcaagaccgccaccggcctgctgtacatcatcgagacccagaaggtgctggacctgaagatcaacctgaaggccagctacatcatcgtgccccaggacggcatcttcagccccaccagcaacctgctgctgctggacctgggccacctgaaggtgaccagcaagagcagaagcgagctgcccgacgtgaagcagggcgaggccaacctgaaggagatcatggacagagcctacgacagcttcgacatccagctgaccagcgtgcagctgctgtacagcagagtgggcgacaactggagagaggccagaaagctgagcgtgagcacccagcacatcctggtgcccatgcacttcaacctggagctgagcaaggccatggtgttcatggacgtgagaatgcccaagttcaagatctacggcaagctgcccctgatcagcctgagaatcagcgacaagaagctgcagggcatcatggagctgatcgagagcatccccaagcccgagcccgtgaccgaggtgagcgcccccgtgaagagcttccagatccagaccagcaccagcctgggcaccagccagatcagccagaagatcatccccctgctggagctgcccagcgtgagcgaggacgacagcgaggaggagttcttcgacgccccctgcagccccctggaggagcccctgcagttccccaccggcgtgaagagcatcagaaccagaaagctgcagaagcaggactgcagcgtgaacatgaccaccttcaagatcagattcgaggtgcccaaggtgctgatcgagttctaccacctggtgggcgactgcgagctgagcgtggtggagatcctggtgctgggcctgggcgccgagatcgagatcagaacctacgacctgaaggccaacgccttcctgaaggagttctgcctgaagtgccccgagtacctggacgagaacaagaagcccgtgtacctggtgaccaccctggacaacaccatggaggacctgctgaccctggagtacgtgaaggccgagaagaacgtgcccgacctgaagagcacctacaacaacgtgctgcagctgatcaaggtgaacttcagcagcctggacatccacctgcacaccgaggccctgctgaacaccatcaactacctgcacaacatcctgccccagagcgaggagaagagcgcccccgtgagcaccaccgagaccgaggacaagggcgacgtgatcaagaagctggccctgaagctgagcaccaacgaggacatcatcaccctgcagatcctggccgagctgagctgcctgcagatcttcatccaggaccagaagtgcaacatcagcgagatcaagatcgagggcctggacagcgagatgatcatgagacccagcgagaccgagatcaacgccaagctgagaaacatcatcgtgctggacagcgacatcaccgccatctacaagaaggccgtgtacatcaccggcaaggaggtgttcagcttcaagatggtgagctacatggacgccaccgccggcagcgcctacaccgacatgaacgtggtggacatccaggtgaacctgatcgtgggctgcatcgaggtggtgttcgtgaccaagttcctgtacagcatcctggccttcatcgacaacttccaggccgccaagcaggccctggccgaggccaccgtgcaggccgccggcatggccgccaccggcgtgaaggagctggcccagagaagcagcagaatggccctggacatcaacatcaaggcccccgtggtggtgatcccccagagccccgtgagcgagaacgtgttcgtggccgacttcggcctgatcaccatgaccaacaccttccacatgatcaccgagagccagagcagccccccccccgtgatcgacctgatcaccatcaagctgagcgagatgagactgtacagaagcagattcatcaacgacgcctaccaggaggtgctggacctgctgctgcccctgaacctggaggtggtggtggagagaaacctgtgctgggagtggtaccaggaggtgccctgcttcaacgtgaacgcccagctgaagcccatggagttcatcctgagccaggaggacatcaccaccatcttcaagaccctgcacggcaacatctggtacgagaaggacggcagcgccagccccgccgtgaccaaggaccagtacagcgccaccagcggcgtgaccaccaacgccagccaccacagcggcggcgccaccgtggtgaccgccgccgtggtggaggtgcacagcagagccctgctggtgaagaccaccctgaacatcagcttcaagaccgacgacctgaccatggtgctgtacagccccggccccaagcaggccagcttcaccgacgtgagagaccccagcctgaagctggccgagttcaagctggagaacatcatcagcaccctgaagatgtacaccgacggcagcaccttcagcagcttcagcctgaagaactgcatcctggacgacaagagaccccacgtgaagaaggccacccccagaatgatcggcctgaccgtgggcttcgacaagaaggacatgatggacatcaagtacagaaaggtgagagacggctgcgtgaccgacgccgtgttccaggagatgtacatctgcgccagcgtggagttcctgcagaccgtggccaacgtgttcctggaggcctacaccaccggcaccgccgtggagaccagcgtgcagacctggaccgccaaggaggaggtgcccacccaggagagcgtgaagtgggagatcaacgtgatcatcaagaaccccgagatcgtgttcgtggccgacatgaccaagaacgacgcccccgccctggtgatcaccacccagtgcgagatctgctacaagggcaacctggagaacagcaccatgaccgccgccatcaaggacctgcaggtgagagcctgccccttcctgcccgtgaagagaaagggcaagatcaccaccgtgctgcagccctgcgacctgttctaccagaccacccagaagggcaccgacccccaggtgatcgacatgagcgtgaagagcctgaccctgaaggtgagccccgtgatcatcaacaccatgatcaccatcaccagcgccctgtacaccaccaaggagaccatccccgaggagaccgccagcagcaccgcccacctgtgggagaagaaggacaccaagaccctgaagatgtggttcctggaggagagcaacgagaccgagaagatcgcccccaccaccgagctggtgcccaagggcgagatgatcaagatgaacatcgacagcatcttcatcgtgctggaggccggcatcggccacagaaccgtgcccatgctgctggccaagagcagattcagcggcgagggcaagaactggagcagcctgatcaacctgcactgccagctggagctggaggtgcactactacaacgagatgttcggcgtgtgggagcccctgctggagcccctggagatcgaccagaccgaggacttcagaccctggaacctgggcatcaagatgaagaagaaggccaagatggccatcgtggagagcgaccccgaggaggagaactacaaggtgcccgagtacaagaccgtgatcagcttccacagcaaggaccagctgaacatcaccctgagcaagtgcggcctggtgatgctgaacaacctggtgaaggccttcaccgaggccgccaccggcagcagcgccgacttcgtgaaggacctggcccccttcatgatcctgaacagcctgggcctgaccatcagcgtgagccccagcgacagcttcagcgtgctgaacatccccatggccaagagctacgtgctgaagaacggcgagagcctgagcatggactacatcagaaccaaggacaacgaccacttcaacgccatgaccagcctgagcagcaagctgttcttcatcctgctgacccccgtgaaccacagcaccgccgacaagatccccctgaccaaggtgggcagaagactgtacaccgtgagacacagagagagcggcgtggagagaagcatcgtgtgccagatcgacaccgtggagggcagcaagaaggtgaccatcagaagccccgtgcagatcagaaaccacttcagcgtgcccctgagcgtgtacgagggcgacaccctgctgggcaccgccagccccgagaacgagttcaacatccccctgggcagctacagaagcttcatcttcctgaagcccgaggacgagaactaccagatgtgcgagggcatcgacttcgaggagatcatcaagaacgacggcgccctgctgaagaagaagtgcagaagcaagaaccccagcaaggagagcttcctgatcaacatcgtgcccgagaaggacaacctgaccagcctgagcgtgtacagcgaggacggctgggacctgccctacatcatgcacctgtggccccccatcctgctgagaaacctgctgccctacaagatcgcctactacatcgagggcatcgagaacagcgtgttcaccctgagcgagggccacagcgcccagatctgcaccgcccagctgggcaaggccagactgcacctgaagctgctggactacctgaaccacgactggaagagcgagtaccacatcaagcccaaccagcaggacatcagcttcgtgagcttcacctgcgtgaccgagatggagaagaccgacctggacatcgccgtgcacatgacctacaacaccggccagaccgtggtggccttccacagcccctactggatggtgaacaagaccggcagaatgctgcagtacaaggccgacggcatccacagaaagcacccccccaactacaagaagcccgtgctgttcagcttccagcccaaccacttcttcaacaacaacaaggtgcagctgatggtgaccgacagcgagctgagcaaccagttcagcatcgacaccgtgggcagccacggcgccgtgaagtgcaagggcctgaagatggactaccaggtgggcgtgaccatcgacctgagcagcttcaacatcaccagaatcgtgaccttcacccccttctacatgatcaagaacaagagcaagtaccacatcagcgtggccgaggagggcaacgacaagtggctgagcctggacctggagcagtgcatccccttctggcccgagtacgccagcagcaagctgctgatccaggtggagagaagcgaggacccccccaagagaatctacttcaacaagcaggagaactgcatcctgctgagactggacaacgagctgggcggcatcatcgccgaggtgaacctggccgagcacagcaccgtgatcaccttcctggactaccacgacggcgccgccaccttcctgctgatcaaccacaccaagaacgagctggtgcagtacaaccagagcagcctgagcgagatcgaggacagcctgccccccggcaaggccgtgttctacacctgggccgaccccgtgggcagcagaagactgaagtggagatgcagaaagagccacggcgaggtgacccagaaggacgacatgatgatgcccatcgacctgggcgagaagaccatctacctggtgagcttcttcgagggcctgcagagaatcatcctgttcaccgaggaccccagagtgttcaaggtgacctacgagagcgagaaggccgagctggccgagcaggagatcgccgtggccctgcaggacgtgggcatcagcctggtgaacaactacaccaagcaggaggtggcctacatcggcatcaccagcagcgacgtggtgtgggagaccaagcccaagaagaaggccagatggaagcccatgagcgtgaagcacaccgagaagctggagagagagttcaaggagtacaccgagagcagccccagcgaggacaaggtgatccagctggacaccaacgtgcccgtgagactgacccccaccggccacaacatgaagatcctgcagccccacgtgatcgccctgagaagaaactacctgcccgccctgaaggtggagtacaacaccagcgcccaccagagcagcttcagaatccagatctacagaatccagatccagaaccagatccacggcgccgtgttccccttcgtgttctaccccgtgaagccccccaagagcgtgaccatggacagcgcccccaagcccttcaccgacgtgagcatcgtgatgagaagcgccggccacagccagatcagcagaatcaagtacttcaaggtgctgatccaggagatggacctgagactggacctgggcttcatctacgccctgaccgacctgatgaccgaggccgaggtgaccgagaacaccgaggtggagctgttccacaaggacatcgaggccttcaaggaggagtacaagaccgccagcctggtggaccagagccaggtgagcctgtacgagtacttccacatcagccccatcaagctgcacctgagcgtgagcctgagcagcggcagagaggaggccaaggacagcaagcagaacggcggcctgatccccgtgcacagcctgaacctgctgctgaagagcatcggcgccaccctgaccgacgtgcaggacgtggtgttcaagctggccttcttcgagctgaactaccagttccacaccaccagcgacctgcagagcgaggtgatcagacactacagcaagcaggccatcaagcagatgtacgtgctgatcctgggcctggacgtgctgggcaaccccttcggcctgatcagagagttcagcgagggcgtggaggccttcttctacgagccctaccagggcgccatccagggccccgaggagttcgtggagggcatggccctgggcctgaaggccctggtgggcggcgccgtgggcggcctggccggcgccgccagcaagatcaccggcgccatggccaagggcgtggccgccatgaccatggacgaggactaccagcagaagagaagagaggccatgaacaagcagcccgccggcttcagagagggcatcaccagaggcggcaagggcctggtgagcggcttcgtgagcggcatcaccggcatcgtgaccaagcccatcaagggcgcccagaagggcggcgccgccggcttcttcaagggcgtgggcaagggcctggtgggcgccgtggccagacccaccggcggcatcatcgacatggccagcagcaccttccagggcatcaagagagccaccgagaccagcgaggtggagagcctgagaccccccagattcttcaacgaggacggcgtgatcagaccctacagactgagagacggcaccggcaaccagatgctgcaggccagcaagagcctgatctag

SEQ ID NO: 13420 - DNA, 9408 bp, Artificial Sequence
  Description of Artificial Sequence: Synthetic coding sequence
atggtgttcgagagcgtggtggtggacgtgctgaacagattcctgggcgactacgtggtggacctggacaccagccagctgagcctgggcatctggaagggcgccgtggccctgaagaacctgcagatcaaggagaacgccctgagccagctggacgtgcccttcaaggtgaaggtgggccacatcggcaacctgaagctgatcatcccctggaagaacctgtacacccagcccgtggaggccgtgctggaggagatctacctgctgatcgtgcccagcagcagaatcaagtacgaccccctgaaggaggagaagcagctgatggaggccaagcagcaggagctgaagagaatcgaggaggccaagcagaaggtggtggaccaggagcagcacctgcccgagaagcaggacaccttcgccgagaagctggtgacccagatcatcaagaacctgcaggtgaagatcagcagcatccacatcagatacgaggacgacatcaccaacagagacaagcccctgagcttcggcatcagcctgcagaacctgagcatgcagaccaccgaccagtactgggtgccctgcctgcacgacgagaccgagaagctggtgagaaagctgatcagactggacaacctgttcgcctactggaacgtgaagagccagatgttctacctgagcgactacgacaacagcctggacgacctgaagaacggcatcgtgaacgagaacatcgtgcccgagggctacgacttcgtgttcagacccatcagcgccaacgccaagctggtgatgaacagaagaagcgacttcgacttcagcgcccccaagatcaacctggagatcgagctgcacaacatcgccatcgagttcaacaagccccagtacttcagcatcatggagctgctggagagcgtggacatgatggcccagaacctgccctacagaaagttcaagcccgacgtgcccctgcaccaccacgccagagagtggtgggcctacgccatccacggcgtgctggaggtgaacgtgtgccccagactgtggatgtggagctggaagcacatcagaaagcacagacagaaggtgaagcagtacaaggagctgtacaagaagaagctgaccagcaagaagccccccggcgagctgctggtgagcctggaggagctggagaagaccctggacgtgttcaacatcaccatcgccagacagaccgccgaggtggaggtgaagaaggccggctacaagatctacaaggagggcgtgaaggaccccgaggacaacaagggctggttcagctggctgtggagctggagcgagcagaacaccaacgagcagcagcccgacgtgcagcccgagaccctggaggagatgctgacccccgaggagaaggccctgctgtacgaggccatcggctacagcgagaccgccgtggaccccaccctgctgaagaccttcgaggccctgaagttcttcgtgcacctgaagagcatgagcatcgtgctgagagagaaccaccagaagcccgagctggtggacatcgtgatcgaggagttcagcaccctgatcgtgcagagacccggcgcccaggccatcaagttcgagaccaagatcgacagcttccacatcaccggcctgcccgacaacagcgagaagcccagactgctgagcagcctggacgacgccatgagcctgttccagatcaccttcgagatcaaccccctggacgagaccgtgagccagagatgcatcatcgaggccgagcccctggagatcatctacgacgccagaaccgtgaacagcatcgtggagttcttcagaccccccaaggaggtgcacctggcccagctgaccgccgccaccctgaccaagctggaggagttcagaagcaagaccgccaccggcctgctgtacatcatcgagacccagaaggtgctggacctgaagatcaacctgaaggccagctacatcatcgtgccccaggacggcatcttcagccccaccagcaacctgctgctgctggacctgggccacctgaaggtgaccagcaagagcagaagcgagctgcccgacgtgaagcagggcgaggccaacctgaaggagatcatggacagagcctacgacagcttcgacatccagctgaccagcgtgcagctgctgtacagcagagtgggcgacaactggagagaggccagaaagctgagcgtgagcacccagcacatcctggtgcccatgcacttcaacctggagctgagcaaggccatggtgttcatggacgtgagaatgcccaagttcaagatctacggcaagctgcccctgatcagcctgagaatcagcgacaagaagctgcagggcatcatggagctgatcgagagcatccccaagcccgagcccgtgaccgaggtgagcgcccccgtgaagagcttccagatccagaccagcaccagcctgggcaccagccagatcagccagaagatcatccccctgctggagctgcccagcgtgagcgaggacgacagcgaggaggagttcttcgacgccccctgcagccccctggaggagcccctgcagttccccaccggcgtgaagagcatcagaaccagaaagctgcagaagcaggactgcagcgtgaacatgaccaccttcaagatcagattcgaggtgcccaaggtgctgatcgagttctaccacctggtgggcgactgcgagctgagcgtggtggagatcctggtgctgggcctgggcgccgagatcgagatcagaacctacgacctgaaggccaacgccttcctgaaggagttctgcctgaagtgccccgagtacctggacgagaacaagaagcccgtgtacctggtgaccaccctggacaacaccatggaggacctgctgaccctggagtacgtgaaggccgagaagaacgtgcccgacctgaagagcacctacaacaacgtgctgcagctgatcaaggtgaacttcagcagcctggacatccacctgcacaccgaggccctgctgaacaccatcaactacctgcacaacatcctgccccagagcgaggagaagagcgcccccgtgagcaccaccgagaccgaggacaagggcgacgtgatcaagaagctgggcctggacagcgagatgatcatgagacccagcgagaccgagatcaacgccaagctgagaaacatcatcgtgctggacagcgacatcaccgccatctacaagaaggccgtgtacatcaccggcaaggaggtgttcagcttcaagatggtgagctacatggacgccaccgccggcagcgcctacaccgacatgaacgtggtggacatccaggtgaacctgatcgtgggctgcatcgaggtggtgttcgtgaccaagttcctgtacagcatcctggccttcatcgacaacttccaggccgccaagcaggccctggccgaggccaccgtgcaggccgccggcatggccgccaccggcgtgaaggagctggcccagagaagcagcagaatggccctggacatcaacatcaaggcccccgtggtggtgatcccccagagccccgtgagcgagaacgtgttcgtggccgacttcggcctgatcaccatgaccaacaccttccacatgatcaccgagagccagagcagccccccccccgtgatcgacctgatcaccatcaagctgagcgagatgagactgtacagaagcagattcatcaacgacgcctaccaggaggtgctggacctgctgctgcccctgaacctggaggtggtggtggagagaaacctgtgctgggagtggtaccaggaggtgccctgcttcaacgtgaacgcccagctgaagcccatggagttcatcctgagccaggaggacatcaccaccatcttcaagaccctgcacggcaacatctggtacgagaaggacggcagcgccagccccgccgtgaccaaggaccagtacagcgccaccagcggcgtgaccaccaacgccagccaccacagcggcggcgccaccgtggtgaccgccgccgtggtggaggtgcacagcagagccctgctggtgaagaccaccctgaacatcagcttcaagaccgacgacctgaccatggtgctgtacagccccggccccaagcaggccagcttcaccgacgtgagagaccccagcctgaagctggccgagttcaagctggagaacatcatcagcaccctgaagatgtacaccgacggcagcaccttcagcagcttcagcctgaagaactgcatcctggacgacaagagaccccacgtgaagaaggccacccccagaatgatcggcctgaccgtgggcttcgacaagaaggacatgatggacatcaagtacagaaaggtgagagacggctgcgtgaccgacgccgtgttccaggagatgtacatctgcgccagcgtggagttcctgcagaccgtggccaacgtgttcctggaggcctacaccaccggcaccgccgtggagaccagcgtgcagacctggaccgccaaggaggaggtgcccacccaggagagcgtgaagtgggagatcaacgtgatcatcaagaaccccgagatcgtgttcgtggccgacatgaccaagaacgacgcccccgccctggtgatcaccacccagtgcgagatctgctacaagggcaacctggagaacagcaccatgaccgccgccatcaaggacctgcaggtgagagcctgccccttcctgcccgtgaagagaaagggcaagatcaccaccgtgctgcagccctgcgacctgttctaccagaccacccagaagggcaccgacccccaggtgatcgacatgagcgtgaagagcctgaccctgaaggtgagccccgtgatcatcaacaccatgatcaccatcaccagcgccctgtacaccaccaaggagaccatccccgaggagaccgccagcagcaccgcccacctgtgggagaagaaggacaccaagaccctgaagatgtggttcctggaggagagcaacgagaccgagaagatcgcccccaccaccgagctggtgcccaagggcgagatgatcaagatgaacatcgacagcatcttcatcgtgctggaggccggcatcggccacagaaccgtgcccatgctgctggccaagagcagattcagcggcgagggcaagaactggagcagcctgatcaacctgcactgccagctggagctggaggtgcactactacaacgagatgttcggcgtgtgggagcccctgctggagcccctggagatcgaccagaccgaggacttcagaccctggaacctgggcatcaagatgaagaagaaggccaagatggccatcgtggagagcgaccccgaggaggagaactacaaggtgcccgagtacaagaccgtgatcagcttccacagcaaggaccagctgaacatcaccctgagcaagtgcggcctggtgatgctgaacaacctggtgaaggccttcaccgaggccgccaccggcagcagcgccgacttcgtgaaggacctggcccccttcatgatcctgaacagcctgggcctgaccatcagcgtgagccccagcgacagcttcagcgtgctgaacatccccatggccaagagctacgtgctgaagaacggcgagagcctgagcatggactacatcagaaccaaggacaacgaccacttcaacgccatgaccagcctgagcagcaagctgttcttcatcctgctgacccccgtgaaccacagcaccgccgacaagatccccctgaccaaggtgggcagaagactgtacaccgtgagacacagagagagcggcgtggagagaagcatcgtgtgccagatcgacaccgtggagggcagcaagaaggtgaccatcagaagccccgtgcagatcagaaaccacttcagcgtgcccctgagcgtgtacgagggcgacaccctgctgggcaccgccagccccgagaacgagttcaacatccccctgggcagctacagaagcttcatcttcctgaagcccgaggacgagaactaccagatgtgcgagggcatcgacttcgaggagatcatcaagaacgacggcgccctgctgaagaagaagtgcagaagcaagaaccccagcaaggagagcttcctgatcaacatcgtgcccgagaaggacaacctgaccagcctgagcgtgtacagcgaggacggctgggacctgccctacatcatgcacctgtggccccccatcctgctgagaaacctgctgccctacaagatcgcctactacatcgagggcatcgagaacagcgtgttcaccctgagcgagggccacagcgcccagatctgcaccgcccagctgggcaaggccagactgcacctgaagctgctggactacctgaaccacgactggaagagcgagtaccacatcaagcccaaccagcaggacatcagcttcgtgagcttcacctgcgtgaccgagatggagaagaccgacctggacatcgccgtgcacatgacctacaacaccggccagaccgtggtggccttccacagcccctactggatggtgaacaagaccggcagaatgctgcagtacaaggccgacggcatccacagaaagcacccccccaactacaagaagcccgtgctgttcagcttccagcccaaccacttcttcaacaacaacaaggtgcagctgatggtgaccgacagcgagctgagcaaccagttcagcatcgacaccgtgggcagccacggcgccgtgaagtgcaagggcctgaagatggactaccaggtgggcgtgaccatcgacctgagcagcttcaacatcaccagaatcgtgaccttcacccccttctacatgatcaagaacaagagcaagtaccacatcagcgtggccgaggagggcaacgacaagtggctgagcctggacctggagcagtgcatccccttctggcccgagtacgccagcagcaagctgctgatccaggtggagagaagcgaggacccccccaagagaatctacttcaacaagcaggagaactgcatcctgctgagactggacaacgagctgggcggcatcatcgccgaggtgaacctggccgagcacagcaccgtgatcaccttcctggactaccacgacggcgccgccaccttcctgctgatcaaccacaccaagaacgagctggtgcagtacaaccagagcagcctgagcgagatcgaggacagcctgccccccggcaaggccgtgttctacacctgggccgaccccgtgggcagcagaagactgaagtggagatgcagaaagagccacggcgaggtgacccagaaggacgacatgatgatgcccatcgacctgggcgagaagaccatctacctggtgagcttcttcgagggcctgcagagaatcatcctgttcaccgaggaccccagagtgttcaaggtgacctacgagagcgagaaggccgagctggccgagcaggagatcgccgtggccctgcaggacgtgggcatcagcctggtgaacaactacaccaagcaggaggtggcctacatcggcatcaccagcagcgacgtggtgtgggagaccaagcccaagaagaaggccagatggaagcccatgagcgtgaagcacaccgagaagctggagagagagttcaaggagtacaccgagagcagccccagcgaggacaaggtgatccagctggacaccaacgtgcccgtgagactgacccccaccggccacaacatgaagatcctgcagccccacgtgatcgccctgagaagaaactacctgcccgccctgaaggtggagtacaacaccagcgcccaccagagcagcttcagaatccagatctacagaatccagatccagaaccagatccacggcgccgtgttccccttcgtgttctaccccgtgaagccccccaagagcgtgaccatggacagcgcccccaagcccttcaccgacgtgagcatcgtgatgagaagcgccggccacagccagatcagcagaatcaagtacttcaaggtgctgatccaggagatggacctgagactggacctgggcttcatctacgccctgaccgacctgatgaccgaggccgaggtgaccgagaacaccgaggtggagctgttccacaaggacatcgaggccttcaaggaggagtacaagaccgccagcctggtggaccagagccaggtgagcctgtacgagtacttccacatcagccccatcaagctgcacctgagcgtgagcctgagcagcggcagagaggaggccaaggacagcaagcagaacggcggcctgatccccgtgcacagcctgaacctgctgctgaagagcatcggcgccaccctgaccgacgtgcaggacgtggtgttcaagctggccttcttcgagctgaactaccagttccacaccaccagcgacctgcagagcgaggtgatcagacactacagcaagcaggccatcaagcagatgtacgtgctgatcctgggcctggacgtgctgggcaaccccttcggcctgatcagagagttcagcgagggcgtggaggccttcttctacgagccctaccagggcgccatccagggccccgaggagttcgtggagggcatggccctgggcctgaaggccctggtgggcggcgccgtgggcggcctggccggcgccgccagcaagatcaccggcgccatggccaagggcgtggccgccatgaccatggacgaggactaccagcagaagagaagagaggccatgaacaagcagcccgccggcttcagagagggcatcaccagaggcggcaagggcctggtgagcggcttcgtgagcggcatcaccggcatcgtgaccaagcccatcaagggcgcccagaagggcggcgccgccggcttcttcaagggcgtgggcaagggcctggtgggcgccgtggccagacccaccggcggcatcatcgacatggccagcagcaccttccagggcatcaagagagccaccgagaccagcgaggtggagagcctgagaccccccagattcttcaacgaggacggcgtgatcagaccctacagactgagagacggcaccggcaaccagatgctgcaggtgatggagaacggcagattcgccaagtacaagtacttcacccacgtgatgatcaacaagaccgacatgctgatgatcaccagaagaggcgtgctgttcgtgaccaagggcaccttcggccagctgacctgcgagtggcagtacagcttcgacgagttcaccaaggagcccttcatcgtgcacggcagaagactgagaatcgaggccaaggagagagtgaagagcgtgttccacgccagagagttcggcaagatcatcaacttcaagacccccgaggacgccagatggatcctgaccaagctgcaggaggccagagagcccagccccagcctgtag

SEQ ID NO: 13421 - DNA, 1317 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagagaggagtggatgagagccatccagatggtggccaacagcctgaagcagagagcccccggcgaggaccccatggactacaagtgcggcagccccagcgacagcagcaccaccgaggagatggaggtggccgtgagcaaggccagagccaaggtgaccatgaacgacttcgactacctgaagctgctgggcaagggcaccttcggcaaggtgatcctggtgagagagaaggccaccggcagatactacgccatgaagatcctgagaaaggaggtgatcatcgccaaggacgaggtggcccacaccgtgaccgagagcagagtgctgcagaacaccagacaccccttcctgaccgccctgaagtacgccttccagacccacgacagactgtgcttcgtgatggagtacgccaacggcggcgagctgttcttccacctgagcagagagagagtgttcaccgaggagagagccagattctacggcgccgagatcgtgagcgccctggagtacctgcacagcagagacgtggtgtacagagacatcaaggtgctggaggacaacgactacggcagagccgtggactggtggggcctgggcgtggtgatgtacgagatgatgtgcggcagactgcccttctacaaccaggaccacgagagactgttcgagctgatcctgatggaggagatcagattccccagaaccctgagccccgaggccaagagcctgctggccggcctgctgaagaaggaccccaagcagagactgggcggcggccccagcgacgccaaggaggtgatggagcacagattcttcctgagcatcaactggcaggacgtggtgcagaagaagctgctgccccccttcaagccccaggtgaccagcgaggtggacaccagatacttcgacgacgagttcaccgcccagagcatcaccatcaccccccccgacagatacgacagcctgggcctgctggagctggaccagagaacccacttcccccagttcagctacagcgccagcatcagagagtag

SEQ ID NO: 13422 - DNA, 444 bp, Artificial Sequence
  Description of Artificial Sequence: Synthetic coding sequence
atgagatgcctgagcagcaagaaggccggcagcaccagcgtggtgaagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagagaggagtggatgagagccatccagatggtggccaacagcctgcagccccacctgtgcgcccagaccagaatctggaagacccccccccccgcccaggcctgggccgtgggcagactggagatccaggtgctgatccacaccagccccagcgagggctag

SEQ ID NO: 13423 - DNA, 1149 bp, Artificial Sequence
  Description of Artificial Sequence: Synthetic coding sequence
atgagagccatccagatggtggccaacagcctgaagcagagagcccccggcgaggaccccatggactacaagtgcggcagccccagcgacagcagcaccaccgaggagatggaggtggccgtgagcaaggccagagccaaggtgaccatgaacgacttcgactacctgaagctgctgggcaagggcaccttcggcaaggtgatcctggtgagagagaaggccaccggcagatactacgccatgaagatcctgagaaaggaggtgatcatcgccaaggacgaggtggcccacaccgtgaccgagagcagagtgctgcagaacaccagacaccccttcctgaccgccctgaagtacgccttccagacccacgacagactgtgcttcgtgatggagtacgccaacggcggcgagctgttcttccacctgagcagagagagagtgttcaccgaggagagagccagattctacggcgccgagatcgtgagcgccctggagtacctgcacagcagagacgtggtgtacagagacatcaagctggagaacctgatgctggacaaggacggccacatcaagatcaccgacttcggcctgtgcaaggagggcatcagcgacggcgccaccatgaagaccttctgcggcacccccgagtacctggcccccgaggtgctggaggacaacgactacggcagagccgtggactggtggggcctgggcgtggtgatgtacgagatgatgtgcggcagactgcccttctacaaccaggaccacgagagactgttcgagctgatcctgatggaggagatcagattccccagaaccctgagccccgaggccaagagcctgctggccggcctgctgaagaaggaccccaagcagagactgggcggcggccccagcgacgccaaggaggtgatggagcacagattcttcctgagcatcaactggcaggacgtggtgcagaagaagctgctgccccccttcaagccccaggtgaccagcgaggtggacaccagatacttcgacgacgagttcaccgcccagagcatcaccatcaccccccccgacagatacgacagcctgggcctgctggagctggaccagagaacccacttcccccagttcagctacagcgccagcatcagagagtag

SEQ ID NO: 13424 - DNA, 402 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagagaggagtggatgagagccatccagatggtggccaacagcctgaagcagagagcccccggcgaggaccccatggactacaagtgcggcagccccagcgacagcagcaccacctag

SEQ ID NO: 13425 - DNA, 1446 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagagaggagtggatgagagccatccagatggtggccaacagcctgaagcagagagcccccggcgaggaccccatggactacaagtgcggcagccccagcgacagcagcaccaccgaggagatggaggtggccgtgagcaaggccagagccaaggtgaccatgaacgacttcgactacctgaagctgctgggcaagggcaccttcggcaaggtgatcctggtgagagagaaggccaccggcagatactacgccatgaagatcctgagaaaggaggtgatcatcgccaaggacgaggtggcccacaccgtgaccgagagcagagtgctgcagaacaccagacaccccttcctgaccgccctgaagtacgccttccagacccacgacagactgtgcttcgtgatggagtacgccaacggcggcgagctgttcttccacctgagcagagagagagtgttcaccgaggagagagccagattctacggcgccgagatcgtgagcgccctggagtacctgcacagcagagacgtggtgtacagagacatcaagctggagaacctgatgctggacaaggacggccacatcaagatcaccgacttcggcctgtgcaaggagggcatcagcgacggcgccaccatgaagaccttctgcggcacccccgagtacctggcccccgaggtgctggaggacaacgactacggcagagccgtggactggtggggcctgggcgtggtgatgtacgagatgatgtgcggcagactgcccttctacaaccaggaccacgagagactgttcgagctgatcctgatggaggagatcagattccccagaaccctgagccccgaggccaagagcctgctggccggcctgctgaagaaggaccccaagcagagactgggcggcggccccagcgacgccaaggaggtgatggagcacagattcttcctgagcatcaactggcaggacgtggtgcagaagaagctgctgccccccttcaagccccaggtgaccagcgaggtggacaccagatacttcgacgacgagttcaccgcccagagcatcaccatcaccccccccgacagatacgacagcctgggcctgctggagctggaccagagaacccacttcccccagttcagctacagcgccagcatcagagagtag

SEQ ID NO: 13426 - DNA, 402 bp, Artificial Sequence; identical to SEQ ID NO: 13424
  Description of Artificial Sequence: Synthetic coding sequence

SEQ ID NO: 13427 - DNA, 291 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagatag

SEQ ID NO: 13428 - DNA, 360 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagagaggagtggatgagagccatccagatggtggccaacagcctgaagcagagagcccccggcgaggacccctag

SEQ ID NO: 13429 - DNA, 1446 bp, Artificial Sequence; identical to SEQ ID NO: 13425
  Description of Artificial Sequence: Synthetic coding sequence

SEQ ID NO: 13430 - DNA, 204 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagatag

SEQ ID NO: 13431 - DNA, 144 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagtag

SEQ ID NO: 13432 - DNA, 405 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagagaggagtggatgagagccatccagatggtggccaacagcctgaagcagagagcccccggcgaggaccccatggactacaagtgcggcagccccagcgacagcagcaccaccgagtag

SEQ ID NO: 13433 - DNA, 324 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagagaggagtggatgagagccatccagatggtggcctag

SEQ ID NO: 13434 - DNA, 867 bp, Artificial Sequence
  Description of Artificial Sequence: Synthetic coding sequence
atgaacgaggtgagcgtgatcaaggagggctggctgcacaagagaggcgagtacatcaagacctggagacccagatacttcctgctgaagagcgacggcagcttcatcggctacaaggagagacccgaggcccccgaccagaccctgccccccctgaacaacttcagcgtggccgagtgccagctgatgaagaccgagagacccagacccaacaccttcgtgatcagatgcctgcagtggaccaccgtgatcgagagaaccttccacgtggacagccccgacgagagagaggagtggatgagagccatccagatggtggccaacagcctgaagcagagagcccccggcgaggaccccatggactacaagtgcggcagccccagcgacagcagcaccaccgaggagatggaggtggccgtgagcaaggccagagccaaggtgaccatgaacgacttcgactacctgaagctgctgggcaagggcaccttcggcaaggtgatcctggtgagagagaaggccaccggcagatactacgccatgaagatcctgagaaaggaggtgatcatcgccaaggacgaggtggcccacaccgtgaccgagagcagagtgctgcagaacaccagacaccccttcctgaccgtgagctgcccccccctgcccagacagtgcgaggccagcctgtggaccgagctgagagagagagccctgatcttctggtacaaggcccagagctggggcagacccggcggccagggcaaggtgctgctgagacccgccaagagcagcgagcccagacacgtggtgggcgtgagcagactgggcgagtgggagggcgacagcttcttcatcgacggcggcttcatgtag

SEQ ID NO: 13435 - DNA, 1440 bp, Artificial Sequence
  Description of Artificial Sequence: Synthetic coding sequence
atgagcgacgtgaccatcgtgaaggagggctgggtgcagaagagaggcgagtacatcaagaactggagacccagatacttcctgctgaagaccgacggcagcttcatcggctacaaggagaagccccaggacgtggacctgccctaccccctgaacaacttcagcgtggccaagtgccagctgatgaagaccgagagacccaagcccaacaccttcatcatcagatgcctgcagtggaccaccgtgatcgagagaaccttccacgtggacacccccgaggagagagaggagtggaccgaggccatccaggccgtggccgacagactgcagagacaggaggaggagagaatgaactgcagccccaccagccagatcgacaacatcggcgaggaggagatggacgccagcaccacccaccacaagagaaagaccatgaacgacttcgactacctgaagctgctgggcaagggcaccttcggcaaggtgatcctggtgagagagaaggccagcggcaagtactacgccatgaagatcctgaagaaggaggtgatcatcgccaaggacgaggtggcccacaccctgaccgagagcagagtgctgaagaacaccagacaccccttcctgaccagcctgaagtacagcttccagaccaaggacagactgtgcttcgtgatggagtacgtgaacggcggcgagctgttcttccacctgagcagagagagagtgttcagcgaggacagaaccagattctacggcgccgagatcgtgagcgccctggactacctgcacagcggcaagatcgtgtacagagacctgaagctggagaacctgatgctggacaaggacggccacatcaagatcaccgacttcggcctgtgcaaggagggcatcaccgacgccgccaccatgaagaccttctgcggcacccccgagtacctggcccccgaggtgctggaggacaacgactacggcagagccgtggactggtggggcctgggcgtggtgatgtacgagatgatgtgcggcagactgcccttctacaaccaggaccacgagaagctgttcgagctgatcctgatggaggacatcaagttccccagaaccctgagcagcgacgccaagagcctgctgagcggcctgctgatcaaggaccccaacaagagactgggcggcggccccgacgacgccaaggagatcatgagacacagcttcttcagcggcgtgaactggcaggacgtgtacgacaagaagctggtgccccccttcaagccccaggtgaccagcgagaccgacaccagatacttcgacgaggagttcaccgcccagaccatcaccatcaccccccccgagaagtacgacgaggacggcatggactgcatggacaacgagagaagaccccacttcccccagttcagctacagcgccagcggcagagagtag

SEQ ID NO: 13436 - DNA, 1398 bp, Artificial Sequence
  Description of Artificial Sequence: Synthetic coding sequence
atgagcgacgtgaccatcgtgaaggagggctgggtgcagaagagaggcgagtacatcaagaactggagacccagatacttcctgctgaagaccgacggcagcttcatcggctacaaggagaagccccaggacgtggacctgccctaccccctgaacaacttcagcgtggccaagtgccagctgatgaagaccgagagacccaagcccaacaccttcatcatcagatgcctgcagtggaccaccgtgatcgagagaaccttccacgtggacacccccgaggagagagaggagtggaccgaggccatccaggccgtggccgacagactgcagagacaggaggaggagagaatgaactgcagccccaccagccagatcgacaacatcggcgaggaggagatggacgccagcaccacccaccacaagagaaagaccatgaacgacttcgactacctgaagctgctgggcaagggcaccttcggcaaggtgatcctggtgagagagaaggccagcggcaagtactacgccatgaagatcctgaagaaggaggtgatcatcgccaaggacgaggtggcccacaccctgaccgagagcagagtgctgaagaacaccagacaccccttcctgaccagcctgaagtacagcttccagaccaaggacagactgtgcttcgtgatggagtacgtgaacggcggcgagctgttcttccacctgagcagagagagagtgttcagcgaggacagaaccagattctacggcgccgagatcgtgagcgccctggactacctgcacagcggcaagatcgtgtacagagacctgaagctggagaacctgatgctggacaaggacggccacatcaagatcaccgacttcggcctgtgcaaggagggcatcaccgacgccgccaccatgaagaccttctgcggcacccccgagtacctggcccccgaggtgctggaggacaacgactacggcagagccgtggactggtggggcctgggcgtggtgatgtacgagatgatgtgcggcagactgcccttctacaaccaggaccacgagaagctgttcgagctgatcctgatggaggacatcaagttccccagaaccctgagcagcgacgccaagagcctgctgagcggcctgctgatcaaggaccccaacaagagactgggcggcggccccgacgacgccaaggagatcatgagacacagcttcttcagcggcgtgaactggcaggacgtgtacgacaagaagctggtgccccccttcaagccccaggtgaccagcgagaccgacaccagatacttcgacgaggagttcaccgcccagaccatcaccatcaccccccccgagaagtgccagcagagcgactgcggcatgctgggcaactggaagaagtag

SEQ ID NO: 13437 - DNA, 1440 bp, Artificial Sequence; identical to SEQ ID NO: 13435
  Description of Artificial Sequence: Synthetic coding sequence

SEQ ID NO: 13438 - DNA, 1398 bp, Artificial Sequence; identical to SEQ ID NO: 13436
  Description of Artificial Sequence: Synthetic coding sequence

SEQ ID NO: 13439 - DNA, 420 bp, Artificial Sequence
  Description of Artificial Sequence: Synthetic coding sequence
atgagcgacgtgaccatcgtgaaggagggctgggtgcagaagagaggcgagtacatcaagaactggagacccagatacttcctgctgaagaccgacggcagcttcatcggctacaaggagaagccccaggacgtggacctgccctaccccctgaacaacttcagcgtggccaagtgccagctgatgaagaccgagagacccaagcccaacaccttcatcatcagatgcctgcagtggaccaccgtgatcgagagaaccttccacgtggacacccccgaggagagagaggagtggaccgaggccatccaggccgtggccgacagactgcagagacaggaggaggagagaatgaactgcagccccaccagccagatcgacaacatcggcgaggaggagatggacgccagcaccacccactag

SEQ ID NO: 13440 - DNA, 624 bp, Artificial Sequence
  Description of Artificial Sequence: Synthetic coding sequence
atgagccccctgctgagaagactgctgctggccgccctgctgcagctggcccccgcccaggcccccgtgagccagcccgacgcccccggccaccagagaaaggtggtgagctggatcgacgtgtacaccagagccacctgccagcccagagaggtggtggtgcccctgaccgtggagctgatgggcaccgtggccaagcagctggtgcccagctgcgtgaccgtgcagagatgcggcggctgctgccccgacgacggcctggagtgcgtgcccaccggccagcaccaggtgagaatgcagatcctgatgatcagataccccagcagccagctgggcgagatgagcctggaggagcacagccagtgcgagtgcagacccaagaagaaggacagcgccgtgaagcccgacagagccgccaccccccaccacagaccccagcccagaagcgtgcccggctgggacagcgcccccggcgcccccagccccgccgacatcacccaccccacccccgcccccggccccagcgcccacgccgcccccagcaccaccagcgccctgacccccggccccgccgccgccgccgccgacgccgccgccagcagcgtggccaagggcggcgcctag

SEQ ID NO: 13441 - DNA, 567 bp, Artificial Sequence
  Description of Artificial Sequence: Synthetic coding sequence
atgagccccctgctgagaagactgctgctggccgccctgctgcagctggcccccgcccaggcccccgtgagccagcccgacgcccccggccaccagagaaaggtggtgagctggatcgacgtgtacaccagagccacctgccagcccagagaggtggtggtgcccctgaccgtggagctgatgggcaccgtggccaagcagctggtgcccagctgcgtgaccgtgcagagatgcggcggctgctgccccgacgacggcctggagtgcgtgcccaccggccagcaccaggtgagaatgcagatcctgatgatcagataccccagcagccagctgggcgagatgagcctggaggagcacagccagtgcgagtgcagacccaagaagaaggacagcgccgtgaagcccgacagccccagacccctgtgccccagatgcacccagcaccaccagagacccgaccccagaacctgcagatgcagatgcagaagaagaagcttcctgagatgccagggcagaggcctggagctgaaccccgacacctgcagatgcagaaagctgagaagatag

SEQ ID NO: 13442 - DNA, 1143 bp, Artificial Sequence
  Description of Artificial Sequence: Synthetic coding sequence
atgagcgagaccgtgatctgcagcagcagagccaccgtgatgctgtacgacgacggcaacaagagatggctgcccgccggcaccggcccccaggccttcagcagagtgcagatctaccacaaccccaccgccaacagcttcagagtggtgggcagaaagatgcagcccgaccagcaggtggtgatcaactgcgccatcgtgagaggcgtgaagtacaaccaggccacccccaacttccaccagtggagagacgccagacaggtgtggggcctgaacttcggcagcaaggaggacgccgcccagttcgccgccggcatggccagcgccctggaggccctggagggcggcggccccccccccccccccgccctgcccacctggagcgtgcccaacggccccagccccgaggaggtggagcagcagaagagacagcagcccggccccagcgagcacatcgagagaagagtgagcaacgccggcggcccccccgccccccccgccggcggccccccccccccccccggccccccccccccccccggccccccccccccccccggcctgccccccagcggcgtgcccgccgccgcccacggcgccggcggcggccccccccccgccccccccctgcccgccgcccagggccccggcggcggcggcgccggcgcccccggcctggccgccgccatcgccggcgccaagctgagaaaggtgagcaagcaggaggaggccagcggcggccccaccgcccccaaggccgagagcggcagaagcggcggcggcggcctgatggaggagatgaacgccatgctggccagaagaagaaaggccacccaggtgggcgagaagacccccaaggacgagagcgccaaccaggaggagcccgaggccagagtgcccgcccagagcgagagcgtgagaagaccctgggagaagaacagcaccaccctgcccagaatgaagagcagcagcagcgtgaccaccagcgagacccagccctgcacccccagcagcagcgactacagcgacctgcagagagtgaagcaggagctgctggaggaggtgaagaaggagctgcagaaggtgaaggaggagatcatcgaggccttcgtgcaggagctgagaaagagaggcagcccctag

SEQ ID NO: 13443 - DNA, 915 bp, Artificial Sequence
  Description of Artificial Sequence: Synthetic coding sequence
atggccggcaacttcgacagcgaggagagaagcagctggtactggggcagactgagcagacaggaggccgtggccctgctgcagggccagagacacggcgtgttcctggtgagagacagcagcaccagccccggcgactacgtgctgagcgtgagcgagaacagcagagtgagccactacatcatcaacagcagcggccccagaccccccgtgccccccagccccgcccagcccccccccggcgtgagccccagcagactgagaatcggcgaccaggagttcgacagcctgcccgccctgctggagttctacaagatccactacctggacaccaccaccctgatcgagcccgtgagcagaagcagacagggcagcggcgtgatcctgagacaggaggaggccgagtacgtgagagccctgttcgacttcaacggcaacgacgaggaggacctgcccttcaagaagggcgacatcctgagaatcagagacaagcccgaggagcagtggtggaacgccgaggacagcgagggcaagagaggcatgatccccgtgccctacgtggagaagtacagacccgccagcgccagcgtgagcgccctgatcggcggcaaccaggagggcagccacccccagcccctgggcggccccgagcccggcccctacgcccagcccagcgtgaacacccccctgcccaacctgcagaacggccccatctacgccagagtgatccagaagagagtgcccaacgcctacgacaagaccgccctggccctggaggtgggcgagctggtgaaggtgaccaagatcaacgtgagcggccagtgggagggcgagtgcaacggcaagagaggccacttccccttcacccacgtgagactgctggaccagcagaaccccgacgaggacttcagctag

SEQ ID NO: 13444 - DNA, 615 bp, Artificial Sequence
  Description of Artificial Sequence: Synthetic coding sequence
atggccggcaacttcgacagcgaggagagaagcagctggtactggggcagactgagcagacaggaggccgtggccctgctgcagggccagagacacggcgtgttcctggtgagagacagcagcaccagccccggcgactacgtgctgagcgtgagcgagaacagcagagtgagccactacatcatcaacagcagcggccccagaccccccgtgccccccagccccgcccagcccccccccggcgtgagccccagcagactgagaatcggcgaccaggagttcgacagcctgcccgccctgctggagttctacaagatccactacctggacaccaccaccctgatcgagcccgtgagcagaagcagacagggcagcggcgtgatcctgagacaggaggaggccgagtacgtgagagccctgttcgacttcaacggcaacgacgaggaggacctgcccttcaagaagggcgacatcctgagaatcagagacaagcccgaggagcagtggtggaacgccgaggacagcgagggcaagagaggcatgatccccgtgccctacgtggagaagtacagacccgccagcgccagcgtgagcgccctgatcggcggcagatag

SEQ ID NO: 13445 - DNA, 2196 bp, Artificial Sequence
  Description of Artificial Sequence: Synthetic coding sequence
tgaaagcccgccaccggcctgtgggtgtgggtgagcctgctggtggccgccggcaccgtgcagcccagcgacagccagagcgtgtgcgccggcaccgagaacaagctgagcagcctgagcgacctggagcagcagtacagagccctgagaaagtactacgagaactgcgaggtggtgatgggcaacctggagatcaccagcatcgagcacaacagagacctgagcttcctgagaagcgtgagagaggtgaccggctacgtgctggtggccctgaaccagttcagatacctgcccctggagaacctgagaatcatcagaggcaccaagctgtacgaggacagatacgccctggccatcttcctgaactacagaaaggacggcaacttcggcctgcaggagctgggcctgaagaacctgaccgagatcctgaacggcggcgtgtacgtggaccagaacaagttcctgtgctacgccgacaccatccactggcaggacatcgtgagaaacccctggcccagcaacctgaccctggtgagcaccaacggcagcagcggctgcggcagatgccacaagagctgcaccggcagatgctggggccccaccgagaaccactgccagaccctgaccagaaccgtgtgcgccgagcagtgcgacggcagatgctacggcccctacgtgagcgactgctgccacagagagtgcgccggcggctgcagcggccccaaggacaccgactgcttcgcctgcatgaacttcaacgacagcggcgcctgcgtgacccagtgcccccagaccttcgtgtacaaccccaccaccttccagctggagcacaacttcaacgccaagtacacctacggcgccttctgcgtgaagaagtgcccccacaacttcgtggtggacagcagcagctgcgtgagagcctgccccagcagcaagatggaggtggaggagaacggcatcaagatgtgcaagccctgcaccgacatctgccccaaggcctgcgacggcatcggcaccggcagcctgatgagcgcccagaccgtggacagcagcaacatcgacaagttcatcaactgcaccaagatcaacggcaacctgatcttcctggtgaccggcatccacggcgacccctacaacgccatcgaggccatcgaccccgagaagctgaacgtgttcagaaccgtgagagagatcaccggcttcctgaacatccagagctggccccccaacatgaccgacttcagcgtgttcagcaacctggtgaccatcggcggcagagtgctgtacagcggcctgagcctgctgatcctgaagcagcagggcatcaccagcctgcagttccagagcctgaaggagatcagcgccggcaacatctacatcaccgacaacagcaacctgtgctactaccacaccatcaactggaccaccctgttcagcaccatcaaccagagaatcgtgatcagagacaacagaaaggccgagaactgcaccgccgagggcatggtgtgcaaccacctgtgcagcagcgacggctgctggggccccggccccgaccagtgcctgagctgcagaagattcagcagaggcagaatctgcatcgagagctgcaacctgtacgacggcgagttcagagagttcgagaacggcagcatctgcgtggagtgcgacccccagtgcgagaagatggaggacggcctgctgacctgccacggccccggccccgacaactgcaccaagtgcagccacttcaaggacggccccaactgcgtggagaagtgccccgacggcctgcagggcgccaacagcttcatcttcaagtacgccgaccccgacagagagtgccacccctgccaccccaactgcacccagggctgcatcggcagcagcatcgaggactgcatcggcctgatggacagaacccccctgatcgccgccggcgtgatcggcggcctgttcatcctggtgatcgtgggcctgaccttcgccgtgtacgtgagaagaaagagcatcaagaagaagagagccctgagaagattcctggagaccgagctggtggagcccctgacccccagcggcaccgcccccaaccaggcccagctgagaatcctgaaggagaccgagctgaagagagtgaaggtgctgggcagcggcgccttcggcaccgtgtacaagggcatctgggtgcccgagggctag

SEQ ID NO: 13446 - DNA, 3927 bp, Artificial Sequence
  Description of Artificial Sequence: Synthetic coding sequence
atgaagcccgccaccggcctgtgggtgtgggtgagcctgctggtggccgccggcaccgtgcagcccagcgacagccagagcgtgtgcgccggcaccgagaacaagctgagcagcctgagcgacctggagcagcagtacagagccctgagaaagtactacgagaactgcgaggtggtgatgggcaacctggagatcaccagcatcgagcacaacagagacctgagcttcctgagaagcgtgagagaggtgaccggctacgtgctggtggccctgaaccagttcagatacctgcccctggagaacctgagaatcatcagaggcaccaagctgtacgaggacagatacgccctggccatcttcctgaactacagaaaggacggcaacttcggcctgcaggagctgggcctgaagaacctgaccgagatcctgaacggcggcgtgtacgtggaccagaacaagttcctgtgctacgccgacaccatccactggcaggacatcgtgagaaacccctggcccagcaacctgaccctggtgagcaccaacggcagcagcggctgcggcagatgccacaagagctgcaccggcagatgctggggccccaccgagaaccactgccagaccctgaccagaaccgtgtgcgccgagcagtgcgacggcagatgctacggcccctacgtgagcgactgctgccacagagagtgcgccggcggctgcagcggccccaaggacaccgactgcttcgcctgcatgaacttcaacgacagcggcgcctgcgtgacccagtgcccccagaccttcgtgtacaaccccaccaccttccagctggagcacaacttcaacgccaagtacacctacggcgccttctgcgtgaagaagtgcccccacaacttcgtggtggacagcagcagctgcgtgagagcctgccccagcagcaagatggaggtggaggagaacggcatcaagatgtgcaagccctgcaccgacatctgccccaaggcctgcgacggcatcggcaccggcagcctgatgagcgcccagaccgtggacagcagcaacatcgacaagttcatcaactgcaccaagatcaacggcaacctgatcttcctggtgaccggcatccacggcgacccctacaacgccatcgaggccatcgaccccgagaagctgaacgtgttcagaaccgtgagagagatcaccggcttcctgaacatccagagctggccccccaacatgaccgacttcagcgtgttcagcaacctggtgaccatcggcggcagagtgctgtacagcggcctgagcctgctgatcctgaagcagcagggcatcaccagcctgcagttccagagcctgaaggagatcagcgccggcaacatctacatcaccgacaacagcaacctgtgctactaccacaccatcaactggaccaccctgttcagcaccatcaaccagagaatcgtgatcagagacaacagaaaggccgagaactgcaccgccgagggcatggtgtgcaaccacctgtgcagcagcgacggctgctggggccccggccccgaccagtgcctgagctgcagaagattcagcagaggcagaatctgcatcgagagctgcaacctgtacgacggcgagttcagagagttcgagaacggcagcatctgcgtggagtgcgacccccagtgcgagaagatggaggacggcctgctgacctgccacggccccggccccgacaactgcaccaagtgcagccacttcaaggacggccccaactgcgtggagaagtgccccgacggcctgcagggcgccaacagcttcatcttcaagtacgccgaccccgacagagagtgccacccctgccaccccaactgcacccagggctgcaacggccccaccagccacgactgcatctactacccctggaccggccacagcaccctgccccagcacgccagaacccccctgatcgccgccggcgtgatcggcggcctgttcatcctggtgatcgtgggcctgaccttcgccgtgtacgtgagaagaaagagcatcaagaagaagagagccctgagaagattcctggagaccgagctggtggagcccctgacccccagcggcaccgcccccaaccaggcccagctgagaatcctgaaggagaccgagctgaagagagtgaaggtgctgggcagcggcgccttcggcaccgtgtacaagggcatctgggtgcccgagggcgagaccgtgaagatccccgtggccatcaagatcctgaacgagaccaccggccccaaggccaacgtggagttcatggacgaggccctgatcatggccagcatggaccacccccacctggtgagactgctgggcgtgtgcctgagccccaccatccagctggtgacccagctgatgccccacggctgcctgctggagtacgtgcacgagcacaaggacaacatcggcagccagctgctgctgaactggtgcgtgcagatcgccaagggcatgatgtacctggaggagagaagactggtgcacagagacctggccgccagaaacgtgctggtgaagagccccaaccacgtgaagatcaccgacttcggcctggccagactgctggagggcgacgagaaggagtacaacgccgacggcggcaagatgcccatcaagtggatggccctggagtgcatccactacagaaagttcacccaccagagcgacgtgtggagctacggcgtgaccatctgggagctgatgaccttcggcggcaagccctacgacggcatccccaccagagagatccccgacctgctggagaagggcgagagactgccccagccccccatctgcaccatcgacgtgtacatggtgatggtgaagtgctggatgatcgacgccgacagcagacccaagttcaaggagctggccgccgagttcagcagaatggccagagacccccagagatacctggtgatccagggcgacgacagaatgaagctgcccagccccaacgacagcaagttcttccagaacctgctggacgaggaggacctggaggacatgatggacgccgaggagtacctggtgccccaggccttcaacatccccccccccatctacaccagcagagccagaatcgacagcaacagaagcgagatcggccacagccccccccccgcctacacccccatgagcggcaaccagttcgtgtacagagacggcggcttcgccgccgagcagggcgtgagcgtgccctacagagcccccaccagcaccatccccgaggcccccgtggcccagggcgccaccgccgagatcttcgacgacagctgctgcaacggcaccctgagaaagcccgtggccccccacgtgcaggaggacagcagcacccagagatacagcgccgaccccaccgtgttcgcccccgagagaagccccagaggcgagctggacgaggagggctacatgacccccatgagagacaagcccaagcaggagtacctgaaccccgtggaggagaaccccttcgtgagcagaagaaagaacggcgacctgcaggccctggacaaccccgagtaccacaacgccagcaacggcccccccaaggccgaggacgagtacgtgaacgagcccctgtacctgaacaccttcgccaacaccctgggcaaggccgagtacctgaagaacaacatcctgagcatgcccgagaaggccaagaaggccttcgacaaccccgactactggaaccacagcctgccccccagaagcaccctgcagcaccccgactacctgcaggagtacagcaccaagtacttctacaagcagaacggcagaatcagacccatcgtggccgagaaccccgagtacctgagcgagttcagcctgaagcccggcaccgtgctgcccccccccccctacagacacagaaacaccgtggtgtag

SEQ ID NO: 13447 - DNA, 3897 bp, Artificial Sequence
  Description of Artificial Sequence: Synthetic coding sequence
atgaagcccgccaccggcctgtgggtgtgggtgagcctgctggtggccgccggcaccgtgcagcccagcgacagccagagcgtgtgcgccggcaccgagaacaagctgagcagcctgagcgacctggagcagcagtacagagccctgagaaagtactacgagaactgcgaggtggtgatgggcaacctggagatcaccagcatcgagcacaacagagacctgagcttcctgagaagcgtgagagaggtgaccggctacgtgctggtggccctgaaccagttcagatacctgcccctggagaacctgagaatcatcagaggcaccaagctgtacgaggacagatacgccctggccatcttcctgaactacagaaaggacggcaacttcggcctgcaggagctgggcctgaagaacctgaccgagatcctgaacggcggcgtgtacgtggaccagaacaagttcctgtgctacgccgacaccatccactggcaggacatcgtgagaaacccctggcccagcaacctgaccctggtgagcaccaacggcagcagcggctgcggcagatgccacaagagctgcaccggcagatgctggggccccaccgagaaccactgccagaccctgaccagaaccgtgtgcgccgagcagtgcgacggcagatgctacggcccctacgtgagcgactgctgccacagagagtgcgccggcggctgcagcggccccaaggacaccgactgcttcgcctgcatgaacttcaacgacagcggcgcctgcgtgacccagtgcccccagaccttcgtgtacaaccccaccaccttccagctggagcacaacttcaacgccaagtacacctacggcgccttctgcgtgaagaagtgcccccacaacttcgtggtggacagcagcagctgcgtgagagcctgccccagcagcaagatggaggtggaggagaacggcatcaagatgtgcaagccctgcaccgacatctgccccaaggcctgcgacggcatcggcaccggcagcctgatgagcgcccagaccgtggacagcagcaacatcgacaagttcatcaactgcaccaagatcaacggcaacctgatcttcctggtgaccggcatccacggcgacccctacaacgccatcgaggccatcgaccccgagaagctgaacgtgttcagaaccgtgagagagatcaccggcttcctgaacatccagagctggccccccaacatgaccgacttcagcgtgttcagcaacctggtgaccatcggcggcagagtgctgtacagcggcctgagcctgctgatcctgaagcagcagggcatcaccagcctgcagttccagagcctgaaggagatcagcgccggcaacatctacatcaccgacaacagcaacctgtgctactaccacaccatcaactggaccaccctgttcagcaccatcaaccagagaatcgtgatcagagacaacagaaaggccgagaactgcaccgccgagggcatggtgtgcaaccacctgtgcagcagcgacggctgctggggccccggccccgaccagtgcctgagctgcagaagattcagcagaggcagaatctgcatcgagagctgcaacctgtacgacggcgagttcagagagttcgagaacggcagcatctgcgtggagtgcgacccccagtgcgagaagatggaggacggcctgctgacctgccacggccccggccccgacaactgcaccaagtgcagccacttcaaggacggccccaactgcgtggagaagtgccccgacggcctgcagggcgccaacagcttcatcttcaagtacgccgaccccgacagagagtgccacccctgccaccccaactgcacccagggctgcatcggcagcagcatcgaggactgcatcggcctgatggacagaacccccctgatcgccgccggcgtgatcggcggcctgttcatcctggtgatcgtgggcctgaccttcgccgtgtacgtgagaagaaagagcatcaagaagaagagagccctgagaagattcctggagaccgagctggtggagcccctgacccccagcggcaccgcccccaaccaggcccagctgagaatcctgaaggagaccgagctgaagagagtgaaggtgctgggcagcggcgccttcggcaccgtgtacaagggcatctgggtgcccgagggcgagaccgtgaagatccccgtggccatcaagatcctgaacgagaccaccggccccaaggccaacgtggagttcatggacgaggccctgatcatggccagcatggaccacccccacctggtgagactgctgggcgtgtgcctgagccccaccatccagctggtgacccagctgatgccccacggctgcctgctggagtacgtgcacgagcacaaggacaacatcggcagccagctgctgctgaactggtgcgtgcagatcgccaagggcatgatgtacctggaggagagaagactggtgcacagagacctggccgccagaaacgtgctggtgaagagccccaaccacgtgaagatcaccgacttcggcctggccagactgctggagggcgacgagaaggagtacaacgccgacggcggcaagatgcccatcaagtggatggccctggagtgcatccactacagaaagttcacccaccagagcgacgtgtggagctacggcgtgaccatctgggagctgatgaccttcggcggcaagccctacgacggcatccccaccagagagatccccgacctgctggagaagggcgagagactgccccagccccccatctgcaccatcgacgtgtacatggtgatggtgaagtgctggatgatcgacgccgacagcagacccaagttcaaggagctggccgccgagttcagcagaatggccagagacccccagagatacctggtgatccagggcgacgacagaatgaagctgcccagccccaacgacagcaagttcttccagaacctgctggacgaggaggacctggaggacatgatggacgccgaggagtacctggtgccccaggccttcaacatccccccccccatctacaccagcagagccagaatcgacagcaacagaagcgagatcggccacagccccccccccgcctacacccccatgagcggcaaccagttcgtgtacagagacggcggcttcgccgccgagcagggcgtgagcgtgccctacagagcccccaccagcaccatccccgaggcccccgtggcccagggcgccaccgccgagatcttcgacgacagctgctgcaacggcaccctgagaaagcccgtggccccccacgtgcaggaggacagcagcacccagagatacagcgccgaccccaccgtgttcgcccccgagagaagccccagaggcgagctggacgaggagggctacatgacccccatgagagacaagcccaagcaggagtacctgaaccccgtggaggagaaccccttcgtgagcagaagaaagaacggcgacctgcaggccctggacaaccccgagtaccacaacgccagcaacggcccccccaaggccgaggacgagtacgtgaacgagcccctgtacctgaacaccttcgccaacaccctgggcaaggccgagtacctgaagaacaacatcctgagcatgcccgagaaggccaagaaggccttcgacaaccccgactactggaaccacagcctgccccccagaagcaccctgcagcaccccgactacctgcaggagtacagcaccaagtacttctacaagcagaacggcagaatcagacccatcgtggccgagaaccccgagtacctgagcgagttcagcctgaagcccggcaccgtgctgcccccccccccctacagacacagaaacaccgtggtgtag

SEQ ID NO: 13448 - DNA, 387 bp, Artificial Sequence
  Description of Artificial Sequence: Synthetic coding sequence
atgggcaacctggagatcaccagcatcgagcacaacagagacctgagcttcctgagaagcgtgagagaggtgaccggctacgtgctggtggccctgaaccagttcagatacctgcccctggagaacctgagaatcatcagaggcaccaagctgtacgaggacagatacgccctggccatcttcctgaactacagaaaggacggcaacttcggcctgcaggagctgggcctgaagaacctgaccgagatcctgaacggcggcgtgtacgtggaccagaacaagttcctgtgctacgccgacaccatccactggcaggacatcgtgagaaacccctggcccagcaacctgaccctggtgagcaccaacggcagcagcggctgcggctag

SEQ ID NO: 13449 - DNA, 3879 bp, Artificial Sequence
  Description of Artificial Sequence: Synthetic coding sequence
atgaagcccgccaccggcctgtgggtgtgggtgagcctgctggtggccgccggcaccgtgcagcccagcgacagccagagcgtgtgcgccggcaccgagaacaagctgagcagcctgagcgacctggagcagcagtacagagccctgagaaagtactacgagaactgcgaggtggtgatgggcaacctggagatcaccagcatcgagcacaacagagacctgagcttcctgagaagcgtgagagaggtgaccggctacgtgctggtggccctgaaccagttcagatacctgcccctggagaacctgagaatcatcagaggcaccaagctgtacgaggacagatacgccctggccatcttcctgaactacagaaaggacggcaacttcggcctgcaggagctgggcctgaagaacctgaccgagatcctgaacggcggcgtgtacgtggaccagaacaagttcctgtgctacgccgacaccatccactggcaggacatcgtgagaaacccctggcccagcaacctgaccctggtgagcaccaacggcagcagcggctgcggcagatgccacaagagctgcaccggcagatgctggggccccaccgagaaccactgccagaccctgaccagaaccgtgtgcgccgagcagtgcgacggcagatgctacggcccctacgtgagcgactgctgccacagagagtgcgccggcggctgcagcggccccaaggacaccgactgcttcgcctgcatgaacttcaacgacagcggcgcctgcgtgacccagtgcccccagaccttcgtgtacaaccccaccaccttccagctggagcacaacttcaacgccaagtacacctacggcgccttctgcgtgaagaagtgcccccacaacttcgtggtggacagcagcagctgcgtgagagcctgccccagcagcaagatggaggtggaggagaacggcatcaagatgtgcaagccctgcaccgacatctgccccaaggcctgcgacggcatcggcaccggcagcctgatgagcgcccagaccgtggacagcagcaacatcgacaagttcatcaactgcaccaagatcaacggcaacctgatcttcctggtgaccggcatccacggcgacccctacaacgccatcgaggccatcgaccccgagaagctgaacgtgttcagaaccgtgagagagatcaccggcttcctgaacatccagagctggccccccaacatgaccgacttcagcgtgttcagcaacctggtgaccatcggcggcagagtgctgtacagcggcctgagcctgctgatcctgaagcagcagggcatcaccagcctgcagttccagagcctgaaggagatcagcgccggcaacatctacatcaccgacaacagcaacctgtgctactaccacaccatcaactggaccaccctgttcagcaccatcaaccagagaatcgtgatcagagacaacagaaaggccgagaactgcaccgccgagggcatggtgtgcaaccacctgtgcagcagcgacggctgctggggccccggccccgaccagtgcctgagctgcagaagattcagcagaggcagaatctgcatcgagagctgcaacctgtacgacggcgagttcagagagttcgagaacggcagcatctgcgtggagtgcgacccccagtgcgagaagatggaggacggcctgctgacctgccacggccccggccccgacaactgcaccaagtgcagccacttcaaggacggccccaactgcgtggagaagtgccccgacggcctgcagggcgccaacagcttcatcttcaagtacgccgaccccgacagagagtgccacccctgccaccccaactgcacccagggctgcaacggccccaccagccacgactgcatctactacccctggaccggccacagcaccctgccccagcacgccagaacccccctgatcgccgccggcgtgatcggcggcctgttcatcctggtgatcgtgggcctgaccttcgccgtgtacgtgagaagaaagagcatcaagaagaagagagccctgagaagattcctggagaccgagctggtggagcccctgacccccagcggcaccgcccccaaccaggcccagctgagaatcctgaaggagaccgagctgaagagagtgaaggtgctgggcagcggcgccttcggcaccgtgtacaagggcatctgggtgcccgagggcgagaccgtgaagatccccgtggccatcaagatcctgaacgagaccaccggccccaaggccaacgtggagttcatggacgaggccctgatcatggccagcatggaccacccccacctggtgagactgctgggcgtgtgcctgagccccaccatccagctggtgacccagctgatgccccacggctgcctgctggagtacgtgcacgagcacaaggacaacatcggcagccagctgctgctgaactggtgcgtgcagatcgccaagggcatgatgtacctggaggagagaagactggtgcacagagacctggccgccagaaacgtgctggtgaagagccccaaccacgtgaagatcaccgacttcggcctggccagactgctggagggcgacgagaaggagtacaacgccgacggcggcaagatgcccatcaagtggatggccctggagtgcatccactacagaaagttcacccaccagagcgacgtgtggagctacggcgtgaccatctgggagctgatgaccttcggcggcaagccctacgacggcatccccaccagagagatccccgacctgctggagaagggcgagagactgccccagccccccatctgcaccatcgacgtgtacatggtgatggtgaagtgctggatgatcgacgccgacagcagacccaagttcaaggagctggccgccgagttcagcagaatggccagagacccccagagatacctggtgatccagggcgacgacagaatgaagctgcccagccccaacgacagcaagttcttccagaacctgctggacgaggaggacctggaggacatgatggacgccgaggagtacctggtgccccaggccttcaacatccccccccccatctacaccagcagagccagaatcgacagcaacagaaaccagttcgtgtacagagacggcggcttcgccgccgagcagggcgtgagcgtgccctacagagcccccaccagcaccatccccgaggcccccgtggcccagggcgccaccgccgagatcttcgacgacagctgctgcaacggcaccctgagaaagcccgtggccccccacgtgcaggaggacagcagcacccagagatacagcgccgaccccaccgtgttcgcccccgagagaagccccagaggcgagctggacgaggagggctacatgacccccatgagagacaagcccaagcaggagtacctgaaccccgtggaggagaaccccttcgtgagcagaagaaagaacggcgacctgcaggccctggacaaccccgagtaccacaacgccagcaacggcccccccaaggccgaggacgagtacgtgaacgagcccctgtacctgaacaccttcgccaacaccctgggcaaggccgagtacctgaagaacaacatcctgagcatgcccgagaaggccaagaaggccttcgacaaccccgactactggaaccacagcctgccccccagaagcaccctgcagcaccccgactacctgcaggagtacagcaccaagtacttctacaagcagaacggcagaatcagacccatcgtggccgagaaccccgagtacctgagcgagttcagcctgaagcccggcaccgtgctgcccccccccccctacagacacagaaacaccgtggtgtag

SEQ ID NO: 13450 - DNA, 4029 bp, Artificial Sequence
  Description of Artificial Sequence: Synthetic coding sequence
atgagagccaacgacgccctgcaggtgctgggcctgctgttcagcctggccagaggcagcgaggtgggcaacagccaggccgtgtgccccggcaccctgaacggcctgagcgtgaccggcgacgccgagaaccagtaccagaccctgtacaagctgtacgagagatgcgaggtggtgatgggcaacctggagatcgtgctgaccggccacaacgccgacctgagcttcctgcagtggatcagagaggtgaccggctacgtgctggtggccatgaacgagttcagcaccctgcccctgcccaacctgagagtggtgagaggcacccaggtgtacgacggcaagttcgccatcttcgtgatgctgaactacaacaccaacagcagccacgccctgagacagctgagactgacccagctgaccgagatcctgagcggcggcgtgtacatcgagaagaacgacaagctgtgccacatggacaccatcgactggagagacatcgtgagagacagagacgccgagatcgtggtgaaggacaacggcagaagctgccccccctgccacgaggtgtgcaagggcagatgctggggccccggcagcgaggactgccagaccctgaccaagaccatctgcgccccccagtgcaacggccactgcttcggccccaaccccaaccagtgctgccacgacgagtgcgccggcggctgcagcggcccccaggacaccgactgcttcgcctgcagacacttcaacgacagcggcgcctgcgtgcccagatgcccccagcccctggtgtacaacaagctgaccttccagctggagcccaacccccacaccaagtaccagtacggcggcgtgtgcgtggccagctgcccccacaacttcgtggtggaccagaccagctgcgtgagagcctgcccccccgacaagatggaggtggacaagaacggcctgaagatgtgcgagccctgcggcggcctgtgccccaaggcctgcgagggcaccggcagcggcagcagattccagaccgtggacagcagcaacatcgacggcttcgtgaactgcaccaagatcctgggcaacctggacttcctgatcaccggcctgaacggcgacccctggcacaagatccccgccctggaccccgagaagctgaacgtgttcagaaccgtgagagagatcaccggctacctgaacatccagagctggcccccccacatgcacaacttcagcgtgttcagcaacctgaccaccatcggcggcagaagcctgtacaacagaggcttcagcctgctgatcatgaagaacctgaacgtgaccagcctgggcttcagaagcctgaaggagatcagcgccggcagaatctacatcagcgccaacagacagctgtgctaccaccacagcctgaactggaccaaggtgctgagaggccccaccgaggagagactggacatcaagcacaacagacccagaagagactgcgtggccgagggcaaggtgtgcgaccccctgtgcagcagcggcggctgctggggccccggccccggccagtgcctgagctgcagaaactacagcagaggcggcgtgtgcgtgacccactgcaacttcctgaacggcgagcccagagagttcgcccacgaggccgagtgcttcagctgccaccccgagtgccagcccatggagggcaccgccacctgcaacggcagcggcagcgacacctgcgcccagtgcgcccacttcagagacggcccccactgcgtgagcagctgcccccacggcgtgctgggcgccaagggccccatctacaagtaccccgacgtgcagaacgagtgcagaccctgccacgagaactgcacccagggctgcaagggccccgagctgcaggactgcctgggccagaccctggtgctgatcggcaagacccacctgaccatggccctgaccgtgatcgccggcctggtggtgatcttcatgatgctgggcggcaccttcctgtactggagaggcagaagaatccagaacaagagagccatgagaagatacctggagagaggcgagagcatcgagcccctggaccccagcgagaaggccaacaaggtgctggccagaatcttcaaggagaccgagctgagaaagctgaaggtgctgggcagcggcgtgttcggcaccgtgcacaagggcgtgtggatccccgagggcgagagcatcaagatccccgtgtgcatcaaggtgatcgaggacaagagcggcagacagagcttccaggccgtgaccgaccacatgctggccatcggcagcctggaccacgcccacatcgtgagactgctgggcctgtgccccggcagcagcctgcagctggtgacccagtacctgcccctgggcagcctgctggaccacgtgagacagcacagaggcgccctgggcccccagctgctgctgaactggggcgtgcagatcgccaagggcatgtactacctggaggagcacggcatggtgcacagaaacctggccgccagaaacgtgctgctgaagagccccagccaggtgcaggtggccgacttcggcgtggccgacctgctgccccccgacgacaagcagctgctgtacagcgaggccaagacccccatcaagtggatggccctggagagcatccacttcggcaagtacacccaccagagcgacgtgtggagctacggcgtgaccgtgtgggagctgatgaccttcggcgccgagccctacgccggcctgagactggccgaggtgcccgacctgctggagaagggcgagagactggcccagccccagatctgcaccatcgacgtgtacatggtgatggtgaagtgctggatgatcgacgagaacatcagacccaccttcaaggagctggccaacgagttcaccagaatggccagagacccccccagatacctggtgatcaagagagagagcggccccggcatcgcccccggccccgagccccacggcctgaccaacaagaagctggaggaggtggagctggagcccgagctggacctggacctggacctggaggccgaggaggacaacctggccaccaccaccctgggcagcgccctgagcctgcccgtgggcaccctgaacagacccagaggcagccagagcctgctgagccccagcagcggctacatgcccatgaaccagggcaacctgggcgagagctgccaggagagcgccgtgagcggcagcagcgagagatgccccagacccgtgagcctgcaccccatgcccagaggctgcctggccagcgagagcagcgagggccacgtgaccggcagcgaggccgagctgcaggagaaggtgagcatgtgcagaagcagaagcagaagcagaagccccagacccagaggcgacagcgcctaccacagccagagacacagcctgctgacccccgtgacccccctgagcccccccggcctggaggaggaggacgtgaacggctacgtgatgcccgacacccacctgaagggcacccccagcagcagagagggcaccctgagcagcgtgggcctgagcagcgtgctgggcaccgaggaggaggacgaggacgaggagtacgagtacatgaacagaagaagaagacacagccccccccacccccccagacccagcagcctggaggagctgggctacgagtacatggacgtgggcagcgacctgagcgccagcctgggcagcacccagagctgccccctgcaccccgtgcccatcatgcccaccgccggcaccacccccgacgaggactacgagtacatgaacagacagagagacggcggcggccccggcggcgactacgccgccatgggcgcctgccccgccagcgagcagggctacgaggagatgagagccttccagggccccggccaccaggccccccacgtgcactacgccagactgaagaccctgagaagcctggaggccaccgacagcgccttcgacaaccccgactactggcacagcagactgttccccaaggccaacgcccagagaacctag

SEQ ID NO: 13451 - DNA, 996 bp, Artificial Sequence
  Description of Artificial Sequence: Synthetic coding sequence
atgagagccaacgacgccctgcaggtgctgggcctgctgttcagcctggccagaggcagcgaggtgggcaacagccaggccgtgtgccccggcaccctgaacggcctgagcgtgaccggcgacgccgagaaccagtaccagaccctgtacaagctgtacgagagatgcgaggtggtgatgggcaacctggagatcgtgctgaccggccacaacgccgacctgagcttcctgcagtggatcagagaggtgaccggctacgtgctggtggccatgaacgagttcagcaccctgcccctgcccaacctgagagtggtgagaggcacccaggtgtacgacggcaagttcgccatcttcgtgatgctgaactacaacaccaacagcagccacgccctgagacagctgagactgacccagctgaccgagatcctgagcggcggcgtgtacatcgagaagaacgacaagctgtgccacatggacaccatcgactggagagacatcgtgagagacagagacgccgagatcgtggtgaaggacaacggcagaagctgccccccctgccacgaggtgtgcaagggcagatgctggggccccggcagcgaggactgccagaccctgaccaagaccatctgcgccccccagtgcaacggccactgcttcggccccaaccccaaccagtgctgccacgacgagtgcgccggcggctgcagcggcccccaggacaccgactgcttcgcctgcagacacttcaacgacagcggcgcctgcgtgcccagatgcccccagcccctggtgtacaacaagctgaccttccagctggagcccaacccccacaccaagtaccagtacggcggcgtgtgcgtggccagctgcccccacaacttcgtggtggaccagaccagctgcgtgagagcctgcccccccgacaagatggaggtggacaagaacggcctgaagatgtgcgagccctgcggcggcctgtgccccaaggtgttctag

SEQ ID NO: 13452 - DNA, 552 bp, Artificial Sequence
  Description of Artificial Sequence: Synthetic coding sequence
atgagagccaacgacgccctgcaggtgctgggcctgctgttcagcctggccagaggcagcgaggtgggcaacagccaggccgtgtgccccggcaccctgaacggcctgagcgtgaccggcgacgccgagaaccagtaccagaccctgtacaagctgtacgagagatgcgaggtggtgatgggcaacctggagatcgtgctgaccggccacaacgccgacctgagcttcctgcagtggatcagagaggtgaccggctacgtgctggtggccatgaacgagttcagcaccctgcccctgcccaacctgagagtggtgagaggcacccaggtgtacgacggcaagttcgccatcttcgtgatgctgaactacaacaccaacagcagccacgccctgagacagctgagactgacccagctgaccggccagttccccatggtgcccagcggcctgaccccccagcccgcccaggactggtacctgctggacgacgaccccagactgctgaccctgagcgccagcagcaaggtgcccgtgaccctggccgccgtgtag

SEQ ID NO: 13453 - DNA, 3852 bp, Artificial Sequence
  Description of Artificial Sequence: Synthetic coding sequence
atgggcaacctggagatcgtgctgaccggccacaacgccgacctgagcttcctgcagtggatcagagaggtgaccggctacgtgctggtggccatgaacgagttcagcaccctgcccctgcccaacctgagagtggtgagaggcacccaggtgtacgacggcaagttcgccatcttcgtgatgctgaactacaacaccaacagcagccacgccctgagacagctgagactgacccagctgaccgagatcctgagcggcggcgtgtacatcgagaagaacgacaagctgtgccacatggacaccatcgactggagagacatcgtgagagacagagacgccgagatcgtggtgaaggacaacggcagaagctgccccccctgccacgaggtgtgcaagggcagatgctggggccccggcagcgaggactgccagaccctgaccaagaccatctgcgccccccagtgcaacggccactgcttcggccccaaccccaaccagtgctgccacgacgagtgcgccggcggctgcagcggcccccaggacaccgactgcttcgcctgcagacacttcaacgacagcggcgcctgcgtgcccagatgcccccagcccctggtgtacaacaagctgaccttccagctggagcccaacccccacaccaagtaccagtacggcggcgtgtgcgtggccagctgcccccacaacttcgtggtggaccagaccagctgcgtgagagcctgcccccccgacaagatggaggtggacaagaacggcctgaagatgtgcgagccctgcggcggcctgtgccccaaggcctgcgagggcaccggcagcggcagcagattccagaccgtggacagcagcaacatcgacggcttcgtgaactgcaccaagatcctgggcaacctggacttcctgatcaccggcctgaacggcgacccctggcacaagatccccgccctggaccccgagaagctgaacgtgttcagaaccgtgagagagatcaccggctacctgaacatccagagctggcccccccacatgcacaacttcagcgtgttcagcaacctgaccaccatcggcggcagaagcctgtacaacagaggcttcagcctgctgatcatgaagaacctgaacgtgaccagcctgggcttcagaagcctgaaggagatcagcgccggcagaatctacatcagcgccaacagacagctgtgctaccaccacagcctgaactggaccaaggtgctgagaggccccaccgaggagagactggacatcaagcacaacagacccagaagagactgcgtggccgagggcaaggtgtgcgaccccctgtgcagcagcggcggctgctggggccccggccccggccagtgcctgagctgcagaaactacagcagaggcggcgtgtgcgtgacccactgcaacttcctgaacggcgagcccagagagttcgcccacgaggccgagtgcttcagctgccaccccgagtgccagcccatggagggcaccgccacctgcaacggcagcggcagcgacacctgcgcccagtgcgcccacttcagagacggcccccactgcgtgagcagctgcccccacggcgtgctgggcgccaagggccccatctacaagtaccccgacgtgcagaacgagtgcagaccctgccacgagaactgcacccagggctgcaagggccccgagctgcaggactgcctgggccagaccctggtgctgatcggcaagacccacctgaccatggccctgaccgtgatcgccggcctggtggtgatcttcatgatgctgggcggcaccttcctgtactggagaggcagaagaatccagaacaagagagccatgagaagatacctggagagaggcgagagcatcgagcccctggaccccagcgagaaggccaacaaggtgctggccagaatcttcaaggagaccgagctgagaaagctgaaggtgctgggcagcggcgtgttcggcaccgtgcacaagggcgtgtggatccccgagggcgagagcatcaagatccccgtgtgcatcaaggtgatcgaggacaagagcggcagacagagcttccaggccgtgaccgaccacatgctggccatcggcagcctggaccacgcccacatcgtgagactgctgggcctgtgccccggcagcagcctgcagctggtgacccagtacctgcccctgggcagcctgctggaccacgtgagacagcacagaggcgccctgggcccccagctgctgctgaactggggcgtgcagatcgccaagggcatgtactacctggaggagcacggcatggtgcacagaaacctggccgccagaaacgtgctgctgaagagccccagccaggtgcaggtggccgacttcggcgtggccgacctgctgccccccgacgacaagcagctgctgtacagcgaggccaagacccccatcaagtggatggccctggagagcatccacttcggcaagtacacccaccagagcgacgtgtggagctacggcgtgaccgtgtgggagctgatgaccttcggcgccgagccctacgccggcctgagactggccgaggtgcccgacctgctggagaagggcgagagactggcccagccccagatctgcaccatcgacgtgtacatggtgatggtgaagtgctggatgatcgacgagaacatcagacccaccttcaaggagctggccaacgagttcaccagaatggccagagacccccccagatacctggtgatcaagagagagagcggccccggcatcgcccccggccccgagccccacggcctgaccaacaagaagctggaggaggtggagctggagcccgagctggacctggacctggacctggaggccgaggaggacaacctggccaccaccaccctgggcagcgccctgagcctgcccgtgggcaccctgaacagacccagaggcagccagagcctgctgagccccagcagcggctacatgcccatgaaccagggcaacctgggcgagagctgccaggagagcgccgtgagcggcagcagcgagagatgccccagacccgtgagcctgcaccccatgcccagaggctgcctggccagcgagagcagcgagggccacgtgaccggcagcgaggccgagctgcaggagaaggtgagcatgtgcagaagcagaagcagaagcagaagccccagacccagaggcgacagcgcctaccacagccagagacacagcctgctgacccccgtgacccccctgagcccccccggcctggaggaggaggacgtgaacggctacgtgatgcccgacacccacctgaagggcacccccagcagcagagagggcaccctgagcagcgtgggcctgagcagcgtgctgggcaccgaggaggaggacgaggacgaggagtacgagtacatgaacagaagaagaagacacagccccccccacccccccagacccagcagcctggaggagctgggctacgagtacatggacgtgggcagcgacctgagcgccagcctgggcagcacccagagctgccccctgcaccccgtgcccatcatgcccaccgccggcaccacccccgacgaggactacgagtacatgaacagacagagagacggcggcggccccggcggcgactacgccgccatgggcgcctgccccgccagcgagcagggctacgaggagatgagagccttccagggccccggccaccaggccccccacgtgcactacgccagactgaagaccctgagaagcctggaggccaccgacagcgccttcgacaaccccgactactggcacagcagactgttccccaaggccaacgcccagagaacctag

SEQ ID NO: 13454 - DNA, 2100 bp, Artificial Sequence
  Description of Artificial Sequence: Synthetic coding sequence
atggccctgaccgtgatcgccggcctggtggtgatcttcatgatgctgggcggcaccttcctgtactggagaggcagaagaatccagaacaagagagccatgagaagatacctggagagaggcgagagcatcgagcccctggaccccagcgagaaggccaacaaggtgctggccagaatcttcaaggagaccgagctgagaaagctgaaggtgctgggcagcggcgtgttcggcaccgtgcacaagggcgtgtggatccccgagggcgagagcatcaagatccccgtgtgcatcaaggtgatcgaggacaagagcggcagacagagcttccaggccgtgaccgaccacatgctggccatcggcagcctggaccacgcccacatcgtgagactgctgggcctgtgccccggcagcagcctgcagctggtgacccagtacctgcccctgggcagcctgctggaccacgtgagacagcacagaggcgccctgggcccccagctgctgctgaactggggcgtgcagatcgccaagggcatgtactacctggaggagcacggcatggtgcacagaaacctggccgccagaaacgtgctgctgaagagccccagccaggtgcaggtggccgacttcggcgtggccgacctgctgccccccgacgacaagcagctgctgtacagcgaggccaagacccccatcaagtggatggccctggagagcatccacttcggcaagtacacccaccagagcgacgtgtggagctacggcgtgaccgtgtgggagctgatgaccttcggcgccgagccctacgccggcctgagactggccgaggtgcccgacctgctggagaagggcgagagactggcccagccccagatctgcaccatcgacgtgtacatggtgatggtgaagtgctggatgatcgacgagaacatcagacccaccttcaaggagctggccaacgagttcaccagaatggccagagacccccccagatacctggtgatcaagagagagagcggccccggcatcgcccccggccccgagccccacggcctgaccaacaagaagctggaggaggtggagctggagcccgagctggacctggacctggacctggaggccgaggaggacaacctggccaccaccaccctgggcagcgccctgagcctgcccgtgggcaccctgaacagacccagaggcagccagagcctgctgagccccagcagcggctacatgcccatgaaccagggcaacctgggcgagagctgccaggagagcgccgtgagcggcagcagcgagagatgccccagacccgtgagcctgcaccccatgcccagaggctgcctggccagcgagagcagcgagggccacgtgaccggcagcgaggccgagctgcaggagaaggtgagcatgtgcagaagcagaagcagaagcagaagccccagacccagaggcgacagcgcctaccacagccagagacacagcctgctgacccccgtgacccccctgagcccccccggcctggaggaggaggacgtgaacggctacgtgatgcccgacacccacctgaagggcacccccagcagcagagagggcaccctgagcagcgtgggcctgagcagcgtgctgggcaccgaggaggaggacgaggacgaggagtacgagtacatgaacagaagaagaagacacagccccccccacccccccagacccagcagcctggaggagctgggctacgagtacatggacgtgggcagcgacctgagcgccagcctgggcagcacccagagctgccccctgcaccccgtgcccatcatgcccaccgccggcaccacccccgacgaggactacgagtacatgaacagacagagagacggcggcggccccggcggcgactacgccgccatgggcgcctgccccgccagcgagcagggctacgaggagatgagagccttccagggccccggccaccaggccccccacgtgcactacgccagactgaagaccctgagaagcctggaggccaccgacagcgccttcgacaaccccgactactggcacagcagactgttccccaaggccaacgcccagagaacctag

SEQ ID NO: 13455 - DNA, 381 bp, Artificial Sequence
  Description of Artificial Sequence: Synthetic coding sequence
atgagagccaacgacgccctgcaggtgctgggcctgctgttcagcctggccagaggcagcgaggtgggcaacagccaggccgtgtgccccggcaccctgaacggcctgagcgtgaccggcgacgccgagaaccagtaccagaccctgtacaagctgtacgagagatgcgaggtggtgatgggcaacctggagatcgtgctgaccggccacaacgccgacctgagcttcctgcagtggatcagagaggtgaccggctacgtgctggtggccatgaacgagttcagcaccctgcccctgcccaacctgagagtggtgagaggcacccaggtgtacgacggcaagttcgccatcttcgtgatgctgaactacaacaccaactag

SEQ ID NO: 13456 - DNA, 2766 bp, Artificial Sequence
  Description of Artificial Sequence: Synthetic coding sequence
atgagagccaacgacgccctgcaggtgctgggcctgctgttcagcctggccagaggcagcgaggtgggcaacagccaggccgtgtgccccggcaccctgaacggcctgagcgtgaccggcgacgccgagaaccagtaccagaccctgtacaagctgtacgagagatgcgaggtggtgatgggcaacctggagatcgtgctgaccggccacaacgccgacctgagcttcctgcagtggatcagagaggtgaccggctacgtgctggtggccatgaacgagttcagcaccctgcccctgcccaacctgagagtggtgagaggcacccaggtgtacgacggcaagttcgccatcttcgtgatgctgaactacaacaccaacagcagccacgccctgagacagctgagactgacccagctgaccgagatcctgagcggcggcgtgtacatcgagaagaacgacaagctgtgccacatggacaccatcgactggagagacatcgtgagagacagagacgccgagatcgtggtgaaggacaacggcagaagctgccccccctgccacgaggtgtgcaagggcagatgctggggccccggcagcgaggactgccagaccctgaccaagaccatctgcgccccccagtgcaacggccactgcttcggccccaaccccaaccagtgctgccacgacgagtgcgccggcggctgcagcggcccccaggacaccgactgcttcgcctgcagacacttcaacgacagcggcgcctgcgtgcccagatgcccccagcccctggtgtacaacaagctgaccttccagctggagcccaacccccacaccaagtaccagtacggcggcgtgtgcgtggccagctgcccccacaacttcgtggtggaccagaccagctgcgtgagagcctgcccccccgacaagatggaggtggacaagaacggcctgaagatgtgcgagccctgcggcggcctgtgccccaaggcctgcgagggcaccggcagcggcagcagattccagaccgtggacagcagcaacatcgacggcttcgtgaactgcaccaagatcctgggcaacctggacttcctgatcaccggcctgaacggcgacccctggcacaagatccccgccctggaccccgagaagctgaacgtgttcagaaccgtgagagagatcaccggctacctgaacatccagagctggcccccccacatgcacaacttcagcgtgttcagcaacctgaccaccatcggcggcagaagcctgtacaacagaggcttcagcctgctgatcatgaagaacctgaacgtgaccagcctgggcttcagaagcctgaaggagatcagcgccggcagaatctacatcagcgccaacagacagctgtgctaccaccacagcctgaactggaccaaggtgctgagaggccccaccgaggagagactggacatcaagcacaacagacccagaagagactgcgtggccgagggcaaggtgtgcgaccccctgtgcagcagcggcggctgctggggccccggccccggccagtgcctgagctgcagaaactacagcagaggcggcgtgtgcgtgacccactgcaacttcctgaacggcgagcccagagagttcgcccacgaggccgagtgcttcagctgccaccccgagtgccagcccatggagggcaccgccacctgcaacggcagcggcagcgacacctgcgcccagtgcgcccacttcagagacggcccccactgcgtgagcagctgcccccacggcgtgctgggcgccaagggccccatctacaagtaccccgacgtgcagaacgagtgcagaccctgccacgagaactgcacccagggctgcaagggccccgagctgcaggactgcctgggccagaccctggtgctgatcggcaagacccacctgaccatggccctgaccgtgatcgccggcctggtggtgatcttcatgatgctgggcggcaccttcctgtactggagaggcagaagaatccagaacaagagagccatgagaagatacctggagagaggcgagagcatcgagcccctggaccccagcgagaaggccaacaaggtgctggccagaatcttcaaggagaccgagctgagaaagctgaaggtgctgggcagcggcgtgttcggcaccgtgcacaagggcgtgtggatccccgagggcgagagcatcaagatccccgtgtgcatcaaggtgatcgaggacaagagcggcagacagagcttccaggccgtgaccgaccacatgctggccatcggcagcctggaccacgcccacatcgtgagactgctgggcctgtgccccggcagcagcctgcagctggtgacccagtacctgcccctgggcagcctgctggaccacgtgagacagcacagaggcgccctgggcccccagctgctgctgaactggggcgtgcagatcgccaagggcatgtactacctggaggagcacggcatggtgcacagaaacctggccgccagaaacgtgctgctgaagagccccagccaggtgcaggtggccgacttcggcgtggccgacctgctgccccccgacgacaagcagctgctgtacagcgaggccaagacccccatcaagtggatggccctggagagcatccacttcggcaagtacacccaccagagcgacgtgtggagctacggccagtgcatctggatgcccagcctgcccagcctggcccccgtgagcaacctgcccttcgagacccccagctag

SEQ ID NO: 13457 - DNA, 10191 bp, Artificial Sequence
  Description of Artificial Sequence: Synthetic coding sequence
atgttcatcaacatcaagagcatcctgtggatgtgcagcaccctgatcgtgacccacgccctgcacaaggtgaaggtgggcaagagcccccccgtgagaggcagcctgagcggcaaggtgagcctgccctgccacttcagcaccatgcccaccctgccccccagctacaacaccagcgagttcctgagaatcaagtggagcaagatcgaggtggacaagaacggcaaggacctgaaggagaccaccgtgctggtggcccagaacggcaacatcaagatcggccaggactacaagggcagagtgagcgtgcccacccaccccgaggccgtgggcgacgccagcctgaccgtggtgaagctgctggccagcgacgccggcctgtacagatgcgacgtgatgtacggcatcgaggacacccaggacaccgtgagcctgaccgtggacggcgtggtgttccactacagagccgccaccagcagatacaccctgaacttcgaggccgcccagaaggcctgcctggacgtgggcgccgtgatcgccacccccgagcagctgttcgccgcctacgaggacggcttcgagcagtgcgacgccggctggctggccgaccagaccgtgagataccccatcagagcccccagagtgggctgctacggcgacaagatgggcaaggccggcgtgagaacctacggcttcagaagcccccaggagacctacgacgtgtactgctacgtggaccacctggacggcgacgtgttccacctgaccgtgcccagcaagttcaccttcgaggaggccgccaaggagtgcgagaaccaggacgccagactggccaccgtgggcgagctgcaggccgcctggagaaacggcttcgaccagtgcgactacggctggctgagcgacgccagcgtgagacaccccgtgaccgtggccagagcccagtgcggcggcggcctgctgggcgtgagaaccctgtacagattcgagaaccagaccggcttccccccccccgacagcagattcgacgcctactgcttcaagcccaaggaggccaccaccatcgacctgagcatcctggccgagaccgccagccccagcctgagcaaggagccccagatggtgagcgacagaaccacccccatcatccccctggtggacgagctgcccgtgatccccaccgagttcccccccgtgggcaacatcgtgagcttcgagcagaaggccaccgtgcagccccaggccatcaccgacagcctggccaccaagctgcccacccccaccggcagcaccaagaagccctgggacatggacgactacagccccagcgccagcggccccctgggcaagctggacatcagcgagatcaaggaggaggtgctgcagagcaccaccggcgtgagccactacgccaccgacagctgggacggcgtggtggaggacaagcagacccaggagagcgtgacccagatcgagcagatcgaggtgggccccctggtgaccagcatggagatcctgaagcacatccccagcaaggagttccccgtgaccgagacccccctggtgaccgccagaatgatcctggagagcaagaccgagaagaagatggtgagcaccgtgagcgagctggtgaccaccggccactacggcttcaccctgggcgaggaggacgacgaggacagaaccctgaccgtgggcagcgacgagagcaccctgatcttcgaccagatccccgaggtgatcaccgtgagcaagaccagcgaggacaccatccacacccacctggaggacctggagagcgtgagcgccagcaccaccgtgagccccctgatcatgcccgacaacaacggcagcagcatggacgactgggaggagagacagaccagcggcagaatcaccgaggagttcctgggcaagtacctgagcaccacccccttccccagccagcacagaaccgagatcgagctgttcccctacagcggcgacaagatcctggtggagggcatcagcaccgtgatctaccccagcctgcagaccgagatgacccacagaagagagagaaccgagaccctgatccccgagatgagaaccgacacctacaccgacgagatccaggaggagatcaccaagagccccttcatgggcaagaccgaggaggaggtgttcagcggcatgaagctgagcaccagcctgagcgagcccatccacgtgaccgagagcagcgtggagatgaccaagagcttcgacttccccaccctgatcaccaagctgagcgccgagcccaccgaggtgagagacatggaggaggacttcaccgccacccccggcaccaccaagtacgacgagaacatcaccaccgtgctgctggcccacggcaccctgagcgtggaggccgccaccgtgagcaagtggagctgggacgaggacaacaccaccagcaagcccctggagagcaccgagcccagcgccagcagcaagctgccccccgccctgctgaccaccgtgggcatgaacggcaaggacaaggacatccccagcttcaccgaggacggcgccgacgagttcaccctgatccccgacagcacccagaagcagctggaggaggtgaccgacgaggacatcgccgcccacggcaagttcaccatcagattccagcccaccaccagcaccggcatcgccgagaagagcaccctgagagacagcaccaccgaggagaaggtgccccccatcaccagcaccgagggccaggtgtacgccaccatggagggcagcgccctgggcgaggtggaggacgtggacctgagcaagcccgtgagcaccgtgccccagttcgcccacaccagcgaggtggagggcctggccttcgtgagctacagcagcacccaggagcccaccacctacgtggacagcagccacaccatccccctgagcgtgatccccaagaccgactggggcgtgctggtgcccagcgtgcccagcgaggacgaggtgctgggcgagcccagccaggacatcctggtgatcgaccagaccagactggaggccaccatcagccccgagaccatgagaaccaccaagatcaccgagggcaccacccaggaggagttcccctggaaggagcagaccgccgagaagcccgtgcccgccctgagcagcaccgcctggacccccaaggaggccgtgacccccctggacgagcaggagggcgacggcagcgcctacaccgtgagcgaggacgagctgctgaccggcagcgagagagtgcccgtgctggagaccacccccgtgggcaagatcgaccacagcgtgagctacccccccggcgccgtgaccgagcacaaggtgaagaccgacgaggtggtgaccctgacccccagaatcggccccaaggtgagcctgagccccggccccgagcagaagtacgagaccgagggcagcagcaccaccggcttcaccagcagcctgagccccttcagcacccacatcacccagctgatggaggagaccaccaccgagaagaccagcctggaggacatcgacctgggcagcggcctgttcgagaagcccaaggccaccgagctgatcgagttcagcaccatcaaggtgaccgtgcccagcgacatcaccaccgccttcagcagcgtggacagactgcacaccaccagcgccttcaagcccagcagcgccatcaccaagaagccccccctgatcgacagagagcccggcgaggagaccaccagcgacatggtgatcatcggcgagagcaccagccacgtgccccccaccaccctggaggacatcgtggccaaggagaccgagaccgacatcgacagagagtacttcaccaccagcagcccccccgccacccagcccaccagaccccccaccgtggaggacaaggaggccttcggcccccaggccctgagcaccccccagccccccgccagcaccaagttccaccccgacatcaacgtgtacatcatcgaggtgagagagaacaagaccggcagaatgagcgacctgagcgtgatcggccaccccatcgacagcgagagcaaggaggacgagccctgcagcgaggagaccgaccccgtgcacgacctgatggccgagatcctgcccgagttccccgacatcatcgagatcgacctgtaccacagcgaggagaacgaggaggaggaggaggagtgcgccaacgccaccgacgtgaccaccacccccagcgtgcagtacatcaacggcaagcacctggtgaccaccgtgcccaaggaccccgaggccgccgaggccagaagaggccagttcgagagcgtggcccccagccagaacttcagcgacagcagcgagagcgacacccaccccttcgtgatcgccaagaccgagctgagcaccgccgtgcagcccaacgagagcaccgagaccaccgagagcctggaggtgacctggaagcccgagacctaccccgagaccagcgagcacttcagcggcggcgagcccgacgtgttccccaccgtgcccttccacgaggagttcgagagcggcaccgccaagaagggcgccgagagcgtgaccgagagagacaccgaggtgggccaccaggcccacgagcacaccgagcccgtgagcctgttccccgaggagagcagcggcgagatcgccatcgaccaggagagccagaagatcgccttcgccagagccaccgaggtgaccttcggcgaggaggtggagaagagcaccagcgtgacctacacccccaccatcgtgcccagcagcgccagcgcctacgtgagcgaggaggaggccgtgaccctgatcggcaacccctggcccgacgacctgctgagcaccaaggagagctgggtggaggccacccccagacaggtggtggagctgagcggcagcagcagcatccccatcaccgagggcagcggcgaggccgaggaggacgaggacaccatgttcaccatggtgaccgacctgagccagagaaacaccaccgacaccctgatcaccctggacaccagcagaatcatcaccgagagcttcttcgaggtgcccgccaccaccatctaccccgtgagcgagcagcccagcgccaaggtggtgcccaccaagttcgtgagcgagaccgacaccagcgagtggatcagcagcaccaccgtggaggagaagaagagaaaggaggaggagggcaccaccggcaccgccagcaccttcgaggtgtacagcagcacccagagaagcgaccagctgatcctgcccttcgagctggagagccccaacgtggccaccagcagcgacagcggcaccagaaagagcttcatgagcctgaccacccccacccagagcgagagagagatgaccgacagcacccccgtgttcaccgagaccaacaccctggagaacctgggcgcccagaccaccgagcacagcagcatccaccagcccggcgtgcaggagggcctgaccaccctgcccagaagccccgccagcgtgttcatggagcagggcagcggcgaggccgccgccgaccccgagaccaccaccgtgagcagcttcagcctgaacgtggagtacgccatccaggccgagaaggaggtggccggcaccctgagcccccacgtggagaccaccttcagcaccgagcccaccggcctggtgctgagcaccgtgatggacagagtggtggccgagaacatcacccagaccagcagagagatcgtgatcagcgagagactgggcgagcccaactacggcgccgagatcagaggcttcagcaccggcttccccctggaggaggacttcagcggcgacttcagagagtacagcaccgtgagccaccccatcgccaaggaggagaccgtgatgatggagggcagcggcgacgccgccttcagagacacccagaccagccccagcaccgtgcccaccagcgtgcacatcagccacatcagcgacagcgagggccccagcagcaccatggtgagcaccagcgccttcccctgggaggagttcaccagcagcgccgagggcagcggcgagcagctggtgaccgtgagcagcagcgtggtgcccgtgctgcccagcgccgtgcagaagttcagcggcaccgccagcagcatcatcgacgagggcctgggcgaggtgggcaccgtgaacgagatcgacagaagaagcaccatcctgcccaccgccgaggtggagggcaccaaggcccccgtggagaaggaggaggtgaaggtgagcggcaccgtgagcaccaacttcccccagaccatcgagcccgccaagctgtggagcagacaggaggtgaaccccgtgagacaggagatcgagagcgagaccaccagcgaggagcagatccaggaggagaagagcttcgagagcccccagaacagccccgccaccgagcagaccatcttcgacagccagaccttcaccgagaccgagctgaagaccaccgactacagcgtgctgaccaccaagaagacctacagcgacgacaaggagatgaaggaggaggacaccagcctggtgaacatgagcacccccgaccccgacgccaacggcctggagagctacaccaccctgcccgaggccaccgagaagagccacttcttcctggccaccgccctggtgaccgagagcatccccgccgagcacgtggtgaccgacagccccatcaagaaggaggagagcaccaagcacttccccaagggcatgagacccaccatccaggagagcgacaccgagctgctgttcagcggcctgggcagcggcgaggaggtgctgcccaccctgcccaccgagagcgtgaacttcaccgaggtggagcagatcaacaacaccctgtacccccacaccagccaggtggagagcaccagcagcgacaagatcgaggacttcaacagaatggagaacgtggccaaggaggtgggccccctggtgagccagaccgacatcttcgagggcagcggcagcgtgaccagcaccaccctgatcgagatcctgagcgacaccggcgccgagggccccaccgtggcccccctgcccttcagcaccgacatcggccacccccagaaccagaccgtgagatgggccgaggagatccagaccagcagaccccagaccatcaccgagcaggacagcaacaagaacagcagcaccgccgagatcaacgagaccaccaccagcagcaccgacttcctggccagagcctacggcttcgagatggccaaggagttcgtgaccagcgcccccaagcccagcgacctgtactacgagcccagcggcgagggcagcggcgaggtggacatcgtggacagcttccacaccagcgccaccacccaggccaccagacaggagagcagcaccaccttcgtgagcgacggcagcctggagaagcaccccgaggtgcccagcgccaaggccgtgaccgccgacggcttccccaccgtgagcgtgatgctgcccctgcacagcgagcagaacaagagcagccccgaccccaccagcaccctgagcaacaccgtgagctacgagagaagcaccgacggcagcttccaggacagattcagagagttcgaggacagcaccctgaagcccaacagaaagaagcccaccgagaacatcatcatcgacctggacaaggaggacaaggacctgatcctgaccatcaccgagagcaccatcctggagatcctgcccgagctgaccagcgacaagaacaccatcatcgacatcgaccacaccaagcccgtgtacgaggacatcctgggcatgcagaccgacatcgacaccgaggtgcccagcgagccccacgacagcaacgacgagagcaacgacgacagcacccaggtgcaggagatctacgaggccgccgtgaacctgagcctgaccgaggagaccttcgagggcagcgccgacgtgctggccagctacacccaggccacccacgacgagagcatgacctacgaggacagaagccagctggaccacatgggcttccacttcaccaccggcatccccgcccccagcaccgagaccgagctggacgtgctgctgcccaccgccaccagcctgcccatccccagaaagagcgccaccgtgatccccgagatcgagggcatcaaggccgaggccaaggccctggacgacatgttcgagagcagcaccctgagcgacggccaggccatcgccgaccagagcgagatcatccccaccctgggccagttcgagagaacccaggaggagtacgaggacaagaagcacgccggccccagcttccagcccgagttcagcagcggcgccgaggaggccctggtggaccacaccccctacctgagcatcgccaccacccacctgatggaccagagcgtgaccgaggtgcccgacgtgatggagggcagcaaccccccctactacaccgacaccaccctggccgtgagcaccttcgccaagctgagcagccagacccccagcagccccctgaccatctacagcggcagcgaggccagcggccacaccgagatcccccagcccagcgccctgcccggcatcgacgtgggcagcagcgtgatgagcccccaggacagcttcaaggagatccacgtgaacatcgaggccaccttcaagcccagcagcgaggagtacctgcacatcaccgagccccccagcctgagccccgacaccaagctggagcccagcgaggacgacggcaagcccgagctgctggaggagatggaggccagccccaccgagctgatcgccgtggagggcaccgagatcctgcaggacttccagaacaagaccgacggccaggtgagcggcgaggccatcaagatgttccccaccatcaagacccccgaggccggcaccgtgatcaccaccgccgacgagatcgagctggagggcgccacccagtggccccacagcaccagcgccagcgccacctacggcgtggaggccggcgtggtgccctggctgagcccccagaccagcgagagacccaccctgagcagcagccccgagatcaaccccgagacccaggccgccctgatcagaggccaggacagcaccatcgccgccagcgagcagcaggtggccgccagaatcctggacagcaacgaccaggccaccgtgaaccccgtggagttcaacaccgaggtggccaccccccccttcagcctgctggagaccagcaacgagaccgacttcctgatcggcatcaacgaggagagcgtggagggcaccgccatctacctgcccggccccgacagatgcaagatgaacccctgcctgaacggcggcacctgctaccccaccgagaccagctacgtgtgcacctgcgtgcccggctacagcggcgaccagtgcgagctggacttcgacgagtgccacagcaacccctgcagaaacggcgccacctgcgtggacggcttcaacaccttcagatgcctgtgcctgcccagctacgtgggcgccctgtgcgagcaggacaccgagacctgcgactacggctggcacaagttccagggccagtgctacaagtacttcgcccacagaagaacctgggacgccgccgagagagagtgcagactgcagggcgcccacctgaccagcatcctgagccacgaggagcagatgttcgtgaacagagtgggccacgactaccagtggatcggcctgaacgacaagatgttcgagcacgacttcagatggaccgacggcagcaccctgcagtacgagaactggagacccaaccagcccgacagcttcttcagcgccggcgaggactgcgtggtgatcatctggcacgagaacggccagtggaacgacgtgccctgcaactaccacctgacctacacctgcaagaagggcaccgtggcctgcggccagccccccgtggtggagaacgccaagaccttcggcaagatgaagcccagatacgagatcaacagcctgatcagataccactgcaaggacggcttcatccagagacacctgcccaccatcagatgcctgggcaacggcagatgggccatccccaagatcacctgcatgaaccccagcgcctaccagagaacctacagcatgaagtacttcaagaacagcagcagcgccaaggacaacagcatcaacaccagcaagcacgaccacagatggagcagaagatggcaggagagcagaagatag

SEQ ID NO: 13458 - DNA, 4929 bp, Artificial Sequence
  Description of Artificial Sequence: Synthetic coding sequence
atgttcatcaacatcaagagcatcctgtggatgtgcagcaccctgatcgtgacccacgccctgcacaaggtgaaggtgggcaagagcccccccgtgagaggcagcctgagcggcaaggtgagcctgccctgccacttcagcaccatgcccaccctgccccccagctacaacaccagcgagttcctgagaatcaagtggagcaagatcgaggtggacaagaacggcaaggacctgaaggagaccaccgtgctggtggcccagaacggcaacatcaagatcggccaggactacaagggcagagtgagcgtgcccacccaccccgaggccgtgggcgacgccagcctgaccgtggtgaagctgctggccagcgacgccggcctgtacagatgcgacgtgatgtacggcatcgaggacacccaggacaccgtgagcctgaccgtggacggcgtggtgttccactacagagccgccaccagcagatacaccctgaacttcgaggccgcccagaaggcctgcctggacgtgggcgccgtgatcgccacccccgagcagctgttcgccgcctacgaggacggcttcgagcagtgcgacgccggctggctggccgaccagaccgtgagataccccatcagagcccccagagtgggctgctacggcgacaagatgggcaaggccggcgtgagaacctacggcttcagaagcccccaggagacctacgacgtgtactgctacgtggaccacctggacggcgacgtgttccacctgaccgtgcccagcaagttcaccttcgaggaggccgccaaggagtgcgagaaccaggacgccagactggccaccgtgggcgagctgcaggccgcctggagaaacggcttcgaccagtgcgactacggctggctgagcgacgccagcgtgagacaccccgtgaccgtggccagagcccagtgcggcggcggcctgctgggcgtgagaaccctgtacagattcgagaaccagaccggcttccccccccccgacagcagattcgacgcctactgcttcaagcccaaggaggccaccaccatcgacctgagcatcctggccgagaccgccagccccagcctgagcaaggagccccagatggtgagcgacagaaccacccccatcatccccctggtggacgagctgcccgtgatccccaccgagttcccccccgtgggcaacatcgtgagcttcgagcagaaggccaccgtgcagccccaggccatcaccgacagcctggccaccaagctgcccacccccaccggcagcaccaagaagccctgggacatggacgactacagccccagcgccagcggccccctgggcaagctggacatcagcgagatcaaggaggaggtgctgcagagcaccaccggcgtgagccactacgccaccgacagctgggacggcgtggtggaggacaagcagacccaggagagcgtgacccagatcgagcagatcgaggtgggccccctggtgaccagcatggagatcctgaagcacatccccagcaaggagttccccgtgaccgagacccccctggtgaccgccagaatgatcctggagagcaagaccgagaagaagatggtgagcaccgtgagcgagctggtgaccaccggccactacggcttcaccctgggcgaggaggacgacgaggacagaaccctgaccgtgggcagcgacgagagcaccctgatcttcgaccagatccccgaggtgatcaccgtgagcaagaccagcgaggacaccatccacacccacctggaggacctggagagcgtgagcgccagcaccaccgtgagccccctgatcatgcccgacaacaacggcagcagcatggacgactgggaggagagacagaccagcggcagaatcaccgaggagttcctgggcaagtacctgagcaccacccccttccccagccagcacagaaccgagatcgagctgttcccctacagcggcgacaagatcctggtggagggcatcagcaccgtgatctaccccagcctgcagaccgagatgacccacagaagagagagaaccgagaccctgatccccgagatgagaaccgacacctacaccgacgagatccaggaggagatcaccaagagccccttcatgggcaagaccgaggaggaggtgttcagcggcatgaagctgagcaccagcctgagcgagcccatccacgtgaccgagagcagcgtggagatgaccaagagcttcgacttccccaccctgatcaccaagctgagcgccgagcccaccgaggtgagagacatggaggaggacttcaccgccacccccggcaccaccaagtacgacgagaacatcaccaccgtgctgctggcccacggcaccctgagcgtggaggccgccaccgtgagcaagtggagctgggacgaggacaacaccaccagcaagcccctggagagcaccgagcccagcgccagcagcaagctgccccccgccctgctgaccaccgtgggcatgaacggcaaggacaaggacatccccagcttcaccgaggacggcgccgacgagttcaccctgatccccgacagcacccagaagcagctggaggaggtgaccgacgaggacatcgccgcccacggcaagttcaccatcagattccagcccaccaccagcaccggcatcgccgagaagagcaccctgagagacagcaccaccgaggagaaggtgccccccatcaccagcaccgagggccaggtgtacgccaccatggagggcagcgccctgggcgaggtggaggacgtggacctgagcaagcccgtgagcaccgtgccccagttcgcccacaccagcgaggtggagggcctggccttcgtgagctacagcagcacccaggagcccaccacctacgtggacagcagccacaccatccccctgagcgtgatccccaagaccgactggggcgtgctggtgcccagcgtgcccagcgaggacgaggtgctgggcgagcccagccaggacatcctggtgatcgaccagaccagactggaggccaccatcagccccgagaccatgagaaccaccaagatcaccgagggcaccacccaggaggagttcccctggaaggagcagaccgccgagaagcccgtgcccgccctgagcagcaccgcctggacccccaaggaggccgtgacccccctggacgagcaggagggcgacggcagcgcctacaccgtgagcgaggacgagctgctgaccggcagcgagagagtgcccgtgctggagaccacccccgtgggcaagatcgaccacagcgtgagctacccccccggcgccgtgaccgagcacaaggtgaagaccgacgaggtggtgaccctgacccccagaatcggccccaaggtgagcctgagccccggccccgagcagaagtacgagaccgagggcagcagcaccaccggcttcaccagcagcctgagccccttcagcacccacatcacccagctgatggaggagaccaccaccgagaagaccagcctggaggacatcgacctgggcagcggcctgttcgagaagcccaaggccaccgagctgatcgagttcagcaccatcaaggtgaccgtgcccagcgacatcaccaccgccttcagcagcgtggacagactgcacaccaccagcgccttcaagcccagcagcgccatcaccaagaagccccccctgatcgacagagagcccggcgaggagaccaccagcgacatggtgatcatcggcgagagcaccagccacgtgccccccaccaccctggaggacatcgtggccaaggagaccgagaccgacatcgacagagagtacttcaccaccagcagcccccccgccacccagcccaccagaccccccaccgtggaggacaaggaggccttcggcccccaggccctgagcaccccccagccccccgccagcaccaagttccaccccgacatcaacgtgtacatcatcgaggtgagagagaacaagaccggccccgacagatgcaagatgaacccctgcctgaacggcggcacctgctaccccaccgagaccagctacgtgtgcacctgcgtgcccggctacagcggcgaccagtgcgagctggacttcgacgagtgccacagcaacccctgcagaaacggcgccacctgcgtggacggcttcaacaccttcagatgcctgtgcctgcccagctacgtgggcgccctgtgcgagcaggacaccgagacctgcgactacggctggcacaagttccagggccagtgctacaagtacttcgcccacagaagaacctgggacgccgccgagagagagtgcagactgcagggcgcccacctgaccagcatcctgagccacgaggagcagatgttcgtgaacagagtgggccacgactaccagtggatcggcctgaacgacaagatgttcgagcacgacttcagatggaccgacggcagcaccctgcagtacgagaactggagacccaaccagcccgacagcttcttcagcgccggcgaggactgcgtggtgatcatctggcacgagaacggccagtggaacgacgtgccctgcaactaccacctgacctacacctgcaagaagggcaccgtggcctgcggccagccccccgtggtggagaacgccaagaccttcggcaagatgaagcccagatacgagatcaacagcctgatcagataccactgcaaggacggcttcatccagagacacctgcccaccatcagatgcctgggcaacggcagatgggccatccccaagatcacctgcatgaaccccagcgcctaccagagaacctacagcatgaagtacttcaagaacagcagcagcgccaaggacaacagcatcaacaccagcaagcacgaccacagatggagcagaagatggcaggagagcagaagatag

SEQ ID NO: 13459 - DNA, 7230 bp, Artificial Sequence
  Description of Artificial Sequence: Synthetic coding sequence
atgttcatcaacatcaagagcatcctgtggatgtgcagcaccctgatcgtgacccacgccctgcacaaggtgaaggtgggcaagagcccccccgtgagaggcagcctgagcggcaaggtgagcctgccctgccacttcagcaccatgcccaccctgccccccagctacaacaccagcgagttcctgagaatcaagtggagcaagatcgaggtggacaagaacggcaaggacctgaaggagaccaccgtgctggtggcccagaacggcaacatcaagatcggccaggactacaagggcagagtgagcgtgcccacccaccccgaggccgtgggcgacgccagcctgaccgtggtgaagctgctggccagcgacgccggcctgtacagatgcgacgtgatgtacggcatcgaggacacccaggacaccgtgagcctgaccgtggacggcgtggtgttccactacagagccgccaccagcagatacaccctgaacttcgaggccgcccagaaggcctgcctggacgtgggcgccgtgatcgccacccccgagcagctgttcgccgcctacgaggacggcttcgagcagtgcgacgccggctggctggccgaccagaccgtgagataccccatcagagcccccagagtgggctgctacggcgacaagatgggcaaggccggcgtgagaacctacggcttcagaagcccccaggagacctacgacgtgtactgctacgtggaccacctggacggcgacgtgttccacctgaccgtgcccagcaagttcaccttcgaggaggccgccaaggagtgcgagaaccaggacgccagactggccaccgtgggcgagctgcaggccgcctggagaaacggcttcgaccagtgcgactacggctggctgagcgacgccagcgtgagacaccccgtgaccgtggccagagcccagtgcggcggcggcctgctgggcgtgagaaccctgtacagattcgagaaccagaccggcttccccccccccgacagcagattcgacgcctactgcttcaagagaagaatgagcgacctgagcgtgatcggccaccccatcgacagcgagagcaaggaggacgagccctgcagcgaggagaccgaccccgtgcacgacctgatggccgagatcctgcccgagttccccgacatcatcgagatcgacctgtaccacagcgaggagaacgaggaggaggaggaggagtgcgccaacgccaccgacgtgaccaccacccccagcgtgcagtacatcaacggcaagcacctggtgaccaccgtgcccaaggaccccgaggccgccgaggccagaagaggccagttcgagagcgtggcccccagccagaacttcagcgacagcagcgagagcgacacccaccccttcgtgatcgccaagaccgagctgagcaccgccgtgcagcccaacgagagcaccgagaccaccgagagcctggaggtgacctggaagcccgagacctaccccgagaccagcgagcacttcagcggcggcgagcccgacgtgttccccaccgtgcccttccacgaggagttcgagagcggcaccgccaagaagggcgccgagagcgtgaccgagagagacaccgaggtgggccaccaggcccacgagcacaccgagcccgtgagcctgttccccgaggagagcagcggcgagatcgccatcgaccaggagagccagaagatcgccttcgccagagccaccgaggtgaccttcggcgaggaggtggagaagagcaccagcgtgacctacacccccaccatcgtgcccagcagcgccagcgcctacgtgagcgaggaggaggccgtgaccctgatcggcaacccctggcccgacgacctgctgagcaccaaggagagctgggtggaggccacccccagacaggtggtggagctgagcggcagcagcagcatccccatcaccgagggcagcggcgaggccgaggaggacgaggacaccatgttcaccatggtgaccgacctgagccagagaaacaccaccgacaccctgatcaccctggacaccagcagaatcatcaccgagagcttcttcgaggtgcccgccaccaccatctaccccgtgagcgagcagcccagcgccaaggtggtgcccaccaagttcgtgagcgagaccgacaccagcgagtggatcagcagcaccaccgtggaggagaagaagagaaaggaggaggagggcaccaccggcaccgccagcaccttcgaggtgtacagcagcacccagagaagcgaccagctgatcctgcccttcgagctggagagccccaacgtggccaccagcagcgacagcggcaccagaaagagcttcatgagcctgaccacccccacccagagcgagagagagatgaccgacagcacccccgtgttcaccgagaccaacaccctggagaacctgggcgcccagaccaccgagcacagcagcatccaccagcccggcgtgcaggagggcctgaccaccctgcccagaagccccgccagcgtgttcatggagcagggcagcggcgaggccgccgccgaccccgagaccaccaccgtgagcagcttcagcctgaacgtggagtacgccatccaggccgagaaggaggtggccggcaccctgagcccccacgtggagaccaccttcagcaccgagcccaccggcctggtgctgagcaccgtgatggacagagtggtggccgagaacatcacccagaccagcagagagatcgtgatcagcgagagactgggcgagcccaactacggcgccgagatcagaggcttcagcaccggcttccccctggaggaggacttcagcggcgacttcagagagtacagcaccgtgagccaccccatcgccaaggaggagaccgtgatgatggagggcagcggcgacgccgccttcagagacacccagaccagccccagcaccgtgcccaccagcgtgcacatcagccacatcagcgacagcgagggccccagcagcaccatggtgagcaccagcgccttcccctgggaggagttcaccagcagcgccgagggcagcggcgagcagctggtgaccgtgagcagcagcgtggtgcccgtgctgcccagcgccgtgcagaagttcagcggcaccgccagcagcatcatcgacgagggcctgggcgaggtgggcaccgtgaacgagatcgacagaagaagcaccatcctgcccaccgccgaggtggagggcaccaaggcccccgtggagaaggaggaggtgaaggtgagcggcaccgtgagcaccaacttcccccagaccatcgagcccgccaagctgtggagcagacaggaggtgaaccccgtgagacaggagatcgagagcgagaccaccagcgaggagcagatccaggaggagaagagcttcgagagcccccagaacagccccgccaccgagcagaccatcttcgacagccagaccttcaccgagaccgagctgaagaccaccgactacagcgtgctgaccaccaagaagacctacagcgacgacaaggagatgaaggaggaggacaccagcctggtgaacatgagcacccccgaccccgacgccaacggcctggagagctacaccaccctgcccgaggccaccgagaagagccacttcttcctggccaccgccctggtgaccgagagcatccccgccgagcacgtggtgaccgacagccccatcaagaaggaggagagcaccaagcacttccccaagggcatgagacccaccatccaggagagcgacaccgagctgctgttcagcggcctgggcagcggcgaggaggtgctgcccaccctgcccaccgagagcgtgaacttcaccgaggtggagcagatcaacaacaccctgtacccccacaccagccaggtggagagcaccagcagcgacaagatcgaggacttcaacagaatggagaacgtggccaaggaggtgggccccctggtgagccagaccgacatcttcgagggcagcggcagcgtgaccagcaccaccctgatcgagatcctgagcgacaccggcgccgagggccccaccgtggcccccctgcccttcagcaccgacatcggccacccccagaaccagaccgtgagatgggccgaggagatccagaccagcagaccccagaccatcaccgagcaggacagcaacaagaacagcagcaccgccgagatcaacgagaccaccaccagcagcaccgacttcctggccagagcctacggcttcgagatggccaaggagttcgtgaccagcgcccccaagcccagcgacctgtactacgagcccagcggcgagggcagcggcgaggtggacatcgtggacagcttccacaccagcgccaccacccaggccaccagacaggagagcagcaccaccttcgtgagcgacggcagcctggagaagcaccccgaggtgcccagcgccaaggccgtgaccgccgacggcttccccaccgtgagcgtgatgctgcccctgcacagcgagcagaacaagagcagccccgaccccaccagcaccctgagcaacaccgtgagctacgagagaagcaccgacggcagcttccaggacagattcagagagttcgaggacagcaccctgaagcccaacagaaagaagcccaccgagaacatcatcatcgacctggacaaggaggacaaggacctgatcctgaccatcaccgagagcaccatcctggagatcctgcccgagctgaccagcgacaagaacaccatcatcgacatcgaccacaccaagcccgtgtacgaggacatcctgggcatgcagaccgacatcgacaccgaggtgcccagcgagccccacgacagcaacgacgagagcaacgacgacagcacccaggtgcaggagatctacgaggccgccgtgaacctgagcctgaccgaggagaccttcgagggcagcgccgacgtgctggccagctacacccaggccacccacgacgagagcatgacctacgaggacagaagccagctggaccacatgggcttccacttcaccaccggcatccccgcccccagcaccgagaccgagctggacgtgctgctgcccaccgccaccagcctgcccatccccagaaagagcgccaccgtgatccccgagatcgagggcatcaaggccgaggccaaggccctggacgacatgttcgagagcagcaccctgagcgacggccaggccatcgccgaccagagcgagatcatccccaccctgggccagttcgagagaacccaggaggagtacgaggacaagaagcacgccggccccagcttccagcccgagttcagcagcggcgccgaggaggccctggtggaccacaccccctacctgagcatcgccaccacccacctgatggaccagagcgtgaccgaggtgcccgacgtgatggagggcagcaaccccccctactacaccgacaccaccctggccgtgagcaccttcgccaagctgagcagccagacccccagcagccccctgaccatctacagcggcagcgaggccagcggccacaccgagatcccccagcccagcgccctgcccggcatcgacgtgggcagcagcgtgatgagcccccaggacagcttcaaggagatccacgtgaacatcgaggccaccttcaagcccagcagcgaggagtacctgcacatcaccgagccccccagcctgagccccgacaccaagctggagcccagcgaggacgacggcaagcccgagctgctggaggagatggaggccagccccaccgagctgatcgccgtggagggcaccgagatcctgcaggacttccagaacaagaccgacggccaggtgagcggcgaggccatcaagatgttccccaccatcaagacccccgaggccggcaccgtgatcaccaccgccgacgagatcgagctggagggcgccacccagtggccccacagcaccagcgccagcgccacctacggcgtggaggccggcgtggtgccctggctgagcccccagaccagcgagagacccaccctgagcagcagccccgagatcaaccccgagacccaggccgccctgatcagaggccaggacagcaccatcgccgccagcgagcagcaggtggccgccagaatcctggacagcaacgaccaggccaccgtgaaccccgtggagttcaacaccgaggtggccaccccccccttcagcctgctggagaccagcaacgagaccgacttcctgatcggcatcaacgaggagagcgtggagggcaccgccatctacctgcccggccccgacagatgcaagatgaacccctgcctgaacggcggcacctgctaccccaccgagaccagctacgtgtgcacctgcgtgcccggctacagcggcgaccagtgcgagctggacttcgacgagtgccacagcaacccctgcagaaacggcgccacctgcgtggacggcttcaacaccttcagatgcctgtgcctgcccagctacgtgggcgccctgtgcgagcaggacaccgagacctgcgactacggctggcacaagttccagggccagtgctacaagtacttcgcccacagaagaacctgggacgccgccgagagagagtgcagactgcagggcgcccacctgaccagcatcctgagccacgaggagcagatgttcgtgaacagagtgggccacgactaccagtggatcggcctgaacgacaagatgttcgagcacgacttcagatggaccgacggcagcaccctgcagtacgagaactggagacccaaccagcccgacagcttcttcagcgccggcgaggactgcgtggtgatcatctggcacgagaacggccagtggaacgacgtgccctgcaactaccacctgacctacacctgcaagaagggcaccgtggcctgcggccagccccccgtggtggagaacgccaagaccttcggcaagatgaagcccagatacgagatcaacagcctgatcagataccactgcaaggacggcttcatccagagacacctgcccaccatcagatgcctgggcaacggcagatgggccatccccaagatcacctgcatgaaccccagcgcctaccagagaacctacagcatgaagtacttcaagaacagcagcagcgccaaggacaacagcatcaacaccagcaagcacgaccacagatggagcagaagatggcaggagagcagaagatag

SEQ ID NO: 13460 - DNA, 4785 bp, Artificial Sequence
  Description of Artificial Sequence: Synthetic coding sequence
atgcccaccctgccccccagctacaacaccagcgagttcctgagaatcaagtggagcaagatcgaggtggacaagaacggcaaggacctgaaggagaccaccgtgctggtggcccagaacggcaacatcaagatcggccaggactacaagggcagagtgagcgtgcccacccaccccgaggccgtgggcgacgccagcctgaccgtggtgaagctgctggccagcgacgccggcctgtacagatgcgacgtgatgtacggcatcgaggacacccaggacaccgtgagcctgaccgtggacggcgtggtgttccactacagagccgccaccagcagatacaccctgaacttcgaggccgcccagaaggcctgcctggacgtgggcgccgtgatcgccacccccgagcagctgttcgccgcctacgaggacggcttcgagcagtgcgacgccggctggctggccgaccagaccgtgagataccccatcagagcccccagagtgggctgctacggcgacaagatgggcaaggccggcgtgagaacctacggcttcagaagcccccaggagacctacgacgtgtactgctacgtggaccacctggacggcgacgtgttccacctgaccgtgcccagcaagttcaccttcgaggaggccgccaaggagtgcgagaaccaggacgccagactggccaccgtgggcgagctgcaggccgcctggagaaacggcttcgaccagtgcgactacggctggctgagcgacgccagcgtgagacaccccgtgaccgtggccagagcccagtgcggcggcggcctgctgggcgtgagaaccctgtacagattcgagaaccagaccggcttccccccccccgacagcagattcgacgcctactgcttcaagcccaaggaggccaccaccatcgacctgagcatcctggccgagaccgccagccccagcctgagcaaggagccccagatggtgagcgacagaaccacccccatcatccccctggtggacgagctgcccgtgatccccaccgagttcccccccgtgggcaacatcgtgagcttcgagcagaaggccaccgtgcagccccaggccatcaccgacagcctggccaccaagctgcccacccccaccggcagcaccaagaagccctgggacatggacgactacagccccagcgccagcggccccctgggcaagctggacatcagcgagatcaaggaggaggtgctgcagagcaccaccggcgtgagccactacgccaccgacagctgggacggcgtggtggaggacaagcagacccaggagagcgtgacccagatcgagcagatcgaggtgggccccctggtgaccagcatggagatcctgaagcacatccccagcaaggagttccccgtgaccgagacccccctggtgaccgccagaatgatcctggagagcaagaccgagaagaagatggtgagcaccgtgagcgagctggtgaccaccggccactacggcttcaccctgggcgaggaggacgacgaggacagaaccctgaccgtgggcagcgacgagagcaccctgatcttcgaccagatccccgaggtgatcaccgtgagcaagaccagcgaggacaccatccacacccacctggaggacctggagagcgtgagcgccagcaccaccgtgagccccctgatcatgcccgacaacaacggcagcagcatggacgactgggaggagagacagaccagcggcagaatcaccgaggagttcctgggcaagtacctgagcaccacccccttccccagccagcacagaaccgagatcgagctgttcccctacagcggcgacaagatcctggtggagggcatcagcaccgtgatctaccccagcctgcagaccgagatgacccacagaagagagagaaccgagaccctgatccccgagatgagaaccgacacctacaccgacgagatccaggaggagatcaccaagagccccttcatgggcaagaccgaggaggaggtgttcagcggcatgaagctgagcaccagcctgagcgagcccatccacgtgaccgagagcagcgtggagatgaccaagagcttcgacttccccaccctgatcaccaagctgagcgccgagcccaccgaggtgagagacatggaggaggacttcaccgccacccccggcaccaccaagtacgacgagaacatcaccaccgtgctgctggcccacggcaccctgagcgtggaggccgccaccgtgagcaagtggagctgggacgaggacaacaccaccagcaagcccctggagagcaccgagcccagcgccagcagcaagctgccccccgccctgctgaccaccgtgggcatgaacggcaaggacaaggacatccccagcttcaccgaggacggcgccgacgagttcaccctgatccccgacagcacccagaagcagctggaggaggtgaccgacgaggacatcgccgcccacggcaagttcaccatcagattccagcccaccaccagcaccggcatcgccgagaagagcaccctgagagacagcaccaccgaggagaaggtgccccccatcaccagcaccgagggccaggtgtacgccaccatggagggcagcgccctgggcgaggtggaggacgtggacctgagcaagcccgtgagcaccgtgccccagttcgcccacaccagcgaggtggagggcctggccttcgtgagctacagcagcacccaggagcccaccacctacgtggacagcagccacaccatccccctgagcgtgatccccaagaccgactggggcgtgctggtgcccagcgtgcccagcgaggacgaggtgctgggcgagcccagccaggacatcctggtgatcgaccagaccagactggaggccaccatcagccccgagaccatgagaaccaccaagatcaccgagggcaccacccaggaggagttcccctggaaggagcagaccgccgagaagcccgtgcccgccctgagcagcaccgcctggacccccaaggaggccgtgacccccctggacgagcaggagggcgacggcagcgcctacaccgtgagcgaggacgagctgctgaccggcagcgagagagtgcccgtgctggagaccacccccgtgggcaagatcgaccacagcgtgagctacccccccggcgccgtgaccgagcacaaggtgaagaccgacgaggtggtgaccctgacccccagaatcggccccaaggtgagcctgagccccggccccgagcagaagtacgagaccgagggcagcagcaccaccggcttcaccagcagcctgagccccttcagcacccacatcacccagctgatggaggagaccaccaccgagaagaccagcctggaggacatcgacctgggcagcggcctgttcgagaagcccaaggccaccgagctgatcgagttcagcaccatcaaggtgaccgtgcccagcgacatcaccaccgccttcagcagcgtggacagactgcacaccaccagcgccttcaagcccagcagcgccatcaccaagaagccccccctgatcgacagagagcccggcgaggagaccaccagcgacatggtgatcatcggcgagagcaccagccacgtgccccccaccaccctggaggacatcgtggccaaggagaccgagaccgacatcgacagagagtacttcaccaccagcagcccccccgccacccagcccaccagaccccccaccgtggaggacaaggaggccttcggcccccaggccctgagcaccccccagccccccgccagcaccaagttccaccccgacatcaacgtgtacatcatcgaggtgagagagaacaagaccggccccgacagatgcaagatgaacccctgcctgaacggcggcacctgctaccccaccgagaccagctacgtgtgcacctgcgtgcccggctacagcggcgaccagtgcgagctggacttcgacgagtgccacagcaacccctgcagaaacggcgccacctgcgtggacggcttcaacaccttcagatgcctgtgcctgcccagctacgtgggcgccctgtgcgagcaggacaccgagacctgcgactacggctggcacaagttccagggccagtgctacaagtacttcgcccacagaagaacctgggacgccgccgagagagagtgcagactgcagggcgcccacctgaccagcatcctgagccacgaggagcagatgttcgtgaacagagtgggccacgactaccagtggatcggcctgaacgacaagatgttcgagcacgacttcagatggaccgacggcagcaccctgcagtacgagaactggagacccaaccagcccgacagcttcttcagcgccggcgaggactgcgtggtgatcatctggcacgagaacggccagtggaacgacgtgccctgcaactaccacctgacctacacctgcaagaagggcaccgtggcctgcggccagccccccgtggtggagaacgccaagaccttcggcaagatgaagcccagatacgagatcaacagcctgatcagataccactgcaaggacggcttcatccagagacacctgcccaccatcagatgcctgggcaacggcagatgggccatccccaagatcacctgcatgaaccccagcgcctaccagagaacctacagcatgaagtacttcaagaacagcagcagcgccaaggacaacagcatcaacaccagcaagcacgaccacagatggagcagaagatggcaggagagcagaagatag

SEQ ID NO: 13461 - DNA, 1968 bp, Artificial Sequence
  Description of Artificial Sequence: Synthetic coding sequence
atgttcatcaacatcaagagcatcctgtggatgtgcagcaccctgatcgtgacccacgccctgcacaaggtgaaggtgggcaagagcccccccgtgagaggcagcctgagcggcaaggtgagcctgccctgccacttcagcaccatgcccaccctgccccccagctacaacaccagcgagttcctgagaatcaagtggagcaagatcgaggtggacaagaacggcaaggacctgaaggagaccaccgtgctggtggcccagaacggcaacatcaagatcggccaggactacaagggcagagtgagcgtgcccacccaccccgaggccgtgggcgacgccagcctgaccgtggtgaagctgctggccagcgacgccggcctgtacagatgcgacgtgatgtacggcatcgaggacacccaggacaccgtgagcctgaccgtggacggcgtggtgttccactacagagccgccaccagcagatacaccctgaacttcgaggccgcccagaaggcctgcctggacgtgggcgccgtgatcgccacccccgagcagctgttcgccgcctacgaggacggcttcgagcagtgcgacgccggctggctggccgaccagaccgtgagataccccatcagagcccccagagtgggctgctacggcgacaagatgggcaaggccggcgtgagaacctacggcttcagaagcccccaggagacctacgacgtgtactgctacgtggaccacctggacggcgacgtgttccacctgaccgtgcccagcaagttcaccttcgaggaggccgccaaggagtgcgagaaccaggacgccagactggccaccgtgggcgagctgcaggccgcctggagaaacggcttcgaccagtgcgactacggctggctgagcgacgccagcgtgagacaccccgtgaccgtggccagagcccagtgcggcggcggcctgctgggcgtgagaaccctgtacagattcgagaaccagaccggcttccccccccccgacagcagattcgacgcctactgcttcaagagacccgacagatgcaagatgaacccctgcctgaacggcggcacctgctaccccaccgagaccagctacgtgtgcacctgcgtgcccggctacagcggcgaccagtgcgagctggacttcgacgagtgccacagcaacccctgcagaaacggcgccacctgcgtggacggcttcaacaccttcagatgcctgtgcctgcccagctacgtgggcgccctgtgcgagcaggacaccgagacctgcgactacggctggcacaagttccagggccagtgctacaagtacttcgcccacagaagaacctgggacgccgccgagagagagtgcagactgcagggcgcccacctgaccagcatcctgagccacgaggagcagatgttcgtgaacagagtgggccacgactaccagtggatcggcctgaacgacaagatgttcgagcacgacttcagatggaccgacggcagcaccctgcagtacgagaactggagacccaaccagcccgacagcttcttcagcgccggcgaggactgcgtggtgatcatctggcacgagaacggccagtggaacgacgtgccctgcaactaccacctgacctacacctgcaagaagggcaccgtggcctgcggccagccccccgtggtggagaacgccaagaccttcggcaagatgaagcccagatacgagatcaacagcctgatcagataccactgcaaggacggcttcatccagagacacctgcccaccatcagatgcctgggcaacggcagatgggccatccccaagatcacctgcatgaaccccagcgcctaccagagaacctacagcatgaagtacttcaagaacagcagcagcgccaaggacaacagcatcaacaccagcaagcacgaccacagatggagcagaagatggcaggagagcagaagatag

SEQ ID NO: 13462 - DNA, 1440 bp, Artificial Sequence
  Description of Artificial Sequence: Synthetic coding sequence
atggccagcaccatcaaggaggccctgagcgtggtgagcgaggaccagagcctgttcgagtgcgcctacggcaccccccacctggccaagaccgagatgaccgccagcagcagcagcgactacggccagaccagcaagatgagccccagagtgccccagcaggactggctgagccagccccccgccagagtgaccatcaagatggagtgcaaccccagccaggtgaacggcagcagaaacagccccgacgagtgcagcgtggccaagggcggcaagatggtgggcagccccgacaccgtgggcatgaactacggcagctacatggaggagaagcacatgcccccccccaacatgaccaccaacgagagaagagtgatcgtgcccgccgaccccaccctgtggagcaccgaccacgtgagacagtggctggagtgggccgtgaaggagtacggcctgcccgacgtgaacatcctgctgttccagaacatcgacggcaaggagctgtgcaagatgaccaaggacgacttccagagactgacccccagctacaacgccgacatcctgctgagccacctgcactacctgagagagacccccctgccccacctgaccagcgacgacgtggacaaggccctgcagaacagccccagactgatgcacgccagaaacaccggcggcgccgccttcatcttccccaacaccagcgtgtaccccgaggccacccagagaatcaccaccagacccgacctgccctacgagccccccagaagaagcgcctggaccggccacggccaccccaccccccagagcaaggccgcccagcccagccccagcaccgtgcccaagaccgaggaccagagaccccagctggacccctaccagatcctgggccccaccagcagcagactggccaaccccggcagcggccagatccagctgtggcagttcctgctggagctgctgagcgacagcagcaacagcagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccacccccccgagagcagcctgtacaagtaccccagcgacctgccctacatgggcagctaccacgcccacccccagaagatgaacttcgtggccccccacccccccgccctgcccgtgaccagcagcagcttcttcgccgcccccaacccctactggaacagccccaccggcggcatctaccccaacaccagactgcccaccagccacatgcccagccacctgggcacctactactag

SEQ ID NO: 13463 - DNA, 1092 bp, Artificial Sequence
  Description of Artificial Sequence: Synthetic coding sequence
atggtgggcagccccgacaccgtgggcatgaactacggcagctacatggaggagaagcacatgcccccccccaacatgaccaccaacgagagaagagtgatcgtgcccgccgaccccaccctgtggagcaccgaccacgtgagacagtggctggagtgggccgtgaaggagtacggcctgcccgacgtgaacatcctgctgttccagaacatcgacggcaaggagctgtgcaagatgaccaaggacgacttccagagactgacccccagctacaacgccgacatcctgctgagccacctgcactacctgagagagacccccctgccccacctgaccagcgacgacgtggacaaggccctgcagaacagccccagactgatgcacgccagaaacaccgacctgccctacgagccccccagaagaagcgcctggaccggccacggccaccccaccccccagagcaaggccgcccagcccagccccagcaccgtgcccaagaccgaggaccagagaccccagctggacccctaccagatcctgggccccaccagcagcagactggccaaccccggcagcggccagatccagctgtggcagttcctgctggagctgctgagcgacagcagcaacagcagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccacccccccgagagcagcctgtacaagtaccccagcgacctgccctacatgggcagctaccacgcccacccccagaagatgaacttcgtggccccccacccccccgccctgcccgtgaccagcagcagcttcttcgccgcccccaacccctactggaacagccccaccggcggcatctaccccaacaccagactgcccaccagccacatgcccagccacctgggcacctactactag

SEQ ID NO: 13464 - DNA, 1389 bp, Artificial Sequence
  Description of Artificial Sequence: Synthetic coding sequence
atgatccagaccgtgcccgaccccgccgcccacatcaaggaggccctgagcgtggtgagcgaggaccagagcctgttcgagtgcgcctacggcaccccccacctggccaagaccgagatgaccgccagcagcagcagcgactacggccagaccagcaagatgagccccagagtgccccagcaggactggctgagccagccccccgccagagtgaccatcaagatggagtgcaaccccagccaggtgaacggcagcagaaacagccccgacgagtgcagcgtggccaagggcggcaagatggtgggcagccccgacaccgtgggcatgaactacggcagctacatggaggagaagcacatgcccccccccaacatgaccaccaacgagagaagagtgatcgtgcccgccgaccccaccctgtggagcaccgaccacgtgagacagtggctggagtgggccgtgaaggagtacggcctgcccgacgtgaacatcctgctgttccagaacatcgacggcaaggagctgtgcaagatgaccaaggacgacttccagagactgacccccagctacaacgccgacatcctgctgagccacctgcactacctgagagagacccccctgccccacctgaccagcgacgacgtggacaaggccctgcagaacagccccagactgatgcacgccagaaacaccgacctgccctacgagccccccagaagaagcgcctggaccggccacggccaccccaccccccagagcaaggccgcccagcccagccccagcaccgtgcccaagaccgaggaccagagaccccagctggacccctaccagatcctgggccccaccagcagcagactggccaaccccggcagcggccagatccagctgtggcagttcctgctggagctgctgagcgacagcagcaacagcagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccacccccccgagagcagcctgtacaagtaccccagcgacctgccctacatgggcagctaccacgcccacccccagaagatgaacttcgtggccccccacccccccgccctgcccgtgaccagcagcagcttcttcgccgcccccaacccctactggaacagccccaccggcggcatctaccccaacaccagactgcccaccagccacatgcccagccacctgggcacctactactag

SEQ ID NO: 13465 - DNA, 1461 bp, Artificial Sequence
  Description of Artificial Sequence: Synthetic coding sequence
atgatccagaccgtgcccgaccccgccgcccacatcaaggaggccctgagcgtggtgagcgaggaccagagcctgttcgagtgcgcctacggcaccccccacctggccaagaccgagatgaccgccagcagcagcagcgactacggccagaccagcaagatgagccccagagtgccccagcaggactggctgagccagccccccgccagagtgaccatcaagatggagtgcaaccccagccaggtgaacggcagcagaaacagccccgacgagtgcagcgtggccaagggcggcaagatggtgggcagccccgacaccgtgggcatgaactacggcagctacatggaggagaagcacatgcccccccccaacatgaccaccaacgagagaagagtgatcgtgcccgccgaccccaccctgtggagcaccgaccacgtgagacagtggctggagtgggccgtgaaggagtacggcctgcccgacgtgaacatcctgctgttccagaacatcgacggcaaggagctgtgcaagatgaccaaggacgacttccagagactgacccccagctacaacgccgacatcctgctgagccacctgcactacctgagagagacccccctgccccacctgaccagcgacgacgtggacaaggccctgcagaacagccccagactgatgcacgccagaaacaccggcggcgccgccttcatcttccccaacaccagcgtgtaccccgaggccacccagagaatcaccaccagacccgacctgccctacgagccccccagaagaagcgcctggaccggccacggccaccccaccccccagagcaaggccgcccagcccagccccagcaccgtgcccaagaccgaggaccagagaccccagctggacccctaccagatcctgggccccaccagcagcagactggccaaccccggcagcggccagatccagctgtggcagttcctgctggagctgctgagcgacagcagcaacagcagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccacccccccgagagcagcctgtacaagtaccccagcgacctgccctacatgggcagctaccacgcccacccccagaagatgaacttcgtggccccccacccccccgccctgcccgtgaccagcagcagcttcttcgccgcccccaacccctactggaacagccccaccggcggcatctaccccaacaccagactgcccaccagccacatgcccagccacctgggcacctactactag

SEQ ID NO: 13466 - DNA, 1461 bp, Artificial Sequence; identical to SEQ ID NO: 13465
  Description of Artificial Sequence: Synthetic coding sequence

SEQ ID NO: 13467 - DNA, 516 bp, Artificial Sequence
  Description of Artificial Sequence: Synthetic coding sequence
atggccagcaccatcaaggaggccctgagcgtggtgagcgaggaccagagcctgttcgagtgcgcctacggcaccccccacctggccaagaccgagatgaccgccagcagcagcagcgactacggccagaccagcaagatgagccccagagtgccccagcaggactggctgagccagccccccgccagagtgaccatcaagatggagtgcaaccccagccaggtgaacggcagcagaaacagccccgacgagtgcagcgtggccaagggcggcaagatggtgggcagccccgacaccgtgggcatgaactacggcagctacatggaggagaagcacatgcccccccccaacatgaccaccaacgagagaagagtgatcgtgcccgccgacctgccctacgagccccccagaagaagcgcctggaccggccacggccaccccaccccccagagcaagggcaccgtgctggcccccatgaccctgagcttcatgagccaggccgtggacgactgctag

SEQ ID NO: 13468 - DNA, 1389 bp, Artificial Sequence; identical to SEQ ID NO: 13464
  Description of Artificial Sequence: Synthetic coding sequence

SEQ ID NO: 13469 - DNA, 1164 bp, Artificial Sequence
  Description of Artificial Sequence: Synthetic coding sequence
atggtgggcagccccgacaccgtgggcatgaactacggcagctacatggaggagaagcacatgcccccccccaacatgaccaccaacgagagaagagtgatcgtgcccgccgaccccaccctgtggagcaccgaccacgtgagacagtggctggagtgggccgtgaaggagtacggcctgcccgacgtgaacatcctgctgttccagaacatcgacggcaaggagctgtgcaagatgaccaaggacgacttccagagactgacccccagctacaacgccgacatcctgctgagccacctgcactacctgagagagacccccctgccccacctgaccagcgacgacgtggacaaggccctgcagaacagccccagactgatgcacgccagaaacaccggcggcgccgccttcatcttccccaacaccagcgtgtaccccgaggccacccagagaatcaccaccagacccgacctgccctacgagccccccagaagaagcgcctggaccggccacggccaccccaccccccagagcaaggccgcccagcccagccccagcaccgtgcccaagaccgaggaccagagaccccagctggacccctaccagatcctgggccccaccagcagcagactggccaaccccggcagcggccagatccagctgtggcagttcctgctggagctgctgagcgacagcagcaacagcagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccacccccccgagagcagcctgtacaagtaccccagcgacctgccctacatgggcagctaccacgcccacccccagaagatgaacttcgtggccccccacccccccgccctgcccgtgaccagcagcagcttcttcgccgcccccaacccctactggaacagccccaccggcggcatctaccccaacaccagactgcccaccagccacatgcccagccacctgggcacctactactag

SEQ ID NO: 13470 - DNA, 1410 bp, Artificial Sequence
  Description of Artificial Sequence: Synthetic coding sequence
atgaacgacttcggcatcaagaacatggaccaggtggcccccgtggccaacagctacagaggcaccctgaagagacagcccgccttcgacaccttcgacggcagcctgttcgccgtgttccccagcctgaacgaggagcagaccctgcaggaggtgcccaccggcctggacagcatcagccacgacagcgccaactgcgagctgcccctgctgaccccctgcagcaaggccgtgatgagccaggccctgaaggccaccttcagcggcttcaagaaggagcagagaagactgggcatccccaagaacccctggctgtggagcgagcagcaggtgtgccagtggctgctgtgggccaccaacgagttcagcctggtgaacgtgaacctgcagagattcggcatgaacggccagatgctgtgcaacctgggcaaggagagattcctggagctggcccccgacttcgtgggcgacatcctgtgggagcacctggagcagatgatcaaggagaaccaggagaagaccgaggaccagtacgaggagaacagccacctgaccagcgtgccccactggatcaacagcaacaccctgggcttcggcaccgagcaggccccctacggcatgcagacccagaactaccccaagggcggcctgctggacagcatgtgccccgccagcacccccagcgtgctgagcagcgagcaggagttccagatgttccccaagagcagactgagcagcgtgagcgtgacctactgcagcgtgagccaggacttccccggcagcaacctgaacctgctgaccaacaacagcggcacccccaaggaccacgacagccccgagaacggcgccgacagcttcgagagcagcgacagcctgctgcagagctggaacagccagagcagcctgctggacgtgcagagagtgcccagcttcgagagcttcgaggacgactgcagccagagcctgtgcctgaacaagcccaccatgagcttcaaggactacatccaggagagaagcgaccccgtggagcagggcaagcccgtgatccccgccgccgtgctggccggcttcaccggcagcggccccatccagctgtggcagttcctgctggagctgctgagcgacaagagctgccagagcttcatcagctggaccggcgacggctgggagttcaagctggccgaccccgacgaggtggccagaagatggggcaagagaaagaacaagcccaagatgaactacgagaagctgagcagaggcctgagatactactacgacaagaacatcatccacaagaccagcggcaagagatacgtgtacagattcgtgtgcgacctgcagaacctgctgggcttcacccccgaggagctgcacgccatcctgggcgtgcagcccgacaccgaggactag

SEQ ID NO: 13471 - DNA, 1410 bp, Artificial Sequence; identical to SEQ ID NO: 13470
  Description of Artificial Sequence: Synthetic coding sequence

SEQ ID NO: 13472 - DNA, 507 bp, Artificial Sequence
  Description of Artificial Sequence: Synthetic coding sequence
atgaacgacttcggcatcaagaacatggaccaggtggcccccgtggccaacagctacagaggcaccctgaagagacagcccgccttcgacaccttcgacggcagcctgttcgccgtgttccccagcctgaacgaggagcagaccctgcaggaggtgcccaccggcctggacagcatcagccacgacagcgccaactgcgagctgcccctgctgaccccctgcagcaaggccgtgatgagccaggccctgaaggccaccttcagcggcttcaagaaggagcagagaagactgggcatccccaagaacccctggctgtggagcgagcagcaggtgtgccagtggctgctgtgggccaccaacgagttcagcctggtgaacgtgaacctgcagagattcggcatgaacggccagatgctgtgcaacctgggcaaggagagattcctggagctggcccccgacttcgtgggcgacatcctgtgggagcacctggagcagatgatcaagtag

SEQ ID NO: 13473 - DNA, 813 bp, Artificial Sequence
  Description of Artificial Sequence: Synthetic coding sequence
atgaacgacttcggcatcaagaacatggaccaggtggcccccgtggccaacagctacagaggcaccctgaagagacagcccgccttcgacaccttcgacggcagcctgttcgccgtgttccccagcctgaacgaggagcagaccctgcaggaggtgcccaccggcctggacagcatcagccacgacagcgccaactgcgagctgcccctgctgaccccctgcagcaaggccgtgatgagccaggccctgaaggccaccttcagcggcttcaagaaggagcagagaagactgggcatccccaagaacccctggctgtggagcgagcagcaggtgtgccagtggctgctgtgggccaccaacgagttcagcctggtgaacgtgaacctgcagagattcggcatgaacggccagatgctgtgcaacctgggcaaggagagattcctggagctggcccccgacttcgtgggcgacatcctgtgggagcacctggagcagatgatcaaggagaaccaggagaagaccgaggaccagtacgaggagaacagccacctgaccagcgtgccccactggatcaacagcaacaccctgggcttcggcaccgagcaggccccctacggcatgcagacccagaactaccccaagggcggcctgctggacagcatgtgccccgccagcacccccagcgtgctgagcagcgagcaggagttccagatgttccccaagagcagactgagcagcgtgagcgtgacctactgcagcgtgagccaggacttccccggcagcaacctgaacctgctgaccaacaacagctag

SEQ ID NO: 13474 - DNA, 570 bp, Artificial Sequence
  Description of Artificial Sequence: Synthetic coding sequence
atgaccgagtacaagctggtggtggtgggcgccggcggcgtgggcaagagcgccctgaccatccagctgatccagaaccacttcgtggacgagtacgaccccaccatcgaggacagctacagaaagcaggtggtgatcgacggcgagacctgcctgctggacatcctggacaccgccggccaggaggagtacagcgccatgagagaccagtacatgagaaccggcgagggcttcctgtgcgtgttcgccatcaacaacaccaagagcttcgaggacatccaccagtacagagagcagatcaagagagtgaaggacagcgacgacgtgcccatggtgctggtgggcaacaagtgcgacctggccgccagaaccgtggagagcagacaggcccaggacctggccagaagctacggcatcccctacatcgagaccagcgccaagaccagacagggcgtggaggacgccttctacaccctggtgagagagatcagacagcacaagctgagaaagctgaacccccccgacgagagcggccccggctgcatgagctgcaagtgcgtgctgagctag

SEQ ID NO: 13475 - DNA, 513 bp, Artificial Sequence
  Description of Artificial Sequence: Synthetic coding sequence
atgaccgagtacaagctggtggtggtgggcgccggcggcgtgggcaagagcgccctgaccatccagctgatccagaaccacttcgtggacgagtacgaccccaccatcgaggacagctacagaaagcaggtggtgatcgacggcgagacctgcctgctggacatcctggacaccgccggccaggaggagtacagcgccatgagagaccagtacatgagaaccggcgagggcttcctgtgcgtgttcgccatcaacaacaccaagagcttcgaggacatccaccagtacagagagcagatcaagagagtgaaggacagcgacgacgtgcccatggtgctggtgggcaacaagtgcgacctggccgccagaaccgtggagagcagacaggcccaggacctggccagaagctacggcatcccctacatcgagaccagcgccaagaccagacagggcagcagaagcggcagcagcagcagcagcggcaccctgtgggacccccccggccccatgtag

SEQ ID NO: 13476 - DNA, 570 bp, Artificial Sequence; identical to SEQ ID NO: 13474
  Description of Artificial Sequence: Synthetic coding sequence

SEQ ID NO: 13477 - DNA, 513 bp, Artificial Sequence; identical to SEQ ID NO: 13475
  Description of Artificial Sequence: Synthetic coding sequence

SEQ ID NO: 13478 - DNA, 570 bp, Artificial Sequence; identical to SEQ ID NO: 13474
  Description of Artificial Sequence: Synthetic coding sequence

SEQ ID NO: 13479 - DNA, 513 bp, Artificial Sequence; identical to SEQ ID NO: 13475
  Description of Artificial Sequence: Synthetic coding sequence

SEQ ID NO: 13480 - DNA, 609 bp, Artificial Sequence
  Description of Artificial Sequence: Synthetic coding sequence
atgctgccccccggcaccgccaccctgctgaccctgctgctggccgccggcagcctgggccagaagccccagagacccagaagacccgccagccccatcagcaccatccagcccaaggccaacttcgacgcccagcagttcgccggcacctggctgctggtggccgtgggcagcgcctgcagattcctgcaggagcagggccacagagccgaggccaccaccctgcacgtggccccccagggcaccgccatggccgtgagcaccttcagaaagctggacggcatctgctggcaggtgagacagctgtacggcgacaccggcgtgctgggcagattcctgctgcaggccagagacgccagaggcgccgtgcacgtggtggtggccgagaccgactaccagagcttcgccgtgctgtacctggagagagccggccagctgagcgtgaagctgtacgccagaagcctgcccgtgagcgacagcgtgctgagcggcttcgagcagagagtgcaggaggcccacctgaccgaggaccagatcttctacttccccaagtacggcttctgcgaggccgccgaccagttccacgtgctggacgaggtgagaagatag

SEQ ID NO: 13481 - DNA, 522 bp, Artificial Sequence
  Description of Artificial Sequence: Synthetic coding sequence
ggcttcctggtgcccctgtggctgatgagaaactgcttcagactgcaggaggagatgctgcagagagaggaggccgagaacaccctgcagagcttcagacaggacgtggacaacgccagcctggccagactggacctggagagaaaggtggagagcctgcaggaggagatcgccttcctgaagaagctgcacgaggaggagatccaggagctgcaggcccagatccaggagcagcacgtgcagatcgacgtggacgtgagcaagcccgacctgaccgccgccctgagagacgtgagacagcagtacgagagcgtggccgccaagaacctgcaggaggccgaggagtggtacaagagcaagttcgccgacctgagcgaggccgccaacagaaacaacgacgccctgagacaggccaagcaggagagcaccgagtacagaagacaggtgcagagcctgacctgcgaggtggacgccctgaagggcaccgtgagcaccaaccccgccgtgaaggagggcaagtag

SEQ ID NO: 13482 - DNA, 687 bp, Artificial Sequence
  Description of Artificial Sequence: Synthetic coding sequence
atgagaaactgcttcagactgcaggaggagatgctgcagagagaggaggccgagaacaccctgcagagcttcagacaggacgtggacaacgccagcctggccagactggacctggagagaaaggtggagagcctgcaggaggagatcgccttcctgaagaagctgcacgaggaggagatccaggagctgcaggcccagatccaggagcagcacgtgcagatcgacgtggacgtgagcaagcccgacctgaccgccgccctgagagacgtgagacagcagtacgagagcgtggccgccaagaacctgcaggaggccgaggagtggtacaagagcaagttcgccgacctgagcgaggccgccaacagaaacaacgacgccctgagacaggccaagcaggagagcaccgagtacagaagacaggtgcagagcctgacctgcgaggtggacgccctgaagggcaccaacgagagcctggagagacagatgagagagatggaggagaacttcgccgtggaggccgccaactaccaggacaccatcggcagactgcaggacgagatccagaacatgaaggaggagatggccagacacctgagagagtaccaggacctgctgaacgtgaagatggccctggacatcgagatcgccacctacagaaagctgctggagggcgaggagagcagatag

SEQ ID NO: 13483 - DNA, 1296 bp, Artificial Sequence
  Description of Artificial Sequence: Synthetic coding sequence
atgagcaccagaagcgtgagcagcagcagctacagaagaatgttcggcggccccggcaccgccagcagacccagcagcagcagaagctacgtgaccaccagcaccagaacctacagcctgggcagcgccctgagacccagcaccagcagaagcctgtacgccagcagccccggcggcgtgtacgccaccagaagcagcgccgtgagactgagaagcagcgtgcccggcgtgagactgctgcaggacagcgtggacttcagcctggccgacgccatcaacaccgagttcaagaacaccagaaccaacgagaaggtggagctgcaggagctgaacgacagattcgccaactacatcgacaaggtgagattcctggagcagcagaacaagatcctgctggccgagctggagcagctgaagggccagggcaagagcagactgggcgacctgtacgaggaggagatgagagagctgagaagacaggtggaccagctgaccaacgacaaggccagagtggaggtggagagagacaacctggccgaggacatcatgagactgagagagaagctgcaggaggagatgctgcagagagaggaggccgagaacaccctgcagagcttcagacaggacgtggacaacgccagcctggccagactggacctggagagaaaggtggagagcctgcaggaggagatcgccttcctgaagaagctgcacgaggaggagatccaggagctgcaggcccagatccaggagcagcacgtgcagatcgacgtggacgtgagcaagcccgacctgaccgccgccctgagagacgtgagacagcagtacgagagcgtggccgccaagaacctgcaggaggccgaggagtggtacaagagcaagttcgccgacctgagcgaggccgccaacagaaacaacgacgccctgagacaggccaagcaggagagcaccgagtacagaagacaggtgcagagcctgacctgcgaggtggacgccctgaagggcaccaacgagagcctggagagacagatgagagagatggaggagaacttcgccgtggaggccgccaactaccaggacaccatcggcagactgcaggacgagatccagaacatgaaggaggagatggccagacacctgagagagtaccaggacctgctgaacgtgaagatggccctggacatcgagatcgccacctacagaaagctgctggagggcgaggagagcagaatcagcctgcccctgcccaacttcagcagcctgaacctgagaggcaagcacttcatcagcctgtag

SEQ ID NO: 13484 - DNA, 1401 bp, Artificial Sequence
  Description of Artificial Sequence: Synthetic coding sequence
atgagcaccagaagcgtgagcagcagcagctacagaagaatgttcggcggccccggcaccgccagcagacccagcagcagcagaagctacgtgaccaccagcaccagaacctacagcctgggcagcgccctgagacccagcaccagcagaagcctgtacgccagcagccccggcggcgtgtacgccaccagaagcagcgccgtgagactgagaagcagcgtgcccggcgtgagactgctgcaggacagcgtggacttcagcctggccgacgccatcaacaccgagttcaagaacaccagaaccaacgagaaggtggagctgcaggagctgaacgacagattcgccaactacatcgacaaggtgagattcctggagcagcagaacaagatcctgctggccgagctggagcagctgaagggccagggcaagagcagactgggcgacctgtacgaggaggagatgagagagctgagaagacaggtggaccagctgaccaacgacaaggccagagtggaggtggagagagacaacctggccgaggacatcatgagactgagagagaagctgcaggaggagatgctgcagagagaggaggccgagaacaccctgcagagcttcagacaggacgtggacaacgccagcctggccagactggacctggagagaaaggtggagagcctgcaggaggagatcgccttcctgaagaagctgcacgaggaggagatccaggagctgcaggcccagatccaggagcagcacgtgcagatcgacgtggacgtgagcaagcccgacctgaccgccgccctgagagacgtgagacagcagtacgagagcgtggccgccaagaacctgcaggaggccgaggagtggtacaagagcaagttcgccgacctgagcgaggccgccaacagaaacaacgacgccctgagacaggccaagcaggagagcaccgagtacagaagacaggtgcagagcctgacctgcgaggtggacgccctgaagggcaccaacgagagcctggagagacagatgagagagatggaggagaacttcgccgtggaggccgccaactaccaggacaccatcggcagactgcaggacgagatccagaacatgaaggaggagatggccagacacctgagagagtaccaggacctgctgaacgtgaagatggccctggacatcgagatcgccacctacagaaagctgctggagggcgaggagagcagaatcagcctgcccctgcccaacttcagcagcctgaacctgagagagaccaacctggacagcctgcccctggtggacacccacagcaagagaaccctgctgatcaagaccgtggagaccagagacggccaggtgatcaacgagaccagccagcaccacgacgacctggagtag

SEQ ID NO: 13485 - DNA, 1224 bp, Artificial Sequence
  Description of Artificial Sequence: Synthetic coding sequence
atgttcggcggccccggcaccgccagcagacccagcagcagcagaagctacgtgaccaccagcaccagaacctacagcctgggcagcgccctgagacccagcaccagcagaagcctgtacgccagcagccccggcggcgtgtacgccaccagaagcagcgccgtgagactgagaagcagcgtgcccggcgtgagactgctgcaggacagcgtggacttcagcctggccgacgccatcaacaccgagttcaagaacaccagaaccaacgagaaggtggagctgcaggagctgaacgacagattcgccaactacatcgacaaggtgagattcctggagcagcagaacaagatcctgctggccgagctggagcagctgaagggccagggcaagagcagactgggcgacctgtacgaggaggagatgagagagctgagaagacaggtggaccagctgaccaacgacaaggccagagtggaggtggagagagacaacctggccgaggacatcatgagactgagagagaagctgcaggaggagatgctgcagagagaggaggccgagaacaccctgcagagcttcagacaggacgtggacaacgccagcctggccagactggacctggagagaaaggtggagagcctgcaggaggagatcgccttcctgaagaagctgcacgaggaggagatccaggagctgcaggcccagatccaggagcagcacgtgcagatcgacgtggacgtgagcaagcccgacctgaccgccgccctgagagacgtgagacagcagtacgagagcgtggccgccaagaacctgcaggaggccgaggagtggtacaagagcaagttcgccgacctgagcgaggccgccaacagaaacaacgacgccctgagacaggccaagcaggagagcaccgagtacagaagacaggtgcagagcctgacctgcgaggtggacgccctgaagggcaccaacgagagcctggagagacagatgagagagatggaggagaacttcgccgtggaggccgccaactaccaggacaccatcggcagactgcaggacgagatccagaacatgaaggaggagatggccagacacctgagagagtaccaggacctgctgaacgtgaagatggccctggacatcgagatcgccacctacagaaagctgctggagggcgaggagagcagaatcctgtgcctgttccagaccttccccccctag

SEQ ID NO: 13486 - DNA, 2256 bp, Artificial Sequence
  Description of Artificial Sequence: Synthetic coding sequence
atggaggacctgagcagccccgacagcaccctgctgcagggcggccacaacctgctgagcagcgccagcttccaggaggccgtgaccttcaaggacgtgatcgtggacttcacccaggaggagtggaagcagctggaccccggccagagagacctgttcagagacgtgaccctggagaactacacccacctggtgagcatcggcctgcaggtgagcaagcccgacgtgatcagccagctggagcagggcaccgagccctggatcatggagcccagcatccccgtgggcacctgcgccgactgggagaccagactggagaacagcgtgagcgcccccgagcccgacatcagcgaggaggagctgagccccgaggtgatcgtggagaagcacaagagagacgacagctggagcagcaacctgctggagagctgggagtacgagggcagcctggagagacagcaggccaaccagcagaccctgcccaaggagatcaaggtgaccgagaagaccatccccagctgggagaagggccccgtgaacaacgagttcggcaagagcgtgaacgtgagcagcaacctggtgacccaggagcccagccccgaggagaccagcaccaagagaagcatcaagcagaacagcaaccccgtgaagaaggagaagagctgcaagtgcaacgagtgcggcaaggccttcagctactgcagcgccctgatcagacaccagagaacccacaccggcgagaagccctacaagtgcaacgagtgcgagaaggccttcagcagaagcgagaacctgatcaaccaccagagaatccacaccggcgacaagccctacaagtgcgaccagtgcggcaagggcttcatcgagggccccagcctgacccagcaccagagaatccacaccggcgagaagccctacaagtgcgacgagtgcggcaaggccttcagccagagaacccacctggtgcagcaccagagaatccacaccggcgagaagccctacacctgcaacgagtgcggcaaggccttcagccagagaggccacttcatggagcaccagaagatccacaccggcgagaagcccttcaagtgcgacgagtgcgacaagaccttcaccagaagcacccacctgacccagcaccagaagatccacaccggcgagaagacctacaagtgcaacgagtgcggcaaggccttcaacggccccagcaccttcatcagacaccacatgatccacaccggcgagaagccctacgagtgcaacgagtgcggcaaggccttcagccagcacagcaacctgacccagcaccagaagacccacaccggcgagaagccctacgactgcgccgagtgcggcaagagcttcagctactggagcagcctggcccagcacctgaagatccacaccggcgagaagccctacaagtgcaacgagtgcggcaaggccttcagctactgcagcagcctgacccagcacagaagaatccacaccagagagaagcccttcgagtgcagcgagtgcggcaaggccttcagctacctgagcaacctgaaccagcaccagaagacccacacccaggagaaggcctacgagtgcaaggagtgcggcaaggccttcatcagaagcagcagcctggccaagcacgagagaatccacaccggcgagaagccctaccagtgccacgagtgcggcaagaccttcagctacggcagcagcctgatccagcacagaaagatccacaccggcgagagaccctacaagtgcaacgagtgcggcagagccttcaaccagaacatccacctgacccagcacaagagaatccacaccggcgccaagccctacgagtgcgccgagtgcggcaaggccttcagacactgcagcagcctggcccagcaccagaagacccacaccgaggagaagccctaccagtgcaacaagtgcgagaagaccttcagccagagcagccacctgacccagcaccagagaatccacaccggcgagaagccctacaagtgcaacgagtgcgacaaggccttcagcagaagcacccacctgaccgagcaccagaacacccacaccggcgagaagccctacaactgcaacgagtgcagaaagaccttcagccagagcacctacctgatccagcaccagagaatccacagcggcgagaagcccttcggctgcaacgactgcggcaagagcttcagatacagaagcgccctgaacaagcaccagagactgcaccccggcatctag

SEQ ID NO: 13487 - DNA, 3201 bp, Artificial Sequence
  Description of Artificial Sequence: Synthetic coding sequence
atgcccgtgttccacaccagaaccatcgagagcatcctggagcccgtggcccagcagatcagccacctggtgatcatgcacgaggagggcgaggtggacggcaaggccatccccgacctgaccgcccccgtggccgccgtgcaggccgccgtgagcaacctggtgagagtgggcaaggagaccgtgcagaccaccgaggaccagatcctgaagagagacatgccccccgccttcatcaaggtggagaacgcctgcaccaagctggtgcaggccgcccagatgctgcagagcgacccctacagcgtgcccgccagagactacctgatcgacggcagcagaggcatcctgagcggcaccagcgacctgctgctgaccttcgacgaggccgaggtgagaaagatcatcagagtgtgcaagggcatcctggagtacctgaccgtggccgaggtggtggagaccatggaggacctggtgacctacaccaagaacctgggccccggcatgaccaagatggccaagatgatcgacgagagacagcaggagctgacccaccaggagcacagagtgatgctggtgaacagcatgaacaccgtgaaggagctgctgcccgtgctgatcagcgccatgaagatcttcgtgaccaccaagaacagcaagaaccagggcatcgaggaggccctgaagaacagaaacttcaccgtggagaagatgagcgccgagatcaacgagatcatcagagtgctgcagctgaccagctgggacgaggacgcctgggccagcaaggacaccgaggccatgaagagagccctggccagcatcgacagcaagctgaaccaggccaagggctggctgagagaccccagcgccagccccggcgacgccggcgagcaggccatcagacagatcctggacgaggccggcaaggtgggcgagctgtgcgccggcaaggagagaagagagatcctgggcacctgcaagatgctgggccagatgaccgaccaggtggccgacctgagagccagaggccagggcagcagccccgtggccatgcagaaggcccagcaggtgagccagggcctggacgtgctgaccgccaaggtggagaacgccgccagaaagctggaggccatgaccaacagcaagcagagcatcgccaagaagatcgacgccgcccagaactggctggccgaccccaacggcggccccgagggcgaggagcagatcagaggcgccctggccgaggccagaaagatcgccgagctgtgcgacgaccccaaggagagagacgacatcctgagaagcctgggcgagatcagcgccctgaccagcaagctggccgacctgagaagacagggcaagggcgacagccccgaggccagagccctggccaagcaggtggccaccgccctgcagaacctgcagaccaagaccaacagagccgtggccaacagcagacccgccaaggccgccgtgcacctggagggcaagatcgagcaggcccagagatggatcgacaaccccaccgtggacgacagaggcgtgggccaggccgccatcagaggcctggtggccgagggccacagactggccaacgtgatgatgggcccctacagacaggacctgctggccaagtgcgacagagtggaccagctgaccgcccagctggccgacctggccgccagaggcgagggcgagagcccccaggccagagccctggccagccagctgcaggacagcctgaaggacctgaaggccagaatgcaggaggccatgacccaggaggtgagcgacgtgttcagcgacaccaccacccccatcaagctgctggccgtggccgccaccgccccccccgacgcccccaacagagaggaggtgttcgacgagagagccgccaacttcgagaaccacagcggcaagctgggcgccaccgccgagaaggccgccgccgtgggcaccgccaacaagagcaccgtggagggcatccaggccagcgtgaagaccgccagagagctgaccccccaggtggtgagcgccgccagaatcctgctgagaaaccccggcaaccaggccgcctacgagcacttcgagaccatgaagaaccagtggatcgacaacgtggagaagatgaccggcctggtggacgaggccatcgacaccaagagcctgctggacgccagcgaggaggccatcaagaaggacctggacaagtgcaaggtggccatggccaacatccagccccagatgctggtggccggcgccaccagcatcgccagaagagccaacagaatcctgctggtggccaagagagaggtggagaacagcgaggaccccaagttcagagaggccgtgaaggccgccagcgacgagctgagcaagaccatcagccccatggtgatggacgccaaggccgtggccggcaacatcagcgaccccggcctgcagaagagcttcctggacagcggctacagaatcctgggcgccgtggccaaggtgagagaggccttccagccccaggagcccgacttccccccccccccccccgacctggagcagctgagactgaccgacgagctggccccccccaagccccccctgcccgagggcgaggtgcccccccccagaccccccccccccgaggagaaggacgaggagttccccgagcagaaggccggcgaggtgatcaaccagcccatgatgatggccgccagacagctgcacgacgaggccagaaagtggagcagcaagggcaacgacatcatcgccgccgccaagagaatggccctgctgatggccgagatgagcagactggtgagaggcggcagcggcaccaagagagccctgatccagtgcgccaaggacatcgccaaggccagcgacgaggtgaccagactggccaaggaggtggccaagcagtgcaccgacaagagaatcagaaccaacctgctgcaggtgtgcgagagaatccccaccatcagcacccagctgaagatcctgagcaccgtgaaggccaccatgctgggcagaaccaacatcagcgacgaggagagcgagcaggccaccgagatgctggtgcacaacgcccagaacctgatgcagagcgtgaaggagaccgtgagagaggccgaggccgccagcatcaagatcagaaccgacgccggcttcaccctgagatgggtgagaaagaccccctggtaccagtag

SEQ ID NO: 13488 - DNA, 2784 bp, Artificial Sequence
  Description of Artificial Sequence: Synthetic coding sequence
atgctgcagagcgacccctacagcgtgcccgccagagactacctgatcgacggcagcagaggcatcctgagcggcaccagcgacctgctgctgaccttcgacgaggccgaggtgagaaagatcatcagagtgtgcaagggcatcctggagtacctgaccgtggccgaggtggtggagaccatggaggacctggtgacctacaccaagaacctgggccccggcatgaccaagatggccaagatgatcgacgagagacagcaggagctgacccaccaggagcacagagtgatgctggtgaacagcatgaacaccgtgaaggagctgctgcccgtgctgatcagcgccatgaagatcttcgtgaccaccaagaacagcaagaaccagggcatcgaggaggccctgaagaacagaaacttcaccgtggagaagatgagcgccgagatcaacgagatcatcagagtgctgcagctgaccagctgggacgaggacgcctgggccagcaaggacaccgaggccatgaagagagccctggccagcatcgacagcaagctgaaccaggccaagggctggctgagagaccccagcgccagccccggcgacgccggcgagcaggccatcagacagatcctggacgaggccggcaaggtgggcgagctgtgcgccggcaaggagagaagagagatcctgggcacctgcaagatgctgggccagatgaccgaccaggtggccgacctgagagccagaggccagggcagcagccccgtggccatgcagaaggcccagcaggtgagccagggcctggacgtgctgaccgccaaggtggagaacgccgccagaaagctggaggccatgaccaacagcaagcagagcatcgccaagaagatcgacgccgcccagaactggctggccgaccccaacggcggccccgagggcgaggagcagatcagaggcgccctggccgaggccagaaagatcgccgagctgtgcgacgaccccaaggagagagacgacatcctgagaagcctgggcgagatcagcgccctgaccagcaagctggccgacctgagaagacagggcaagggcgacagccccgaggccagagccctggccaagcaggtggccaccgccctgcagaacctgcagaccaagaccaacagagccgtggccaacagcagacccgccaaggccgccgtgcacctggagggcaagatcgagcaggcccagagatggatcgacaaccccaccgtggacgacagaggcgtgggccaggccgccatcagaggcctggtggccgagggccacagactggccaacgtgatgatgggcccctacagacaggacctgctggccaagtgcgacagagtggaccagctgaccgcccagctggccgacctggccgccagaggcgagggcgagagcccccaggccagagccctggccagccagctgcaggacagcctgaaggacctgaaggccagaatgcaggaggccatgacccaggaggtgagcgacgtgttcagcgacaccaccacccccatcaagctgctggccgtggccgccaccgccccccccgacgcccccaacagagaggaggtgttcgacgagagagccgccaacttcgagaaccacagcggcaagctgggcgccaccgccgagaaggccgccgccgtgggcaccgccaacaagagcaccgtggagggcatccaggccagcgtgaagaccgccagagagctgaccccccaggtggtgagcgccgccagaatcctgctgagaaaccccggcaaccaggccgcctacgagcacttcgagaccatgaagaaccagtggatcgacaacgtggagaagatgaccggcctggtggacgaggccatcgacaccaagagcctgctggacgccagcgaggaggccatcaagaaggacctggacaagtgcaaggtggccatggccaacatccagccccagatgctggtggccggcgccaccagcatcgccagaagagccaacagaatcctgctggtggccaagagagaggtggagaacagcgaggaccccaagttcagagaggccgtgaaggccgccagcgacgagctgagcaagaccatcagccccatggtgatggacgccaaggccgtggccggcaacatcagcgaccccggcctgcagaagagcttcctggacagcggctacagaatcctgggcgccgtggccaaggtgagagaggccttccagccccaggagcccgacttccccccccccccccccgacctggagcagctgagactgaccgacgagctggccccccccaagccccccctgcccgagggcgaggtgcccccccccagaccccccccccccgaggagaaggacgaggagttccccgagcagaaggccggcgaggtgatcaaccagcccatgatgatggccgccagacagctgcacgacgaggccagaaagtggagcagcaagcccggcatccccgccgccgaggtgggcatcggcgtggtggccgaggccgacgccgccgacgccgccggcttccccgtgccccccgacatggaggacgactacgagcccgagctgctgctgatgcccagcaaccagcccgtgaaccagcccatcctggccgccgcccagagcctgcacagagaggccaccaagtggagcagcaagggcaacgacatcatcgccgccgccaagagaatggccctgctgatggccgagatgagcagactggtgagaggcggcagcgtgcccagaaccagccccagaccccagatgagatag

SEQ ID NO: 13489 - DNA, 984 bp, Artificial Sequence
  Description of Artificial Sequence: Synthetic coding sequence
atgcccgtgttccacaccagaaccatcgagagcatcctggagcccgtggcccagcagatcagccacctggtgatcatgcacgaggagggcgaggtggacggcaaggccatccccgacctgaccgcccccgtggccgccgtgcaggccgccgtgagcaacctggtgagagtgggcaaggagaccgtgcagaccaccgaggaccagatcctgaagagagacatgccccccgccttcatcaaggtggagaacgcctgcaccaagctggtgcaggccgcccagatgctgcagagcgacccctacagcgtgcccgccagagactacctgatcgacggcagcagaggcatcctgagcggcaccagcgacctgctgctgaccttcgacgaggccgaggtgcccccccccagaccccccccccccgaggagaaggacgaggagttccccgagcagaaggccggcgaggtgatcaaccagcccatgatgatggccgccagacagctgcacgacgaggccagaaagtggagcagcaagggcaacgacatcatcgccgccgccaagagaatggccctgctgatggccgagatgagcagactggtgagaggcggcagcggcaccaagagagccctgatccagtgcgccaaggacatcgccaaggccagcgacgaggtgaccagactggccaaggaggtggccaagcagtgcaccgacaagagaatcagaaccaacctgctgcaggtgtgcgagagaatccccaccatcagcacccagctgaagatcctgagcaccgtgaaggccaccatgctgggcagaaccaacatcagcgacgaggagagcgagcaggccaccgagatgctggtgcacaacgcccagaacctgatgcagagcgtgaaggagaccgtgagagaggccgaggccgccagcatcaagatcagaaccgacgccggcttcaccctgagatgggtgagaaagaccccctggtaccagtag

SEQ ID NO: 13490 - DNA, 2421 bp, Artificial Sequence
  Description of Artificial Sequence: Synthetic coding sequence
ggccagatgaccgaccaggtggccgacctgagagccagaggccagggcagcagccccgtggccatgcagaaggcccagcaggtgagccagggcctggacgtgctgaccgccaaggtggagaacgccgccagaaagctggaggccatgaccaacagcaagcagagcatcgccaagaagatcgacgccgcccagaactggctggccgaccccaacggcggccccgagggcgaggagcagatcagaggcgccctggccgaggccagaaagatcgccgagctgtgcgacgaccccaaggagagagacgacatcctgagaagcctgggcgagatcagcgccctgaccagcaagctggccgacctgagaagacagggcaagggcgacagccccgaggccagagccctggccaagcaggtggccaccgccctgcagaacctgcagaccaagaccaacagagccgtggccaacagcagacccgccaaggccgccgtgcacctggagggcaagatcgagcaggcccagagatggatcgacaaccccaccgtggacgacagaggcgtgggccaggccgccatcagaggcctggtggccgagggccacagactggccaacgtgatgatgggcccctacagacaggacctgctggccaagtgcgacagagtggaccagctgaccgcccagctggccgacctggccgccagaggcgagggcgagagcccccaggccagagccctggccagccagctgcaggacagcctgaaggacctgaaggccagaatgcaggaggccatgacccaggaggtgagcgacgtgttcagcgacaccaccacccccatcaagctgctggccgtggccgccaccgccccccccgacgcccccaacagagaggaggtgttcgacgagagagccgccaacttcgagaaccacagcggcaagctgggcgccaccgccgagaaggccgccgccgtgggcaccgccaacaagagcaccgtggagggcatccaggccagcgtgaagaccgccagagagctgaccccccaggtggtgagcgccgccagaatcctgctgagaaaccccggcaaccaggccgcctacgagcacttcgagaccatgaagaaccagtggatcgacaacgtggagaagatgaccggcctggtggacgaggccatcgacaccaagagcctgctggacgccagcgaggaggccatcaagaaggacctggacaagtgcaaggtggccatggccaacatccagccccagatgctggtggccggcgccaccagcatcgccagaagagccaacagaatcctgctggtggccaagagagaggtggagaacagcgaggaccccaagttcagagaggccgtgaaggccgccagcgacgagctgagcaagaccatcagccccatggtgatggacgccaaggccgtggccggcaacatcagcgaccccggcctgcagaagagcttcctggacagcggctacagaatcctgggcgccgtggccaaggtgagagaggccttccagccccaggagcccgacttccccccccccccccccgacctggagcagctgagactgaccgacgagctggccccccccaagccccccctgcccgagggcgaggtgcccccccccagaccccccccccccgaggagaaggacgaggagttccccgagcagaaggccggcgaggtgatcaaccagcccatgatgatggccgccagacagctgcacgacgaggccagaaagtggagcagcaagcccggcatccccgccgccgaggtgggcatcggcgtggtggccgaggccgacgccgccgacgccgccggcttccccgtgccccccgacatggaggacgactacgagcccgagctgctgctgatgcccagcaaccagcccgtgaaccagcccatcctggccgccgcccagagcctgcacagagaggccaccaagtggagcagcaagggcaacgacatcatcgccgccgccaagagaatggccctgctgatggccgagatgagcagactggtgagaggcggcagcggcaccaagagagccctgatccagtgcgccaaggacatcgccaaggccagcgacgaggtgaccagactggccaaggaggtggccaagcagtgcaccgacaagagaatcagaaccaacctgctgcaggtgtgcgagagaatccccaccatcagcacccagctgaagatcctgagcaccgtgaaggccaccatgctgggcagaaccaacatcagcgacgaggagagcgagcaggccaccgagatgctggtgcacaacgcccagaacctgatgcagagcgtgaaggagaccgtgagagaggccgaggccgccagcatcaagatcagaaccgacgccggcttcaccctgagatgggtgagaaagaccccctggtaccagtag

SEQ ID NO: 13491 - DNA, 3021 bp, Artificial Sequence
  Description of Artificial Sequence: Synthetic coding sequence
atgccccccgccttcatcaaggtggagaacgcctgcaccaagctggtgcaggccgcccagatgctgcagagcgacccctacagcgtgcccgccagagactacctgatcgacggcagcagaggcatcctgagcggcaccagcgacctgctgctgaccttcgacgaggccgaggtgagaaagatcatcagagtgtgcaagggcatcctggagtacctgaccgtggccgaggtggtggagaccatggaggacctggtgacctacaccaagaacctgggccccggcatgaccaagatggccaagatgatcgacgagagacagcaggagctgacccaccaggagcacagagtgatgctggtgaacagcatgaacaccgtgaaggagctgctgcccgtgctgatcagcgccatgaagatcttcgtgaccaccaagaacagcaagaaccagggcatcgaggaggccctgaagaacagaaacttcaccgtggagaagatgagcgccgagatcaacgagatcatcagagtgctgcagctgaccagctgggacgaggacgcctgggccagcaaggacaccgaggccatgaagagagccctggccagcatcgacagcaagctgaaccaggccaagggctggctgagagaccccagcgccagccccggcgacgccggcgagcaggccatcagacagatcctggacgaggccggcaaggtgggcgagctgtgcgccggcaaggagagaagagagatcctgggcacctgcaagatgctgggccagatgaccgaccaggtggccgacctgagagccagaggccagggcagcagccccgtggccatgcagaaggcccagcaggtgagccagggcctggacgtgctgaccgccaaggtggagaacgccgccagaaagctggaggccatgaccaacagcaagcagagcatcgccaagaagatcgacgccgcccagaactggctggccgaccccaacggcggccccgagggcgaggagcagatcagaggcgccctggccgaggccagaaagatcgccgagctgtgcgacgaccccaaggagagagacgacatcctgagaagcctgggcgagatcagcgccctgaccagcaagctggccgacctgagaagacagggcaagggcgacagccccgaggccagagccctggccaagcaggtggccaccgccctgcagaacctgcagaccaagaccaacagagccgtggccaacagcagacccgccaaggccgccgtgcacctggagggcaagatcgagcaggcccagagatggatcgacaaccccaccgtggacgacagaggcgtgggccaggccgccatcagaggcctggtggccgagggccacagactggccaacgtgatgatgggcccctacagacaggacctgctggccaagtgcgacagagtggaccagctgaccgcccagctggccgacctggccgccagaggcgagggcgagagcccccaggccagagccctggccagccagctgcaggacagcctgaaggacctgaaggccagaatgcaggaggccatgacccaggaggtgagcgacgtgttcagcgacaccaccacccccatcaagctgctggccgtggccgccaccgccccccccgacgcccccaacagagaggaggtgttcgacgagagagccgccaacttcgagaaccacagcggcaagctgggcgccaccgccgagaaggccgccgccgtgggcaccgccaacaagagcaccgtggagggcatccaggccagcgtgaagaccgccagagagctgaccccccaggtggtgagcgccgccagaatcctgctgagaaaccccggcaaccaggccgcctacgagcacttcgagaccatgaagaaccagtggatcgacaacgtggagaagatgaccggcctggtggacgaggccatcgacaccaagagcctgctggacgccagcgaggaggccatcaagaaggacctggacaagtgcaaggtggccatggccaacatccagccccagatgctggtggccggcgccaccagcatcgccagaagagccaacagaatcctgctggtggccaagagagaggtggagaacagcgaggaccccaagttcagagaggccgtgaaggccgccagcgacgagctgagcaagaccatcagccccatggtgatggacgccaaggccgtggccggcaacatcagcgaccccggcctgcagaagagcttcctggacagcggctacagaatcctgggcgccgtggccaaggtgagagaggccttccagccccaggagcccgacttccccccccccccccccgacctggagcagctgagactgaccgacgagctggccccccccaagccccccctgcccgagggcgaggtgcccccccccagaccccccccccccgaggagaaggacgaggagttccccgagcagaaggccggcgaggtgatcaaccagcccatgatgatggccgccagacagctgcacgacgaggccagaaagtggagcagcaagggcaacgacatcatcgccgccgccaagagaatggccctgctgatggccgagatgagcagactggtgagaggcggcagcggcaccaagagagccctgatccagtgcgccaaggacatcgccaaggccagcgacgaggtgaccagactggccaaggaggtggccaagcagtgcaccgacaagagaatcagaaccaacctgctgcaggtgtgcgagagaatccccaccatcagcacccagctgaagatcctgagcaccgtgaaggccaccatgctgggcagaaccaacatcagcgacgaggagagcgagcaggccaccgagatgctggtgcacaacgcccagaacctgatgcagagcgtgaaggagaccgtgagagagctgaagctgctgcagagcaagttcgagcagatgctggacctgcactgcgccggcctggagagactgcccggcaccagcagacacctggccgagcccggctggcacagaaacctgtactag

SEQ ID NO: 13492 - DNA, 570 bp, Artificial Sequence
  Description of Artificial Sequence: Synthetic coding sequence
atgaccgagtacaagctggtggtggtgggcgccggcggcgtgggcaagagcgccctgaccatccagctgatccagaaccacttcgtggacgagtacgaccccaccatcgaggacagctacagaaagcaggtggtgatcgacggcgagacctgcctgctggacatcctggacaccgccggccaggaggagtacagcgccatgagagaccagtacatgagaaccggcgagggcttcctgtgcgtgttcgccatcaacaacaccaagagcttcgaggacatccaccactacagagagcagatcaagagagtgaaggacagcgaggacgtgcccatggtgctggtgggcaacaagtgcgacctgcccagcagaaccgtggacaccaagcaggcccaggacctggccagaagctacggcatccccttcatcgagaccagcgccaagaccagacagagagtggaggacgccttctacaccctggtgagagagatcagacagtacagactgaagaagatcagcaaggaggagaagacccccggctgcgtgaagatcaagaagtgcatcatcatgtag

SEQ ID NO: 13493 - DNA, 567 bp, Artificial Sequence
  Description of Artificial Sequence: Synthetic coding sequence
atgaccgagtacaagctggtggtggtgggcgccggcggcgtgggcaagagcgccctgaccatccagctgatccagaaccacttcgtggacgagtacgaccccaccatcgaggacagctacagaaagcaggtggtgatcgacggcgagacctgcctgctggacatcctggacaccgccggccaggaggagtacagcgccatgagagaccagtacatgagaaccggcgagggcttcctgtgcgtgttcgccatcaacaacaccaagagcttcgaggacatccaccactacagagagcagatcaagagagtgaaggacagcgaggacgtgcccatggtgctggtgggcaacaagtgcgacctgcccagcagaaccgtggacaccaagcaggcccaggacctggccagaagctacggcatccccttcatcgagaccagcgccaagaccagacagggcgtggacgacgccttctacaccctggtgagagagatcagaaagcacaaggagaagatgagcaaggacggcaagaagaagaagaagaagagcaagaccaagtgcgtgatcatgtag

SEQ ID NO: 13494 - DNA, 228 bp, Artificial Sequence
  Description of Artificial Sequence: Synthetic coding sequence
atgaccgagtacaagctggtggtggtgggcgccggcggcgtgggcaagagcgccctgaccatccagctgatccagaaccacttcgtggacgagtacgaccccaccatcgagggcgtggacgacgccttctacaccctggtgagagagatcagaaagcacaaggagaagatgagcaaggacggcaagaagaagaagaagaagagcaagaccaagtgcgtgatcatgtag

SEQ ID NO: 13495 - DNA, 2931 bp, Artificial Sequence
  Description of Artificial Sequence: Synthetic coding sequence
atgagaggcgccagaggcgcctgggacttcctgtgcgtgctgctgctgctgctgagagtgcagaccggcagcagccagcccagcgtgagccccggcgagcccagcccccccagcatccaccccggcaagagcgacctgatcgtgagagtgggcgacgagatcagactgctgtgcaccgaccccggcttcgtgaagtggaccttcgagatcctggacgagaccaacgagaacaagcagaacgagtggatcaccgagaaggccgaggccaccaacaccggcaagtacacctgcaccaacaagcacggcctgagcaacagcatctacgtgttcgtgagagaccccgccaagctgttcctggtggacagaagcctgtacggcaaggaggacaacgacaccctggtgagatgccccctgaccgaccccgaggtgaccaactacagcctgaagggctgccagggcaagcccctgcccaaggacctgagattcatccccgaccccaaggccggcatcatgatcaagagcgtgaagagagcctaccacagactgtgcctgcactgcagcgtggaccaggagggcaagagcgtgctgagcgagaagttcatcctgaaggtgagacccgccttcaaggccgtgcccgtggtgagcgtgagcaaggccagctacctgctgagagagggcgaggagttcaccgtgacctgcaccatcaaggacgtgagcagcagcgtgtacagcacctggaagagagagaacagccagaccaagctgcaggagaagtacaacagctggcaccacggcgacttcaactacgagagacaggccaccctgaccatcagcagcgccagagtgaacgacagcggcgtgttcatgtgctacgccaacaacaccttcggcagcgccaacgtgaccaccaccctggaggtggtggacaagggcttcatcaacatcttccccatgatcaacaccaccgtgttcgtgaacgacggcgagaacgtggacctgatcgtggagtacgaggccttccccaagcccgagcaccagcagtggatctacatgaacagaaccttcaccgacaagtgggaggactaccccaagagcgagaacgagagcaacatcagatacgtgagcgagctgcacctgaccagactgaagggcaccgagggcggcacctacaccttcctggtgagcaacagcgacgtgaacgccgccatcgccttcaacgtgtacgtgaacaccaagcccgagatcctgacctacgacagactggtgaacggcatgctgcagtgcgtggccgccggcttccccgagcccaccatcgactggtacttctgccccggcaccgagcagagatgcagcgccagcgtgctgcccgtggacgtgcagaccctgaacagcagcggcccccccttcggcaagctggtggtgcagagcagcatcgacagcagcgccttcaagcacaacggcaccgtggagtgcaaggcctacaacgacgtgggcaagaccagcgcctacttcaacttcgccttcaagggcaacaacaaggagcagatccacccccacaccctgttcacccccctgctgatcggcttcgtgatcgtggccggcatgatgtgcatcatcgtgatgatcctgacctacaagtacctgcagaagcccatgtacgaggtgcagtggaaggtggtggaggagatcaacggcaacaactacgtgtacatcgaccccacccagctgccctacgaccacaagtgggagttccccagaaacagactgagcttcggcaagaccctgggcgccggcgccttcggcaaggtggtggaggccaccgcctacggcctgatcaagagcgacgccgccatgaccgtggccgtgaagatgctgaagcccagcgcccacctgaccgagagagaggccctgatgagcgagctgaaggtgctgagctacctgggcaaccacatgaacatcgtgaacctgctgggcgcctgcaccatcggcggccccaccctggtgatcaccgagtactgctgctacggcgacctgctgaacttcctgagaagaaagagagacagcttcatctgcagcaagcaggaggaccacgccgaggccgccctgtacaagaacctgctgcacagcaaggagagcagctgcagcgacagcaccaacgagtacatggacatgaagcccggcgtgagctacgtggtgcccaccaaggccgacaagagaagaagcgtgagaatcggcagctacatcgagagagacgtgacccccgccatcatggaggacgacgagctggccctggacctggaggacctgctgagcttcagctaccaggtggccaagggcatggccttcctggccagcaagaactgcatccacagagacctggccgccagaaacatcctgctgacccacggcagaatcaccaagatctgcgacttcggcctggccagagacatcaagaacgacagcaactacgtggtgaagggcaacgccagactgcccgtgaagtggatggcccccgagagcatcttcaactgcgtgtacaccttcgagagcgacgtgtggagctacggcatcttcctgtgggagctgttcagcctgggcagcagcccctaccccggcatgcccgtggacagcaagttctacaagatgatcaaggagggcttcagaatgctgagccccgagcacgcccccgccgagatgtacgacatcatgaagacctgctgggacgccgaccccctgaagagacccaccttcaagcagatcgtgcagctgatcgagaagcagatcagcgagagcaccaaccacatctacagcaacctggccaactgcagccccaacagacagaagcccgtggtggaccacagcgtgagaatcaacagcgtgggcagcaccgccagcagcagccagcccctgctggtgcacgacgacgtgtag

SEQ ID NO: 13496 - DNA, 2919 bp, Artificial Sequence
  Description of Artificial Sequence: Synthetic coding sequence
atgagaggcgccagaggcgcctgggacttcctgtgcgtgctgctgctgctgctgagagtgcagaccggcagcagccagcccagcgtgagccccggcgagcccagcccccccagcatccaccccggcaagagcgacctgatcgtgagagtgggcgacgagatcagactgctgtgcaccgaccccggcttcgtgaagtggaccttcgagatcctggacgagaccaacgagaacaagcagaacgagtggatcaccgagaaggccgaggccaccaacaccggcaagtacacctgcaccaacaagcacggcctgagcaacagcatctacgtgttcgtgagagaccccgccaagctgttcctggtggacagaagcctgtacggcaaggaggacaacgacaccctggtgagatgccccctgaccgaccccgaggtgaccaactacagcctgaagggctgccagggcaagcccctgcccaaggacctgagattcatccccgaccccaaggccggcatcatgatcaagagcgtgaagagagcctaccacagactgtgcctgcactgcagcgtggaccaggagggcaagagcgtgctgagcgagaagttcatcctgaaggtgagacccgccttcaaggccgtgcccgtggtgagcgtgagcaaggccagctacctgctgagagagggcgaggagttcaccgtgacctgcaccatcaaggacgtgagcagcagcgtgtacagcacctggaagagagagaacagccagaccaagctgcaggagaagtacaacagctggcaccacggcgacttcaactacgagagacaggccaccctgaccatcagcagcgccagagtgaacgacagcggcgtgttcatgtgctacgccaacaacaccttcggcagcgccaacgtgaccaccaccctggaggtggtggacaagggcttcatcaacatcttccccatgatcaacaccaccgtgttcgtgaacgacggcgagaacgtggacctgatcgtggagtacgaggccttccccaagcccgagcaccagcagtggatctacatgaacagaaccttcaccgacaagtgggaggactaccccaagagcgagaacgagagcaacatcagatacgtgagcgagctgcacctgaccagactgaagggcaccgagggcggcacctacaccttcctggtgagcaacagcgacgtgaacgccgccatcgccttcaacgtgtacgtgaacaccaagcccgagatcctgacctacgacagactggtgaacggcatgctgcagtgcgtggccgccggcttccccgagcccaccatcgactggtacttctgccccggcaccgagcagagatgcagcgccagcgtgctgcccgtggacgtgcagaccctgaacagcagcggcccccccttcggcaagctggtggtgcagagcagcatcgacagcagcgccttcaagcacaacggcaccgtggagtgcaaggcctacaacgacgtgggcaagaccagcgcctacttcaacttcgccttcaaggagcagatccacccccacaccctgttcacccccctgctgatcggcttcgtgatcgtggccggcatgatgtgcatcatcgtgatgatcctgacctacaagtacctgcagaagcccatgtacgaggtgcagtggaaggtggtggaggagatcaacggcaacaactacgtgtacatcgaccccacccagctgccctacgaccacaagtgggagttccccagaaacagactgagcttcggcaagaccctgggcgccggcgccttcggcaaggtggtggaggccaccgcctacggcctgatcaagagcgacgccgccatgaccgtggccgtgaagatgctgaagcccagcgcccacctgaccgagagagaggccctgatgagcgagctgaaggtgctgagctacctgggcaaccacatgaacatcgtgaacctgctgggcgcctgcaccatcggcggccccaccctggtgatcaccgagtactgctgctacggcgacctgctgaacttcctgagaagaaagagagacagcttcatctgcagcaagcaggaggaccacgccgaggccgccctgtacaagaacctgctgcacagcaaggagagcagctgcagcgacagcaccaacgagtacatggacatgaagcccggcgtgagctacgtggtgcccaccaaggccgacaagagaagaagcgtgagaatcggcagctacatcgagagagacgtgacccccgccatcatggaggacgacgagctggccctggacctggaggacctgctgagcttcagctaccaggtggccaagggcatggccttcctggccagcaagaactgcatccacagagacctggccgccagaaacatcctgctgacccacggcagaatcaccaagatctgcgacttcggcctggccagagacatcaagaacgacagcaactacgtggtgaagggcaacgccagactgcccgtgaagtggatggcccccgagagcatcttcaactgcgtgtacaccttcgagagcgacgtgtggagctacggcatcttcctgtgggagctgttcagcctgggcagcagcccctaccccggcatgcccgtggacagcaagttctacaagatgatcaaggagggcttcagaatgctgagccccgagcacgcccccgccgagatgtacgacatcatgaagacctgctgggacgccgaccccctgaagagacccaccttcaagcagatcgtgcagctgatcgagaagcagatcagcgagagcaccaaccacatctacagcaacctggccaactgcagccccaacagacagaagcccgtggtggaccacagcgtgagaatcaacagcgtgggcagcaccgccagcagcagccagcccctgctggtgcacgacgacgtgtag

SEQ ID NO: 13497 - DNA, 1242 bp, Artificial Sequence
  Description of Artificial Sequence: Synthetic coding sequence
atgagaggcgccagaggcgcctgggacttcctgtgcgtgctgctgctgctgctgagagtgcagaccggcagcagccagcccagcgtgagccccggcgagcccagcccccccagcatccaccccggcaagagcgacctgatcgtgagagtgggcgacgagatcagactgctgtgcaccgaccccggcttcgtgaagtggaccttcgagatcctggacgagaccaacgagaacaagcagaacgagtggatcaccgagaaggccgaggccaccaacaccggcaagtacacctgcaccaacaagcacggcctgagcaacagcatctacgtgttcgtgagagaccccgccaagctgttcctggtggacagaagcctgtacggcaaggaggacaacgacaccctggtgagatgccccctgaccgaccccgaggtgaccaactacagcctgaagggctgccagggcaagcccctgcccaaggacctgagattcatccccgaccccaaggccggcatcatgatcaagagcgtgaagagagcctaccacagactgtgcctgcactgcagcgtggaccaggagggcaagagcgtgctgagcgagaagttcatcctgaaggtgagacccgccttcaaggccgtgcccgtggtgagcgtgagcaaggccagctacctgctgagagagggcgaggagttcaccgtgacctgcaccatcaaggacgtgagcagcagcgtgtacagcacctggaagagagagaacagccagaccaagctgcaggagaagtacaacagctggcaccacggcgacttcaactacgagagacaggccaccctgaccatcagcagcgccagagtgaacgacagcggcgtgttcatgtgctacgccaacaacaccttcggcagcgccaacgtgaccaccaccctggaggtggtggacaagggcttcatcaacatcttccccatgatcaacaccaccgtgttcgtgaacgacggcgagaacgtggacctgatcgtggagtacgaggccttccccaagcccgagcaccagcagtggatctacatgaacagaaccttcaccgacaagtgggaggactaccccaagagcgagaacgagagcaacatcagatacgtgagcgagctgcacctgaccagactgaagggcaccgagggcggcacctacaccttcctggtgagcaacagcgacgtgaacgccgccatcgccttcaacgtgtacgtgaacagcaagctgtag

SEQ ID NO: 13498 - DNA, 1212 bp, Artificial Sequence
  Description of Artificial Sequence: Synthetic coding sequence
atggccagcgagctggccatgagcaacagcgacctgcccaccagccccctggccatggagtacgtgaacgacttcgacctgatgaagttcgaggtgaagaaggagcccgtggagaccgacagaatcatcagccagtgcggcagactgatcgccggcggcagcctgagcagcacccccatgagcaccccctgcagcagcgtgccccccagccccagcttcagcgcccccagccccggcagcggcagcgagcagaaggcccacctggaggactactactggatgaccggctacccccagcagctgaaccccgaggccctgggcttcagccccgaggacgccgtggaggccctgatcagcaacagccaccagctgcagggcggcttcgacggctacgccagaggcgcccagcagctggccgccgccgccggcgccggcgccggcgccagcctgggcggcagcggcgaggagatgggccccgccgccgccgtggtgagcgccgtgatcgccgccgccgccgcccagagcggcgccggcccccactaccaccaccaccaccaccacgccgccggccaccaccaccaccccaccgccggcgcccccggcgccgccggcagcgccgccgccagcgccggcggcgccggcggcgccggcggcggcggccccgccagcgccggcggcggcggcggcggcggcggcggcggcggcggcggcggcgccgccggcgccggcggcgccctgcacccccaccacgccgccggcggcctgcacttcgacgacagattcagcgacgagcagctggtgaccatgagcgtgagagagctgaacagacagctgagaggcgtgagcaaggaggaggtgatcagactgaagcagaagagaagaaccctgaagaacagaggctacgcccagagctgcagattcaagagagtgcagcagagacacgtgctggagagcgagaagaaccagctgctgcagcaggtggaccacctgaagcaggagatcagcagactggtgagagagagagacgcctacaaggagaagtacgagaagctggtgagcagcggcttcagagagaacggcagcagcagcgacaaccccagcagccccgagttcttcatcaccgagcccaccagaaagctggagcccagcgtgggctacgccaccttctggaagccccagcacagagtgctgaccagcgtgttcaccaagtag

SEQ ID NO: 13499 - DNA, 1122 bp, Artificial Sequence
  Description of Artificial Sequence: Synthetic coding sequence
atggccagcgagctggccatgagcaacagcgacctgcccaccagccccctggccatggagtacgtgaacgacttcgacctgatgaagttcgaggtgaagaaggagcccgtggagaccgacagaatcatcagccagtgcggcagactgatcgccggcggcagcctgagcagcacccccatgagcaccccctgcagcagcgtgccccccagccccagcttcagcgcccccagccccggcagcggcagcgagcagaaggcccacctggaggactactactggatgaccggctacccccagcagctgaaccccgaggccctgggcttcagccccgaggacgccgtggaggccctgatcagcaacagccaccagctgcagggcggcttcgacggctacgccagaggcgcccagcagctggccgccgccgccggcgccggcgccggcgccagcctgggcggcagcggcgaggagatgggccccgccgccgccgtggtgagcgccgtgatcgccgccgccgccgcccagagcggcgccggcccccactaccaccaccaccaccaccacgccgccggccaccaccaccaccccaccgccggcgcccccggcgccgccggcagcgccgccgccagcgccggcggcgccggcggcgccggcggcggcggccccgccagcgccggcggcggcggcggcggcggcggcggcggcggcggcggcggcgccgccggcgccggcggcgccctgcacccccaccacgccgccggcggcctgcacttcgacgacagattcagcgacgagcagctggtgaccatgagcgtgagagagctgaacagacagctgagaggcgtgagcaaggaggaggtgatcagactgaagcagaagagaagaaccctgaagaacagaggctacgcccagagctgcagattcaagagagtgcagcagagacacgtgctggagagcgagaagaaccagctgctgcagcaggtggaccacctgaagcaggagatcagcagactggtgagagagagagacgcctacaaggagaagtacgagaagctggtgagcagcggcttcagagagaacggcagcagcagcgacaaccccagcagccccgagttcttcatgtag

SEQ ID NO: 13500 - DNA, 1062 bp, Artificial Sequence
  Description of Artificial Sequence: Synthetic coding sequence
atggccgccgagctggccatgggcgccgagctgcccagcagccccctggccatcgagtacgtgaacgacttcgacctgatgaagttcgaggtgaagaaggagccccccgaggccgagagattctgccacagactgccccccggcagcctgagcagcacccccctgagcaccccctgcagcagcgtgcccagcagccccagcttctgcgcccccagccccggcaccggcggcggcggcggcgccggcggcggcggcggcagcagccaggccggcggcgcccccggcccccccagcggcggccccggcgccgtgggcggcaccagcggcaagcccgccctggaggacctgtactggatgagcggctaccagcaccacctgaaccccgaggccctgaacctgacccccgaggacgccgtggaggccctgatcggcagcggccaccacggcgcccaccacggcgcccaccaccccgccgccgccgccgcctacgaggccttcagaggccccggcttcgccggcggcggcggcgccgacgacatgggcgccggccaccaccacggcgcccaccacgccgcccaccaccaccacgccgcccaccaccaccaccaccaccaccaccaccacggcggcgccggccacggcggcggcgccggccaccacgtgagactggaggagagattcagcgacgaccagctggtgagcatgagcgtgagagagctgaacagacagctgagaggcttcagcaaggaggaggtgatcagactgaagcagaagagaagaaccctgaagaacagaggctacgcccagagctgcagattcaagagagtgcagcagagacacatcctggagagcgagaagtgccagctgcagagccaggtggagcagctgaagctggaggtgggcagactggccaaggagagagacctgtacaaggagaagtacgagaagctggccggcagaggcggccccggcagcgccggcggcgccggcttccccagagagcccagccccccccaggccggccccggcggcgccaagggcaccgccgacttcttcctgtag

SEQ ID NO: 13501 - DNA, 972 bp, Artificial Sequence
  Description of Artificial Sequence: Synthetic coding sequence
atggccgccgagctgagcatgggccccgagctgcccaccagccccctggccatggagtacgtgaacgacttcgacctgctgaagttcgacgtgaagaaggagcccctgggcagagccgagagacccggcagaccctgcaccagactgcagcccgccggcagcgtgagcagcacccccctgagcaccccctgcagcagcgtgcccagcagccccagcttcagccccaccgagcagaagacccacctggaggacctgtactggatggccagcaactaccagcagatgaaccccgaggccctgaacctgacccccgaggacgccgtggaggccctgatcggcagccaccccgtgccccagcccctgcagagcttcgacagcttcagaggcgcccaccaccaccaccaccaccaccacccccacccccaccacgcctaccccggcgccggcgtggcccacgacgagctgggcccccacgcccacccccaccaccaccaccaccaccaggccagccccccccccagcagcgccgccagccccgcccagcagctgcccaccagccaccccggccccggcccccacgccaccgccagcgccaccgccgccggcggcaacggcagcgtggaggacagattcagcgacgaccagctggtgagcatgagcgtgagagagctgaacagacacctgagaggcttcaccaaggacgaggtgatcagactgaagcagaagagaagaaccctgaagaacagaggctacgcccagagctgcagatacaagagagtgcagcagaagcaccacctggagaacgagaagacccagctgatccagcaggtggagcagctgaagcaggaggtgagcagactggccagagagagagacgcctacaaggtgaagtgcgagaagctggccaacagcggcttcagagaggccggcagcaccagcgacagccccagcagccccgagttcttcctgtag

SEQ ID NO: 13502 - DNA, 972 bp, Artificial Sequence; identical to SEQ ID NO: 13501
  Description of Artificial Sequence: Synthetic coding sequence

SEQ ID NO: 13503 - DNA, 1233 bp, Artificial Sequence
  Description of Artificial Sequence: Synthetic coding sequence
atggccaagagaagcagaagcgaggacgaggacgacgacctgcagtacgccgaccacgactacgaggtgccccagcagaagggcctgaagaagctgtggaacagagtgaagtggaccagagacgaggacgacaagctgaagaagctggtggagcagcacggcaccgacgactggaccctgatcgccagccacctgcagaacagaagcgacttccagtgccagcacagatggcagaaggtgctgaaccccgagctgatcaagggcccctggaccaaggaggaggaccagagagtgatcgagctggtgcagaagtacggcaagaagagaaagatgagagtgggccacagccccggcagcgagctgagagacggcagcctgaacgacggcggcaacatggccctgaagcacacccccctgaagaccctgcccttcagccccagccagttcttcaacacctgccccggcaacgagcagctgaacatcgagaaccccagcttcaccagcacccccatctgcggccagaaggccctgatcaccacccccctgcacaaggagaccacccccaaggaccagaaggagaacgtgggcttcagaacccccaccatcagaagaagcatcctgggcaccacccccagaacccccacccccttcaagaacgccctggccgcccaggagaagaagtacggccccctgaagatcgtgagccagcccctggccttcctggaggaggacatcagagaggtgctgaaggaggagaccggcaccgacctgttcctgaaggaggaggacgagcccgcctacaagagctgcaagcaggagaacaccgccagcggcaagaaggtgagaaagagcctggtgctggacaactgggagaaggaggagagcggcacccagctgctgaccgaggacatcagcgacatgcagagcgagaacagattcaccaccagcctgctgatgatccccctgctggagatccacgacaacagatgcaacctgatccccgagaagcaggacatcaacagcaccaacaagacctacaccctgaccaagaagaagcccaaccccaacaccagcaaggtggtgaagctggagaagaacctgcagagcaactgcgagtgggagaccgtggtgtacggcaagaccgaggaccagctgatcatgaccgagcaggccagaagatacctgagcacctacaccgccaccagcagcaccagcagagccctgatcctgtag

SEQ ID NO: 13504 - DNA, 2259 bp, Artificial Sequence
  Description of Artificial Sequence: Synthetic coding sequence
atggccaagagaagcagaagcgaggacgaggacgacgacctgcagtacgccgaccacgactacgaggtgccccagcagaagggcctgaagaagctgtggaacagagtgaagtggaccagagacgaggacgacaagctgaagaagctggtggagcagcacggcaccgacgactggaccctgatcgccagccacctgcagaacagaagcgacttccagtgccagcacagatggcagaaggtgctgaaccccgagctgatcaagggcccctggaccaaggaggaggaccagagagtgatcgagctggtgcagaagtacggccccaagagatggagcctgatcgccaagcacctgaagggcagaatcggcaagcagtgcagagagagatggcacaaccacctgaaccccgaggtgaagaagagcagctggaccgaggaggaggacagaatcatctacgaggcccacaagagactgggcaacagatgggccgagatcgccaagctgctgcccggcagaaccgacaacagcatcaagaaccactggaacagcaccatgagaagaaaggtggagcaggagggctacctgcaggacggcatcaagagcgagagaagcagcagcaagctgcagcacaagccctgcgccgccatggaccacatgcagacccagaaccagttctacatccccgtgcagatccccggctaccagtacgtgagccccgagggcaactgcatcgagcacgtgcagcccaccagcgccttcatccagcagcccttcatcgacgaggaccccgacaaggagaagaagatcaaggagctggagatgctgctgatgagcgccgagaacgaggtgagaagaaagagaatccccagccagcccggcagcttcagcagctggagcggcagcttcctgatggacgacaacatgagcaacaccctgaacagcctggacgagcacaccagcgagttctacagcatggacgagaaccagcccgtgagcgcccagcagaacagccccaccaagttcctggccgtggaggccaacgccgtgctgagcagcctgcagaccatccccgagttcgccgagaccctggagctgatcgagagcgaccccgtggcctggagcgacgtgaccagcttcgacatcagcgacgccgccgccagccccatcaagagcacccccgtgaagctgatgagaatccagcacaacgagggcgccatggagtgccagttcaacgtgagcctggtgctggagggcaagaagaacacctgcaacggcggcaacagcgaggccgtgcccctgaccagccccaacatcgccaagttcagcaccccccccgccatcctgagaaagaagagaaagatgagagtgggccacagccccggcagcgagctgagagacggcagcctgaacgacggcggcaacatggccctgaagcacacccccctgaagaccctgcccttcagccccagccagttcttcaacacctgccccggcaacgagcagctgaacatcgagaaccccagcttcaccagcacccccatctgcggccagaaggccctgatcaccacccccctgcacaaggagaccacccccaaggaccagaaggagaacgtgggcttcagaacccccaccatcagaagaagcatcctgggcaccacccccagaacccccacccccttcaagaacgccctggccgcccaggagaagaagtacggccccctgaagatcgtgagccagcccctggccttcctggaggaggacatcagagaggtgctgaaggaggagaccggcaccgacctgttcctgaaggaggaggacgagcccgcctacaagagctgcaagcaggagaacaccgccagcggcaagaaggtgagaaagagcctggtgctggacaactgggagaaggaggagagcggcacccagctgctgaccgaggacatcagcgacatgcagagcgagaacagattcaccaccagcctgctgatgatccccctgctggagatccacgacaacagatgcaacctgatccccgagaagcaggacatcaacagcaccaacaagacctacaccctgaccaagaagaagcccaaccccaacaccagcaaggtggtgaagctggagaagaacctgcagagcaactgcgagtgggagaccgtggtgtacggcaagaccgaggaccagctgatcatgaccgagcaggccagaagatacctgagcacctacaccgccaccagcagcaccagcagagccctgatcctgtag

SEQ ID NO: 13505 - DNA, 2079 bp, Artificial Sequence
  Description of Artificial Sequence: Synthetic coding sequence
atggccaagagaagcagaagcgaggacgaggacgacgacctgcagtacgccgaccacgactacgaggtgccccagcagaagggcctgaagaagctgtggaacagagtgaagtggaccagagacgaggacgacaagctgaagaagctggtggagcagcacggcaccgacgactggaccctgatcgccagccacctgcagaacagaagcgacttccagtgccagcacagatggcagaaggtgctgaaccccgagctgatcaagggcccctggaccaaggaggaggaccagagagtgatcgagctggtgcagaagtacggccccaagagatggagcctgatcgccaagcacctgaagggcagaatcggcaagcagtgcagagagagatggcacaaccacctgaaccccgaggtgaagaagagcagctggaccgaggaggaggacagaatcatctacgaggcccacaagagactgggcaacagatgggccgagatcgccaagctgctgcccggcagaaccgacaacagcatcaagaaccactggaacagcaccatgagaagaaaggtggagcaggagggctacctgcaggacggcatcaagagcgagagaagcagcagcaagctgcagcacaagccctgcgccgccatggaccacatgcagacccagaaccagttctacatccccgtgcagatccccggctaccagtacgtgagccccgagggcaactgcatcgagcacgtgcagcccaccagcgccttcatccagcagcccttcatcgacgaggaccccgacaaggagaagaagatcaaggagctggagatgctgctgatgagcgccgagaacgaggtgagaagaaagagaatccccagccagcccggcagcttcagcagctggagcggcagcttcctgatggacgacaacatgagcaacaccctgaacagcctggacgagcacaccagcgagttctacagcatggacgagaaccagcccgtgagcgcccagcagaacagccccaccaagttcctggccgtggaggccaacgccgtgctgagcagcctgcagaccatccccgagttcgccgagaccctggagctgatcgagagcgaccccgtggcctggagcgacgtgaccagcttcgacatcagcgacgccgccgccagccccatcaagagcacccccgtgaagctgatgagaatccagcacaacgagggcgccatggagtgccagttcaacgtgagcctggtgctggagggcaagaagaacacctgcaacggcggcaacagcgaggccgtgcccctgaccagccccaacatcgccaagttcagcaccccccccgccatcctgagaaagaagagaaagatgagagtgggccacagccccggcagcgagctgagagacggcagcctgaacgacggcggcaacatggccctgaagcacacccccctgaagaccctgcccttcagccccagccagttcttcaacacctgccccggcaacgagcagctgaacatcgagaaccccagcttcaccagcacccccatctgcggccagaaggccctgatcaccacccccctgcacaaggagaccacccccaaggaccagaaggagaacgtgggcttcagaacccccaccatcagaagaagcatcctgggcaccacccccagaacccccacccccttcaagaacgccctggccgcccaggagaagaagtacggccccctgaagatcgtgagccagcccctggccttcctggaggaggacatcagagaggtgctgaaggaggagaccggcaccgacctgttcctgaaggaggaggacgagcccgcctacaagagctgcaagcaggagaacaccgccagcggcaagaaggtgagaaagagcctggtgctggacaactgggagaaggaggagagcggcacccagctgctgaccgaggacatcagcgacatgcagagcaactgcgagtgggagaccgtggtgtacggcaagaccgaggaccagctgatcatgaccgagcaggccagaagatacctgagcacctacaccgccaccagcagcaccagcagagccctgatcctgtag

SEQ ID NO: 13506 - DNA, 711 bp, Artificial Sequence
  Description of Artificial Sequence: Synthetic coding sequence
atgtgcgtgtgcgccggctgcagagccgcccccagcagaagaggcgccggccccctgcaggtggccggcggctggagcgagggcgccgacatggactacgacagctaccagcactacttctacgactacgactgcggcgaggacttctacagaagcaccgcccccagcgaggacatctggaagaagttcgagctggtgcccagcccccccaccagccccccctggggcctgggccccggcgccggcgaccccgcccccggcatcggcccccccgagccctggcccggcggctgcaccggcgacgaggccgagagcagaggccacagcaagggctggggcagaaactacgccagcatcatcagaagagactgcatgtggagcggcttcagcgccagagagagactggagagagccgtgagcgacagactggcccccggcgcccccagaggcaacccccccaaggccagcgccgcccccgactgcacccccagcctggaggccggcaaccccgcccccgccgccccctgccccctgggcgagcccaagacccaggcctgcagcggcagcgagagccccagcgacagcggcaaggacctgcccgagcccagcaagagaggccccccccacggctggcccaagctgtgcccctgcctgagaagcggcatcggcagcagccaggccctgggccccagcccccccctgttcggctag

SEQ ID NO: 13507 - DNA, 1095 bp, Artificial Sequence
  Description of Artificial Sequence: Synthetic coding sequence
atggactacgacagctaccagcactacttctacgactacgactgcggcgaggacttctacagaagcaccgcccccagcgaggacatctggaagaagttcgagctggtgcccagcccccccaccagccccccctggggcctgggccccggcgccggcgaccccgcccccggcatcggcccccccgagccctggcccggcggctgcaccggcgacgaggccgagagcagaggccacagcaagggctggggcagaaactacgccagcatcatcagaagagactgcatgtggagcggcttcagcgccagagagagactggagagagccgtgagcgacagactggcccccggcgcccccagaggcaacccccccaaggccagcgccgcccccgactgcacccccagcctggaggccggcaaccccgcccccgccgccccctgccccctgggcgagcccaagacccaggcctgcagcggcagcgagagccccagcgacagcgagaacgaggagatcgacgtggtgaccgtggagaagagacagagcctgggcatcagaaagcccgtgaccatcaccgtgagagccgaccccctggacccctgcatgaagcacttccacatcagcatccaccagcagcagcacaactacgccgccagattcccccccgagagctgcagccaggaggaggccagcgagagaggcccccaggaggaggtgctggagagagacgccgccggcgagaaggaggacgaggaggacgaggagatcgtgagccccccccccgtggagagcgaggccgcccagagctgccaccccaagcccgtgagcagcgacaccgaggacgtgaccaagagaaagaaccacaacttcctggagagaaagagaagaaacgacctgagaagcagattcctggccctgagagaccaggtgcccaccctggccagctgcagcaaggcccccaaggtggtgatcctgagcaaggccctggagtacctgcaggccctggtgggcgccgagaagagaatggccaccgagaagagacagctgagatgcagacagcagcagctgcagaagagaatcgcctacctgaccggctactag

SEQ ID NO: 13508 - DNA, 1185 bp, Artificial Sequence
  Description of Artificial Sequence: Synthetic coding sequence
atgtgcgtgtgcgccggctgcagagccgcccccagcagaagaggcgccggccccctgcaggtggccggcggctggagcgagggcgccgacatggactacgacagctaccagcactacttctacgactacgactgcggcgaggacttctacagaagcaccgcccccagcgaggacatctggaagaagttcgagctggtgcccagcccccccaccagccccccctggggcctgggccccggcgccggcgaccccgcccccggcatcggcccccccgagccctggcccggcggctgcaccggcgacgaggccgagagcagaggccacagcaagggctggggcagaaactacgccagcatcatcagaagagactgcatgtggagcggcttcagcgccagagagagactggagagagccgtgagcgacagactggcccccggcgcccccagaggcaacccccccaaggccagcgccgcccccgactgcacccccagcctggaggccggcaaccccgcccccgccgccccctgccccctgggcgagcccaagacccaggcctgcagcggcagcgagagccccagcgacagcgagaacgaggagatcgacgtggtgaccgtggagaagagacagagcctgggcatcagaaagcccgtgaccatcaccgtgagagccgaccccctggacccctgcatgaagcacttccacatcagcatccaccagcagcagcacaactacgccgccagattcccccccgagagctgcagccaggaggaggccagcgagagaggcccccaggaggaggtgctggagagagacgccgccggcgagaaggaggacgaggaggacgaggagatcgtgagccccccccccgtggagagcgaggccgcccagagctgccaccccaagcccgtgagcagcgacaccgaggacgtgaccaagagaaagaaccacaacttcctggagagaaagagaagaaacgacctgagaagcagattcctggccctgagagaccaggtgcccaccctggccagctgcagcaaggcccccaaggtggtgatcctgagcaaggccctggagtacctgcaggccctggtgggcgccgagaagagaatggccaccgagaagagacagctgagatgcagacagcagcagctgcagaagagaatcgcctacctgaccggctactag

SEQ ID NO: 13509 - DNA, 621 bp, Artificial Sequence
  Description of Artificial Sequence: Synthetic coding sequence
atggactacgacagctaccagcactacttctacgactacgactgcggcgaggacttctacagaagcaccgcccccagcgaggacatctggaagaagttcgagctggtgcccagcccccccaccagccccccctggggcctgggccccggcgccggcgaccccgcccccggcatcggcccccccgagccctggcccggcggctgcaccggcgacgaggccgagagcagaggccacagcaagggctggggcagaaactacgccagcatcatcagaagagactgcatgtggagcggcttcagcgccagagagagactggagagagccgtgagcgacagactggcccccggcgcccccagaggcaacccccccaaggccagcgccgcccccgactgcacccccagcctggaggccggcaaccccgcccccgccgccccctgccccctgggcgagcccaagacccaggcctgcagcggcagcgagagccccagcgacagcggcaaggacctgcccgagcccagcaagagaggccccccccacggctggcccaagctgtgcccctgcctgagaagcggcatcggcagcagccaggccctgggccccagcccccccctgttcggctag

SEQ ID NO: 13510 - DNA, 303 bp, Artificial Sequence
  Description of Artificial Sequence: Synthetic coding sequence
atggactacgacagctaccagcactacttctacgactacgactgcggcgaggacttctacagaagcaccgcccccagcgaggacatctggaagaagttcgagctggtgcccagcccccccaccagccccccctggggcctgggccccggcgccggcgaccccgcccccggcatcggcccccccgagccctggcccggcggctgcaccggcgacgaggccgagagcagaggccacagcaagggctggggcagaaactacgccagcatcatcagaagagactgcatgtggagcggcttcagctag

SEQ ID NO: 13511 - DNA, 642 bp, Artificial Sequence
  Description of Artificial Sequence: Synthetic coding sequence
atgcccagaagagccgagaactgggacgaggccgaggtgggcgccgaggaggccggcgtggaggagtacggccccgaggaggacggcggcgaggagagcggcgccgaggagagcggccccgaggagagcggccccgaggagctgggcgccgaggaggagatggaggccggcagacccagacccgtgctgagaagcgtgaacagcagagagcccagccaggtgatcttctgcaacagaagccccagagtggtgctgcccgtgtggctgaacttcgacggcgagccccagccctaccccaccctgccccccggcaccggcagaagaatccacagctacagaggccacctgtggctgttcagagacgccggcacccacgacggcctgctggtgaaccagaccgagctgttcgtgcccagcctgaacgtggacggccagcccatcttcgccaacatcaccctgcccgtgtacaccctgaaggagagatgcctgcaggtggtgagaagcctggtgaagcccgagaactacagaagactggacatcgtgagaagcctgtacgaggacctggaggaccaccccaacgtgcagaaggacctggagagactgacccaggagagaatcgcccaccagagaatgggcgactag

SEQ ID NO: 13512 - DNA, 519 bp, Artificial Sequence
  Description of Artificial Sequence: Synthetic coding sequence
atgcccagaagagccgagaactgggacgaggccgaggtgggcgccgaggaggccggcgtggaggagtacggccccgaggaggacggcggcgaggagagcggcgccgaggagagcggccccgaggagagcggccccgaggagctgggcgccgaggaggagatggaggccggcagacccagacccgtgctgagaagcgtgaacagcagagagcccagccaggtgatcttctgcaacagaagccccagagtggtgctgcccgtgtggctgaacttcgacggcgagccccagccctaccccaccctgccccccggcaccggcagaagaatccacagctacagagtgtacaccctgaaggagagatgcctgcaggtggtgagaagcctggtgaagcccgagaactacagaagactggacatcgtgagaagcctgtacgaggacctggaggaccaccccaacgtgcagaaggacctggagagactgacccaggagagaatcgcccaccagagaatgggcgactag

SEQ ID NO: 13513 - DNA, 396 bp, Artificial Sequence
  Description of Artificial Sequence: Synthetic coding sequence
atgcccagaagagccgagaactgggacgaggccgaggtgggcgccgaggaggccggcgtggaggagtacggccccgaggaggacagctacagaggccacctgtggctgttcagagacgccggcacccacgacggcctgctggtgaaccagaccgagctgttcgtgcccagcctgaacgtggacggccagcccatcttcgccaacatcaccctgcccgtgtacaccctgaaggagagatgcctgcaggtggtgagaagcctggtgaagcccgagaactacagaagactggacatcgtgagaagcctgtacgaggacctggaggaccaccccaacgtgcagaaggacctggagagactgacccaggagagaatcgcccaccagagaatgggcgactag

SEQ ID NO: 13514 - DNA, 1281 bp, Artificial Sequence
  Description of Artificial Sequence: Synthetic coding sequence
atggtgcacttctgcggcctgctgaccctgcacagagagcccgtgcccctgaagagcatcagcgtgagcgtgaacatctacgagttcgtggccggcgtgagcgccaccctgaactacgagaacgaggagaaggtgcccctggaggccttcttcgtgttccccatggacgaggacagcgccgtgtacagcttcgaggccctggtggacggcaagaagatcgtggccgagctgcaggacaagatgaaggccagaaccaactacgagaaggccatcagccagggccaccaggccttcctgctggagggcgacagcagcagcagagacgtgttcagctgcaacgtgggcaacctgcagcccggcagcaaggccgccgtgaccctgaagtacgtgcaggagctgcccctggaggccgacggcgccctgagattcgtgctgcccgccgtgctgaaccccagataccagttcagcggcagcagcaaggacagctgcctgaacgtgaagacccccatcgtgcccgtggaggacctgccctacaccctgagcatggtggccaccatcgacagccagcacggcatcgagaaggtgcagagcaactgccccctgagccccaccgagtacctgggcgaggacaagaccagcgcccaggtgagcctggccgccggccacaagttcgacagagacgtggagctgctgatctactacaacgaggtgcacacccccagcgtggtgctggagatgggcatgcccaacatgaagcccggccacctgatgggcgaccccagcgccatggtgagcttctaccccaacatccccgaggaccagcccagcaacacctgcggcgagttcatcttcctgatggacagaagcggcagcatgcagagccccatgagcagccaggacaccagccagctgagaatccaggccgccaaggagaccctgatcctgctgctgaagagcctgcccatcggctgctacttcaacatctacggcttcggcagcagctacgaggcctgcttccccgagagcgtgaagtacacccagcagaccatggaggaggccctgggcagagtgaagctgatgcaggccgacctgggcggcaccgagatcctggcccccctgcagaacatctacagaggccccagcatccccggccaccccctgcaggtgttcgagagaccctacaccctgaccgtgctgctgctgcacctgagccccgagggcaacctgtgcgtgatcagacccagacacagcagatggaccatcaccgtgagcgtgggctag

SEQ ID NO: 13515 - DNA, 2361 bp, Artificial Sequence
  Description of Artificial Sequence: Synthetic coding sequence
atggtgcacttctgcggcctgctgaccctgcacagagagcccgtgcccctgaagagcatcagcgtgagcgtgaacatctacgagttcgtggccggcgtgagcgccaccctgaactacgagaacgaggagaaggtgcccctggaggccttcttcgtgttccccatggacgaggacagcgccgtgtacagcttcgaggccctggtggacggcaagaagatcgtggccgagctgcaggacaagatgaaggccagaaccaactacgagaaggccatcagccagggccaccaggccttcctgctggagggcgacagcagcagcagagacgtgttcagctgcaacgtgggcaacctgcagcccggcagcaaggccgccgtgaccctgaagtacgtgcaggagctgcccctggaggccgacggcgccctgagattcgtgctgcccgccgtgctgaaccccagataccagttcagcggcagcagcaaggacagctgcctgaacgtgaagacccccatcgtgcccgtggaggacctgccctacaccctgagcatggtggccaccatcgacagccagcacggcatcgagaaggtgcagagcaactgccccctgagccccaccgagtacctgggcgaggacaagaccagcgcccaggtgagcctggccgccggccacaagttcgacagagacgtggagctgctgatctactacaacgaggtgcacacccccagcgtggtgctggagatgggcatgcccaacatgaagcccggccacctgatgggcgaccccagcgccatggtgagcttctaccccaacatccccgaggaccagcccagcaacacctgcggcgagttcatcttcctgatggacagaagcggcagcatgcagagccccatgagcagccaggacaccagccagctgagaatccaggccgccaaggagaccctgatcctgctgctgaagagcctgcccatcggctgctacttcaacatctacggcttcggcagcagctacgaggcctgcttccccgagagcgtgaagtacacccagcagaccatggaggaggccctgggcagagtgaagctgatgcaggccgacctgggcggcaccgagatcctggcccccctgcagaacatctacagaggccccagcatccccggccaccccctgcagctgttcgtgttcaccgacggcgaggtgaccgacaccttcagcgtgatcaaggaggtgagaatcaacagacagaagcacagatgcttcagcttcggcatcggcgagggcaccagcaccagcctgatcaagggcatcgccagagccagcggcggcaccagcgagttcatcaccggcaaggacagaatgcagagcaaggccctgagaaccctgaagagaagcctgcagcccgtggtggaggacgtgagcctgagctggcacctgccccccggcctgagcgccaagatgctgagccccgagcagaccgtgatcttcagaggccagagactgatcagctacgcccagctgaccggcagaatgcccgccgccgagaccaccggcgaggtgtgcctgaagtacaccctgcagggcaagaccttcgaggacaaggtgaccttccccctgcagcccaagcccgacgtgaacctgaccatccacagactggccgccaagagcctgctgcagaccaaggacatgggcctgagagagacccccgccagcgacaagaaggacgccctgaacctgagcctggagagcggcgtgatcagcagcttcaccgccttcatcgccatcaacaaggagctgaacaagcccgtgcagggccccctggcccacagagacgtgcccagacccatcctgctgggcgccagcgcccccctgaagatcaagtgccagagcggcttcagaaaggccctgcacagcgacagaccccccagcgccagccagcccagaggcgagctgatgtgctacaaggccaagaccttccagatggacgactacagcctgtgcggcctgatcagccacaaggaccagcacagccccggcttcggcgagaaccacctggtgcagctgatctaccaccagaacgccaacggcagctgggacctgaacgaggacctggccaagatcctgggcatgagcctggaggagatcatggccgcccagcccgccgagctggtggacagcagcggctgggccaccatcctggccgtgatctggctgcacagcaacggcaaggacctgaagtgcgagtgggagctgctggagagaaaggccgtggcctggatgagagcccacgccggcagcaccatgcccagcgtggtgaaggccgccatcaccttcctgaagagcagcgtggaccccgccatcttcgccttctag

SEQ ID NO: 13516 - DNA, 1248 bp, Artificial Sequence
  Description of Artificial Sequence: Synthetic coding sequence
atggtgcacttctgcggcctgctgaccctgcacagagagcccgtgcccctgaagagcatcagcgtgagcgtgaacatctacgagttcgtggccggcgtgagcgccaccctgaactacgagaacgaggagaaggtgcccctggaggccttcttcgtgttccccatggacgaggacagcgccgtgtacagcttcgaggccctggtggacggcaagaagatcgtggccgagctgcaggacaagatgaaggccagaaccaactacgagaaggccatcagccagggccaccaggccttcctgctggagggcgacagcagcagcagagacgtgttcagctgcaacgtgggcaacctgcagcccggcagcaaggccgccgtgaccctgaagtacgtgcaggagctgcccctggaggccgacggcgccctgagattcgtgctgcccgccgtgctgaaccccagataccagttcagcggcagcagcaaggacagctgcctgaacgtgaagacccccatcgtgcccgtggaggacctgccctacaccctgagcatggtggccaccatcgacagccagcacggcatcgagaaggtgcagagcaactgccccctgagccccaccgagtacctgggcgaggacaagaccagcgcccaggtgagcctggccgccggccacaagttcgacagagacgtggagctgctgatctactacaacgaggtgcacacccccagcgtggtgctggagatgggcatgcccaacatgaagcccggccacctgatgggcgaccccagcgccatggtgagcttctaccccaacatccccgaggaccagcccagcaacacctgcggcgagttcatcttcctgatggacagaagcggcagcatgcagagccccatgagcagccaggacaccagccagctgagaatccaggccgccaaggagaccctgatcctgctgctgaagagcctgcccatcggctgctacttcaacatctacggcttcggcagcagctacgaggcctgcttccccgagagcgtgaagtacacccagcagaccatggaggaggccctgggcagagtgaagctgatgcaggccgacctgggcggcaccgagatcctggcccccctgcagaacatctacagaggccccagcatccccggccaccccctgcagctgttcgtgttcaccgacggcgaggtgaccgacaccttcagcgtgatcaaggaggtgagaatcaacagacagaagcacagatag

SEQ ID NO: 13517 - DNA, 2361 bp, Artificial Sequence; identical to SEQ ID NO: 13515
  Description of Artificial Sequence: Synthetic coding sequence

SEQ ID NO: 13518 - DNA, 1248 bp, Artificial Sequence; identical to SEQ ID NO: 13516
  Description of Artificial Sequence: Synthetic coding sequence

SEQ ID NO: 13519 - DNA, 2301 bp, Artificial Sequence
  Description of Artificial Sequence: Synthetic coding sequence
atggccgccctgagcggcggcggcggcggcggcgccgagcccggccaggccctgttcaacggcgacatggagcccgaggccggcgccggcgccggcgccgccgccagcagcgccgccgaccccgccatccccgaggaggtgtggaacatcaagcagatgatcaagctgacccaggagcacatcgaggccctgctggacaagttcggcggcgagcacaacccccccagcatctacctggaggcctacgaggagtacaccagcaagctggacgccctgcagcagagagagcagcagctgctggagagcctgggcaacggcaccgacttcagcgtgagcagcagcgccagcatggacaccgtgaccagcagcagcagcagcagcctgagcgtgctgcccagcagcctgagcgtgttccagaaccccaccgacgtggccagaagcaaccccaagagcccccagaagcccatcgtgagagtgttcctgcccaacaagcagagaaccgtggtgcccgccagatgcggcgtgaccgtgagagacagcctgaagaaggccctgatgatgagaggcctgatccccgagtgctgcgccgtgtacagaatccaggacggcgagaagaagcccatcggctgggacaccgacatcagctggctgaccggcgaggagctgcacgtggaggtgctggagaacgtgcccctgaccacccacaacttcgtgagaaagaccttcttcaccctggccttctgcgacttctgcagaaagctgctgttccagggcttcagatgccagacctgcggctacaagttccaccagagatgcagcaccgaggtgcccctgatgtgcgtgaactacgaccagctggacctgctgttcgtgagcaagttcttcgagcaccaccccatcccccaggaggaggccagcctggccgagaccgccctgaccagcggcagcagccccagcgcccccgccagcgacagcatcggcccccagatcctgaccagccccagccccagcaagagcatccccatcccccagcccttcagacccgccgacgaggaccacagaaaccagttcggccagagagacagaagcagcagcgcccccaacgtgcacatcaacaccatcgagcccgtgaacatcgacgacctgatcagagaccagggcttcagaggcgacggcggcagcaccaccggcctgagcgccaccccccccgccagcctgcccggcagcctgaccaacgtgaaggccctgcagaagagccccggcccccagagagagagaaagagcagcagcagcagcgaggacagaaacagaatgaagaccctgggcagaagagacagcagcgacgactgggagatccccgacggccagatcaccgtgggccagagaatcggcagcggcagcttcggcaccgtgtacaagggcaagtggcacggcgacgtggccgtgaagatgctgaacgtgaccgcccccaccccccagcagctgcaggccttcaagaacgaggtgggcgtgctgagaaagaccagacacgtgaacatcctgctgttcatgggctacagcaccaagccccagctggccatcgtgacccagtggtgcgagggcagcagcctgtaccaccacctgcacatcatcgagaccaagttcgagatgatcaagctgatcgacatcgccagacagaccgcccagggcatggactacctgcacgccaagagcatcatccacagagacctgaagagcaacaacatcttcctgcacgaggacctgaccgtgaagatcggcgacttcggcctggccaccgtgaagagcagatggagcggcagccaccagttcgagcagctgagcggcagcatcctgtggatggcccccgaggtgatcagaatgcaggacaagaacccctacagcttccagagcgacgtgtacgccttcggcatcgtgctgtacgagctgatgaccggccagctgccctacagcaacatcaacaacagagaccagatcatcttcatggtgggcagaggctacctgagccccgacctgagcaaggtgagaagcaactgccccaaggccatgaagagactgatggccgagtgcctgaagaagaagagagacgagagacccctgttcccccagatcctggccagcatcgagctgctggccagaagcctgcccaagatccacagaagcgccagcgagcccagcctgaacagagccggcttccagaccgaggacttcagcctgtacgcctgcgccagccccaagacccccatccaggccggcggctacggcgccttccccgtgcactag

SEQ ID NO: 13520 - DNA, 1947 bp, Artificial Sequence
  Description of Artificial Sequence: Synthetic coding sequence
atggagcacatccagggcgcctggaagaccatcagcaacggcttcggcttcaaggacgccgtgttcgacggcagcagctgcatcagccccaccatcgtgcagcagttcggctaccagagaagagccagcgacgacggcaagctgaccgaccccagcaagaccagcaacaccatcagagtgttcctgcccaacaagcagagaaccgtggtgaacgtgagaaacggcatgagcctgcacgactgcctgatgaaggccctgaaggtgagaggcctgcagcccgagtgctgcgccgtgttcagactgctgcacgagcacaagggcaagaaggccagactggactggaacaccgacgccgccagcctgatcggcgaggagctgcaggtggacttcctggaccacgtgcccctgaccacccacaacttcgccagaaagaccttcctgaagctggccttctgcgacatctgccagaagttcctgctgaacggcttcagatgccagacctgcggctacaagttccacgagcactgcagcaccaaggtgcccaccatgtgcgtggactggagcaacatcagacagctgctgctgttccccaacagcaccatcggcgacagcggcgtgcccgccctgcccagcctgaccatgagaagaatgagagagagcgtgagcagaatgcccgtgagcagccagcacagatacagcaccccccacgccttcaccttcaacaccagcagccccagcagcgagggcagcctgagccagagacagagaagcaccagcacccccaacgtgcacatggtgagcaccaccctgcccgtggacagcagaatgatcgaggacgccatcagaagccacagcgagagcgccagccccagcgccctgagcagcagccccaacaacctgagccccaccggctggagccagcccaagacccccgtgcccgcccagagagagagagcccccgtgagcggcacccaggagaagaacaagatcagacccagaggccagagagacagcagctactactgggagatcgaggccagcgaggtgatgctgagcaccagaatcggcagcggcagcttcggcaccgtgtacaagggcaagtggcacggcgacgtggccgtgaagatcctgaaggtggtggaccccacccccgagcagttccaggccttcagaaacgaggtggccgtgctgagaaagaccagacacgtgaacatcctgctgttcatgggctacatgaccaaggacaacctggccatcgtgacccagtggtgcgagggcagcagcctgtacaagcacctgcacgtgcaggagaccaagttccagatgttccagctgatcgacatcgccagacagaccgcccagggcatggactacctgcacgccaagaacatcatccacagagacatgaagagcaacaacatcttcctgcacgagggcctgaccgtgaagatcggcgacttcggcctggccaccgtgaagagcagatggagcggcagccagcaggtggagcagcccaccggcagcgtgctgtggatggcccccgaggtgatcagaatgcaggacaacaaccccttcagcttccagagcgacgtgtacagctacggcatcgtgctgtacgagctgatgaccggcgagctgccctacagccacatcaacaacagagaccagatcatcttcatggtgggcagaggctacgccagccccgacctgagcaagctgtacaagaactgccccaaggccatgaagagactggtggccgactgcgtgaagaaggtgaaggaggagagacccctgttcccccagatcctgagcagcatcgagctgctgcagcacagcctgcccaagatcaacagaagcgccagcgagcccagcctgcacagagccgcccacaccgaggacatcaacgcctgcaccctgaccaccagccccagactgcccgtgttctag

SEQ ID NO: 13521 - DNA, 2007 bp, Artificial Sequence
  Description of Artificial Sequence: Synthetic coding sequence
atggagcacatccagggcgcctggaagaccatcagcaacggcttcggcttcaaggacgccgtgttcgacggcagcagctgcatcagccccaccatcgtgcagcagttcggctaccagagaagagccagcgacgacggcaagctgaccgaccccagcaagaccagcaacaccatcagagtgttcctgcccaacaagcagagaaccgtggtgaacgtgagaaacggcatgagcctgcacgactgcctgatgaaggccctgaaggtgagaggcctgcagcccgagtgctgcgccgtgttcagactgctgcacgagcacaagggcaagaaggccagactggactggaacaccgacgccgccagcctgatcggcgaggagctgcaggtggacttcctggaccacgtgcccctgaccacccacaacttcgccagaaagaccttcctgaagctggccttctgcgacatctgccagaagttcctgctgaacggcttcagatgccagacctgcggctacaagttccacgagcactgcagcaccaaggtgcccaccatgtgcgtggactggagcaacatcagacagctgctgctgttccccaacagcaccatcggcgacagcggcgtgcccgccctgcccagcctgaccatgagaagaatgagagagagcgtgagcagaatgcccgtgagcagccagcacagatacagcaccccccacgccttcaccttcaacaccagcagccccagcagcgagggcagcctgagccagagacagagaagcaccagcacccccaacgtgcacatggtgagcaccaccctgcccgtggacagcagaatgatcgagaacaacaacctgagcgccagccccagagcctggagcagaagattctgcctgagaggcagagacgccatcagaagccacagcgagagcgccagccccagcgccctgagcagcagccccaacaacctgagccccaccggctggagccagcccaagacccccgtgcccgcccagagagagagagcccccgtgagcggcacccaggagaagaacaagatcagacccagaggccagagagacagcagctactactgggagatcgaggccagcgaggtgatgctgagcaccagaatcggcagcggcagcttcggcaccgtgtacaagggcaagtggcacggcgacgtggccgtgaagatcctgaaggtggtggaccccacccccgagcagttccaggccttcagaaacgaggtggccgtgctgagaaagaccagacacgtgaacatcctgctgttcatgggctacatgaccaaggacaacctggccatcgtgacccagtggtgcgagggcagcagcctgtacaagcacctgcacgtgcaggagaccaagttccagatgttccagctgatcgacatcgccagacagaccgcccagggcatggactacctgcacgccaagaacatcatccacagagacatgaagagcaacaacatcttcctgcacgagggcctgaccgtgaagatcggcgacttcggcctggccaccgtgaagagcagatggagcggcagccagcaggtggagcagcccaccggcagcgtgctgtggatggcccccgaggtgatcagaatgcaggacaacaaccccttcagcttccagagcgacgtgtacagctacggcatcgtgctgtacgagctgatgaccggcgagctgccctacagccacatcaacaacagagaccagatcatcttcatggtgggcagaggctacgccagccccgacctgagcaagctgtacaagaactgccccaaggccatgaagagactggtggccgactgcgtgaagaaggtgaaggaggagagacccctgttcccccagatcctgagcagcatcgagctgctgcagcacagcctgcccaagatcaacagaagcgccagcgagcccagcctgcacagagccgcccacaccgaggacatcaacgcctgcaccctgaccaccagccccagactgcccgtgttctag

SEQ ID NO: 13522 - DNA, 1302 bp, Artificial Sequence
  Description of Artificial Sequence: Synthetic coding sequence
atgtgcgtggactggagcaacatcagacagctgttcagccagcacagatacagcaccccccacgccttcaccttcaacaccagcagccccagcagcgagggcagcctgagccagagacagagaagcaccagcacccccaacgtgcacatggtgagcaccaccctgcccgtggacagcagaatgatcgaggacgccatcagaagccacagcgagagcgccagccccagcgccctgagcagcagccccaacaacctgagccccaccggctggagccagcccaagacccccgtgcccgcccagagagagagagcccccgtgagcggcacccaggagaagaacaagatcagacccagaggccagagagacagcagctactactgggagatcgaggccagcgaggtgatgctgagcaccagaatcggcagcggcagcttcggcaccgtgtacaagggcaagtggcacggcgacgtggccgtgaagatcctgaaggtggtggaccccacccccgagcagttccaggccttcagaaacgaggtggccgtgctgagaaagaccagacacgtgaacatcctgctgttcatgggctacatgaccaaggacaacctggccatcgtgacccagtggtgcgagggcagcagcctgtacaagcacctgcacgtgcaggagaccaagttccagatgttccagctgatcgacatcgccagacagaccgcccagggcatggactacctgcacgccaagaacatcatccacagagacatgaagagcaacaacatcttcctgcacgagggcctgaccgtgaagatcggcgacttcggcctggccaccgtgaagagcagatggagcggcagccagcaggtggagcagcccaccggcagcgtgctgtggatggcccccgaggtgatcagaatgcaggacaacaaccccttcagcttccagagcgacgtgtacagctacggcatcgtgctgtacgagctgatgaccggcgagctgccctacagccacatcaacaacagagaccagatcatcttcatggtgggcagaggctacgccagccccgacctgagcaagctgtacaagaactgccccaaggccatgaagagactggtggccgactgcgtgaagaaggtgaaggaggagagacccctgttcccccagatcctgagcagcatcgagctgctgcagcacagcctgcccaagatcaacagaagcgccagcgagcccagcctgcacagagccgcccacaccgaggacatcaacgcctgcaccctgaccaccagccccagactgcccgtgttctag

SEQ ID NO: 13523 - DNA, 1704 bp, Artificial Sequence
  Description of Artificial Sequence: Synthetic coding sequence
atgatggccaacagccagatcctgctgagacaggccaccctgagcgtgttcagctgcagaaccagcaaggagcagtgcaagaaggccagactggactggaacaccgacgccgccagcctgatcggcgaggagctgcaggtggacttcctggaccacgtgcccctgaccacccacaacttcgccagaaagaccttcctgaagctggccttctgcgacatctgccagaagttcctgctgaacggcttcagatgccagacctgcggctacaagttccacgagcactgcagcaccaaggtgcccaccatgtgcgtggactggagcaacatcagacagctgctgctgttccccaacagcaccatcggcgacagcggcgtgcccgccctgcccagcctgaccatgagaagaatgagagagagcgtgagcagaatgcccgtgagcagccagcacagatacagcaccccccacgccttcaccttcaacaccagcagccccagcagcgagggcagcctgagccagagacagagaagcaccagcacccccaacgtgcacatggtgagcaccaccctgcccgtggacagcagaatgatcgaggacgccatcagaagccacagcgagagcgccagccccagcgccctgagcagcagccccaacaacctgagccccaccggctggagccagcccaagacccccgtgcccgcccagagagagagagcccccgtgagcggcacccaggagaagaacaagatcagacccagaggccagagagacagcagctactactgggagatcgaggccagcgaggtgatgctgagcaccagaatcggcagcggcagcttcggcaccgtgtacaagggcaagtggcacggcgacgtggccgtgaagatcctgaaggtggtggaccccacccccgagcagttccaggccttcagaaacgaggtggccgtgctgagaaagaccagacacgtgaacatcctgctgttcatgggctacatgaccaaggacaacctggccatcgtgacccagtggtgcgagggcagcagcctgtacaagcacctgcacgtgcaggagaccaagttccagatgttccagctgatcgacatcgccagacagaccgcccagggcatggactacctgcacgccaagaacatcatccacagagacatgaagagcaacaacatcttcctgcacgagggcctgaccgtgaagatcggcgacttcggcctggccaccgtgaagagcagatggagcggcagccagcaggtggagcagcccaccggcagcgtgctgtggatggcccccgaggtgatcagaatgcaggacaacaaccccttcagcttccagagcgacgtgtacagctacggcatcgtgctgtacgagctgatgaccggcgagctgccctacagccacatcaacaacagagaccagatcatcttcatggtgggcagaggctacgccagccccgacctgagcaagctgtacaagaactgccccaaggccatgaagagactggtggccgactgcgtgaagaaggtgaaggaggagagacccctgttcccccagatcctgagcagcatcgagctgctgcagcacagcctgcccaagatcaacagaagcgccagcgagcccagcctgcacagagccgcccacaccgaggacatcaacgcctgcaccctgaccaccagccccagactgcccgtgttctag

SEQ ID NO: 13524 - DNA, 1611 bp, Artificial Sequence
  Description of Artificial Sequence: Synthetic coding sequence
atgggcagcaacaagagcaagcccaaggacgccagccagagaagaagaagcctggagcccgccgagaacgtgcacggcgccggcggcggcgccttccccgccagccagacccccagcaagcccgccagcgccgacggccacagaggccccagcgccgccttcgcccccgccgccgccgagcccaagctgttcggcggcttcaacagcagcgacaccgtgaccagcccccagagagccggccccctggccggcggcgtgaccaccttcgtggccctgtacgactacgagagcagaaccgagaccgacctgagcttcaagaagggcgagagactgcagatcgtgaacaacaccgagggcgactggtggctggcccacagcctgagcaccggccagaccggctacatccccagcaactacgtggcccccagcgacagcatccaggccgaggagtggtacttcggcaagatcaccagaagagagagcgagagactgctgctgaacgccgagaaccccagaggcaccttcctggtgagagagagcgagaccaccaagggcgcctactgcctgagcgtgagcgacttcgacaacgccaagggcctgaacgtgaagcactacaagatcagaaagctggacagcggcggcttctacatcaccagcagaacccagttcaacagcctgcagcagctggtggcctactacagcaagcacgccgacggcctgtgccacagactgaccaccgtgtgccccaccagcaagccccagacccagggcctggccaaggacgcctgggagatccccagagagagcctgagactggaggtgaagctgggccagggctgcttcggcgaggtgtggatgggcacctggaacggcaccaccagagtggccatcaagaccctgaagcccggcaccatgagccccgaggccttcctgcaggaggcccaggtgatgaagaagctgagacacgagaagctggtgcagctgtacgccgtggtgagcgaggagcccatctacatcgtgaccgagtacatgagcaagggcagcctgctggacttcctgaagggcgagaccggcaagtacctgagactgccccagctggtggacatggccgcccagatcgccagcggcatggcctacgtggagagaatgaactacgtgcacagagacctgagagccgccaacatcctggtgggcgagaacctggtgtgcaaggtggccgacttcggcctggccagactgatcgaggacaacgagtacaccgccagacagggcgccaagttccccatcaagtggaccgcccccgaggccgccctgtacggcagattcaccatcaagagcgacgtgtggagcttcggcatcctgctgaccgagctgaccaccaagggcagagtgccctaccccggcatggtgaacagagaggtgctggaccaggtggagagaggctacagaatgccctgcccccccgagtgccccgagagcctgcacgacctgatgtgccagtgctggagaaaggagcccgaggagagacccaccttcgagtacctgcaggccttcctggaggactacttcaccagcaccgagccccagtaccagcccggcgagaacctgtag

SEQ ID NO: 13525 - DNA, 1629 bp, Artificial Sequence
  Description of Artificial Sequence: Synthetic coding sequence
atgggcagcaacaagagcaagcccaaggacgccagccagagaagaagaagcctggagcccgccgagaacgtgcacggcgccggcggcggcgccttccccgccagccagacccccagcaagcccgccagcgccgacggccacagaggccccagcgccgccttcgcccccgccgccgccgagcccaagctgttcggcggcttcaacagcagcgacaccgtgaccagcccccagagagccggccccctggccggcggcgtgaccaccttcgtggccctgtacgactacgagagcagaaccgagaccgacctgagcttcaagaagggcgagagactgcagatcgtgaacaacaccagaaaggtggacgtgagagagggcgactggtggctggcccacagcctgagcaccggccagaccggctacatccccagcaactacgtggcccccagcgacagcatccaggccgaggagtggtacttcggcaagatcaccagaagagagagcgagagactgctgctgaacgccgagaaccccagaggcaccttcctggtgagagagagcgagaccaccaagggcgcctactgcctgagcgtgagcgacttcgacaacgccaagggcctgaacgtgaagcactacaagatcagaaagctggacagcggcggcttctacatcaccagcagaacccagttcaacagcctgcagcagctggtggcctactacagcaagcacgccgacggcctgtgccacagactgaccaccgtgtgccccaccagcaagccccagacccagggcctggccaaggacgcctgggagatccccagagagagcctgagactggaggtgaagctgggccagggctgcttcggcgaggtgtggatgggcacctggaacggcaccaccagagtggccatcaagaccctgaagcccggcaccatgagccccgaggccttcctgcaggaggcccaggtgatgaagaagctgagacacgagaagctggtgcagctgtacgccgtggtgagcgaggagcccatctacatcgtgaccgagtacatgagcaagggcagcctgctggacttcctgaagggcgagaccggcaagtacctgagactgccccagctggtggacatggccgcccagatcgccagcggcatggcctacgtggagagaatgaactacgtgcacagagacctgagagccgccaacatcctggtgggcgagaacctggtgtgcaaggtggccgacttcggcctggccagactgatcgaggacaacgagtacaccgccagacagggcgccaagttccccatcaagtggaccgcccccgaggccgccctgtacggcagattcaccatcaagagcgacgtgtggagcttcggcatcctgctgaccgagctgaccaccaagggcagagtgccctaccccggcatggtgaacagagaggtgctggaccaggtggagagaggctacagaatgccctgcccccccgagtgccccgagagcctgcacgacctgatgtgccagtgctggagaaaggagcccgaggagagacccaccttcgagtacctgcaggccttcctggaggactacttcaccagcaccgagccccagtaccagcccggcgagaacctgtag

SEQ ID NO: 13526 - DNA, 1611 bp, Artificial Sequence; identical to SEQ ID NO: 13524
  Description of Artificial Sequence: Synthetic coding sequence

SEQ ID NO: 13527 - DNA, 1611 bp, Artificial Sequence; identical to SEQ ID NO: 13524
  Description of Artificial Sequence: Synthetic coding sequence

SEQ ID NO: 13528 - DNA, 1611 bp, Artificial Sequence; identical to SEQ ID NO: 13524
  Description of Artificial Sequence: Synthetic coding sequence

SEQ ID NO: 13529 - DNA, 423 bp, Artificial Sequence
  Description of Artificial Sequence: Synthetic coding sequence
atgcccctggtgaagagaaacatcgaccccagacacctgtgccacaccgccctgcccagaggcatcaagaacgagctggagtgcgtgaccaacatcagcctggccaacatcatcagacagctgagcagcctgagcaagtacgccgaggacatcttcggcgagctgttcaacgaggcccacagcttcagcttcagagtgaacagcctgcaggagagagtggacagactgagcgtgagcgtgacccagctggaccccaaggaggaggagctgagcctgcaggacatcaccatgagaaaggccttcagaagcagcaccatccaggaccagcagctgttcgacagaaagaccctgcccatccccctgcaggagacctacgacgtgtgcgagcagcccccccccctgaacatcctgaccccctactag

SEQ ID NO: 13530 - DNA, 1680 bp, Artificial Sequence
  Description of Artificial Sequence: Synthetic coding sequence
atgcccctggtgaagagaaacatcgaccccagacacctgtgccacaccgccctgcccagaggcatcaagaacgagctggagtgcgtgaccaacatcagcctggccaacatcatcagacagctgagcagcctgagcaagtacgccgaggacatcttcggcgagctgttcaacgaggcccacagcttcagcttcagagtgaacagcctgcaggagagagtggacagactgagcgtgagcgtgacccagctggaccccaaggaggaggagctgagcctgcaggacatcaccatgagaaaggccttcagaagcagcaccatccaggaccagcagctgttcgacagaaagaccctgcccatccccctgcaggagacctacgacgtgtgcgagcagcccccccccctgaacatcctgaccccctacagagacgacggcaaggagggcctgaagttctacaccaaccccagctacttcttcgacctgtggaaggagaagatgctgcaggacaccgaggacaagagaaaggagaagagaaagcagaagcagaagaacctggacagaccccacgagcccgagaaggtgcccagagccccccacgacagaagaagagagtggcagaagctggcccagggccccgagctggccgaggacgacgccaacctgctgcacaagcacatcgaggtggccaacggccccgccagccacttcgagaccagaccccagacctacgtggaccacatggacggcagctacagcctgagcgccctgcccttcagccagatgagcgagctgctgaccagagccgaggagagagtgctggtgagaccccacgagccccccccccccccccccatgcacggcgccggcgacgccaagcccatccccacctgcatcagcagcgccaccggcctgatcgagaacagaccccagagccccgccaccggcagaacccccgtgttcgtgagccccacccccccccccccccccccccccctgcccagcgccctgagcaccagcagcctgagagccagcatgaccagcaccccccccccccccgtgcccccccccccccccccccccgccaccgccctgcaggcccccgccgtgccccccccccccgcccccctgcagatcgcccccggcgtgctgcaccccgcccccccccccatcgccccccccctggtgcagcccagcccccccgtggccagagccgcccccgtgtgcgagaccgtgcccgtgcaccccctgccccagggcgaggtgcagggcctgccccccccccccccccccccccccctgcccccccccggcatcagacccagcagccccgtgaccgtgaccgccctggcccacccccccagcggcctgcaccccacccccagcaccgcccccggcccccacgtgcccctgatgccccccagcccccccagccaggtgatccccgccagcgagcccaagagacaccccagcaccctgcccgtgatcagcgacgccagaagcgtgctgctggaggccatcagaaagggcatccagctgagaaaggtggaggagcagagagagcaggaggccaagcacgagagaatcgagaacgacgtggccaccatcctgagcagaagaatcgccgtggagtacagcgacagcgaggacgacagcgagttcgacgaggtggactggctggagtag

SEQ ID NO: 13531 - DNA, 423 bp, Artificial Sequence; identical to SEQ ID NO: 13529
  Description of Artificial Sequence: Synthetic coding sequence

SEQ ID NO: 13532 - DNA, 1680 bp, Artificial Sequence; identical to SEQ ID NO: 13530
  Description of Artificial Sequence: Synthetic coding sequence

SEQ ID NO: 13533 - DNA, 1680 bp, Artificial Sequence; identical to SEQ ID NO: 13530
  Description of Artificial Sequence: Synthetic coding sequence

SEQ ID NO: 13534 - DNA, 1680 bp, Artificial Sequence; identical to SEQ ID NO: 13530
  Description of Artificial Sequence: Synthetic coding sequence

SEQ ID NO: 13535 - DNA, 1680 bp, Artificial Sequence; identical to SEQ ID NO: 13530
  Description of Artificial Sequence: Synthetic coding sequence

SEQ ID NO: 13536 - DNA, 270 bp, Artificial Sequence
  Description of Artificial Sequence: Synthetic coding sequence
atgcccctggtgaagagaaacatcgaccccagacacctgtgccacaccgccctgcccagaggcatcaagaacgagctggagtgcgtgaccaacatcagcctggccaacatcatcagacagctgagcagcctgagcaagtacgccgaggacatcttcggcgagctgttcaacgaggcccacagcttcagcttcagagtgaacagcctgcaggagagagtggacagactgagcgtgagcgtgacccagctggaccccaaggaggaggagtag

SEQ ID NO: 13537 - DNA, 543 bp, Artificial Sequence
  Description of Artificial Sequence: Synthetic coding sequence
atgcccctggtgaagagaaacatcgaccccagacacctgtgccacaccgccctgcccagaggcatcaagaacgagctggagtgcgtgaccaacatcagcctggccaacatcatcagacagctgagcagcctgagcaagtacgccgaggacatcttcggcgagctgttcaacgaggcccacagcttcagcttcagagtgaacagcctgcaggagagagtggacagactgagcgtgagcgtgacccagctggaccccaaggaggaggagctgagcctgcaggacatcaccatgagaaaggccttcagaagcagcaccatccaggaccagcagctgttcgacagaaagaccctgcccatccccctgcaggagacctacgacgtgtgcgagcagcccccccccctgaacatcctgaccccctacagagacgacggcaaggagggcctgaagttctacaccaaccccagctacttcttcgacctgtggaaggagaagatgctgcaggacaccgaggacaagagaaaggagaagagaaagcagaagtag

SEQ ID NO: 13538 - DNA, 270 bp, Artificial Sequence; identical to SEQ ID NO: 13536
  Description of Artificial Sequence: Synthetic coding sequence

SEQ ID NO: 13539 - DNA, 1497 bp, Artificial Sequence
  Description of Artificial Sequence: Synthetic coding sequence
atgcccctggtgaccagaaacatcgagcccagacacctgtgcagacagaccctgcccagcgtgagaagcgagctggagtgcgtgaccaacatcaccctggccaacgtgatcagacagctgggcagcctgagcaagtacgccgaggacatcttcggcgagctgttcacccaggccaacaccttcgccagcagagtgagcagcctggccgagagagtggacagactgcaggtgaaggtgacccagctggaccccaaggaggaggaggtgagcctgcagggcatcaacaccagaaaggccttcagaagcagcaccatccaggaccagaagctgttcgacagaaacagcctgcccgtgcccgtgctggagacctacaacacctgcgacacccccccccccctgaacaacctgaccccctacagagacgacggcaaggaggccctgaagttctacaccgaccccagctacttcttcgacctgtggaaggagaagatgctgcaggacaccaaggacatcatgaaggagaagagaaagcacagaaaggagaagaaggacaaccccaacagaggcaacgtgaaccccagaaagatcaagaccagaaaggaggagtgggagaagatgaagatgggccaggagttcgtggagagcaaggagaagctgggcaccagcggctacccccccaccctggtgtaccagaacggcagcatcggctgcgtggagaacgtggacgccagcagctaccccccccccccccagagcgacagcgccagcagccccagccccagcttcagcgaggacaacctgccccccccccccgccgagttcagctaccccgtggacaaccagagaggcagcggcctggccggccccaagagaagcagcgtggtgagccccagccaccccccccccgccccccccctgggcagcccccccggccccaagcccggcttcgcccccccccccgcccccccccccccccccccccccatgatcggcatcccccccccccccccccccgtgggcttcggcagccccggcaccccccccccccccagcccccccagcttccccccccaccccgacttcgccgccccccccccccccccccccccccccgccgccgactaccccaccctgccccccccccccctgagccagcccaccggcggcgccccccccccccccccccccccccccccccccggccccccccccccccccttcaccggcgccgacggccagcccgccatccccccccccctgagcgacaccaccaagcccaagagcagcctgcccgccgtgagcgacgccagaagcgacctgctgagcgccatcagacagggcttccagctgagaagagtggaggagcagagagagcaggagaagagagacgtggtgggcaacgacgtggccaccatcctgagcagaagaatcgccgtggagtacagcgacagcgaggacgacagcagcgagttcgacgaggacgactggagcgactag

SEQ ID NO: 13540 - DNA, 846 bp, Artificial Sequence
  Description of Artificial Sequence: Synthetic coding sequence
atgcccctggtgaccagaaacatcgagcccagacacctgtgcagacagaccctgcccagcgtgagaagcgagctggagtgcgtgaccaacatcaccctggccaacgtgatcagacagctgggcagcctgagcaagtacgccgaggacatcttcggcgagctgttcacccaggccaacaccttcgccagcagagtgagcagcctggccgagagagtggacagactgcaggtgaaggtgacccagctggaccccaaggaggaggaggtgagcctgcagggcatcaacaccagaaaggccttcagaagcagcaccatccaggaccagaagctgttcgacagaaacagcctgcccgtgcccgtgctggagacctacaacacctgcgacacccccccccccctgaacaacctgaccccctacagagacgacggcaaggaggccctgaagttctacaccgaccccagctacttcttcgacctgtggaaggagaagatgctgcaggacaccaaggacatcatgaaggagaagagaaagcacagaaaggagaagaaggacaaccccaacagaggcaacgtgaaccccagaaagatcaagaccagaaaggaggagtgggagaagatgaagatgggccaggagttcgtggagagcaaggagaagctgggcaccagcggctacccccccaccctggtgtaccagaacggcagcatcggctgcgtggagaacgtggacgccagcagctaccccccccccccccagagcgacagcgccagcagccccagccccagcttcagcgaggacaacctgccccccccccccgccgagttcagattcagcgccgcccagggctag

SEQ ID NO: 13541 - DNA, 1533 bp, Artificial Sequence
  Description of Artificial Sequence: Synthetic coding sequence
atgcccgtgccccccccccccgcccccccccccccccccaccttcgccctggccaacaccgagaagcccaccctgaacaagaccgagcaggccggcagaaacgccctgctgagcgacatcagcaagggcaagaagctgaagaagaccgtgaccaacgacagaagcgcccccatcctggacaagcccaagggcgccggcgccggcggcggcggcggcggcttcggcggcggcggcggcttcggcggcggcggcggcggcggcggcggcggcagcttcggcggcggcggcccccccggcctgggcggcctgttccaggccggcatgcccaagctgagaagcaccgccaacagagacaacgacagcggcggcagcagaccccccctgctgccccccggcggcagaagcaccagcgccaagcccttcagcccccccagcggccccggcagattccccgtgcccagccccggccacagaagcggcccccccgagccccagagaaacagaatgcccccccccagacccgacgtgggcagcaagcccgacagcatccccccccccgtgcccagcacccccagacccatccagagcagcccccacaacagaggcagcccccccgtgcccggcggccccagacagcccagccccggccccacccccccccccttccccggcaacagaggcaccgccctgggcggcggcagcatcagacagagccccctgagcagcagcagccccttcagcaacagaccccccctgccccccacccccagcagagccctggacgacaagcccccccccccccccccccccgtgggcaacagacccagcatccacagagaggccgtgccccccccccccccccagaacaacaagccccccgtgcccagcacccccagacccagcgccagcagccaggcccccccccccccccccccccccagcagacccggccccccccccctgccccccagcagcagcggcaacgacgagacccccagactgccccagagaaacctgagcctgagcagcagcaccccccccctgcccagccccggcagaagcggccccctgccccccccccccagcgagagaccccccccccccgtgagagacccccccggcagaagcggccccctgcccccccccccccccgtgagcagaaacggcagcaccagcagagccctgcccgccaccccccagctgcccagcagaagcggcgtggacagccccagaagcggccccagaccccccctgccccccgacagacccagcgccggcgccccccccccccccccccccagcaccagcatcagaaacggcttccaggacagcccctgcgaggacgagtgggagagcagattctacttccaccccatcagcgacctgcccccccccgagccctacgtgcagaccaccaagagctaccccagcaagctggccagaaacgagagcagaagcggcagcaacagaagagagagaggcgccccccccctgccccccatccccagaccccccaagcaggccgccgagtag

SEQ ID NO: 13542 - DNA, 1512 bp, Artificial Sequence
  Description of Artificial Sequence: Synthetic coding sequence
atgcccgtgccccccccccccgcccccccccccccccccaccttcgccctggccaacaccgagaagcccaccctgaacaagaccgagcaggccggcagaaacgccctgctgagcgacatcagcaagggcaagaagctgaagaagaccgtgaccaacgacagaagcgcccccatcctggacaagcccaagggcgccggcgccggcggcggcggcggcggcttcggcggcggcggcggcttcggcggcggcggcggcggcggcggcggcggcagcttcggcggcggcggcccccccggcctgggcggcctgttccaggccggcatgcccaagctgagaagcaccgccaacagagacaacgacagcggcggcagcagaccccccctgctgccccccggcggcagaagcaccagcgccaagcccttcagcccccccagcggccccggcagattccccgtgcccagccccggccacagaagcggcccccccgagccccagagaaacagaatgcccccccccagacccgacgtgggcagcaagcccgacagcatccccccccccgtgcccagcacccccagacccatccagagcagcccccacaacagaggcagcccccccgtgcccggcggccccagacagcccagccccggccccacccccccccccttccccggcaacagaggcaccgccctgggcggcggcagcatcagacagagccccctgagcagcagcagccccttcagcaacagaccccccctgccccccacccccagcagagccctggacgacaagcccccccccccccccccccccgtgggcaacagacccagcatccacagagaggccgtgccccccccccccccccagaacaacaagccccccgtgcccagcacccccagacccagcgccagcagccaggcccccccccccccccccccccccagcagacccggccccccccccctgccccccagcagcagcggcaacgacgagacccccagactgccccagagaaacctgagcctgagcagcagcaccccccccctgcccagccccggcagaagcggccccctgccccccccccccagcgagagaccccccccccccgtgagagacccccccggcagaagcggccccctgcccccccccccccccgtgagcagaaacggcagcaccagcagagccctgcccgccaccccccagctgcccagcagaagcggcgtggacagccccagaagcggccccagaccccccctgccccccgacagacccagcgccggcgccccccccccccccccccccagcaccagcatcagaaacggcttccaggacagcccctgcgaggacgagtgggagagcagattctacttccaccccatcagcgacctgcccccccccgagccctacgtgcagaccaccaagagctaccccagcaagctggccagaaacgagagcagaagcggcagcaacagaagagagagaggcgccccccccctgccccccatccccagatag

SEQ ID NO: 13543 - DNA, 1512 bp, Artificial Sequence; identical to SEQ ID NO: 13542
  Description of Artificial Sequence: Synthetic coding sequence

SEQ ID NO: 13544 - DNA, 1512 bp, Artificial Sequence; identical to SEQ ID NO: 13542
  Description of Artificial Sequence: Synthetic coding sequence

SEQ ID NO: 13545 - DNA, 1080 bp, Artificial Sequence
  Description of Artificial Sequence: Synthetic coding sequence
atgcccgtgccccccccccccgcccccccccccccccccaccttcgccctggccaacaccgagaagcccaccctgaacaagaccgagcaggccggcagaaacgccctgctgagcgacatcagcaagggcaagaagctgaagaagaccgtgaccaacgacagaagcgcccccatcctggacaagcccaagggcgccggcgccggcggcggcggcggcggcttcggcggcggcggcggcttcggcggcggcggcggcggcggcggcggcggcagcttcggcggcggcggcccccccggcctgggcggcctgttccaggccggcatgcccaagctgagaagcaccgccaacagagacaacgacagcggcggcagcagaccccccctgctgccccccggcggcagaagcaccagcgccaagcccttcagcccccccagcggccccggcagattccccgtgcccagccccggccacagaagcggcccccccgagccccagagaaacagaatgcccccccccagacccgacgtgggcagcaagcccgacagcatccccccccccgtgcccagcacccccagacccatccagagcagcccccacaacagaggcagcccccccgtgcccggcggccccagacagcccagccccggccccaccccccccccccccccccccgtgagagacccccccggcagaagcggccccctgcccccccccccccccgtgagcagaaacggcagcaccagcagagccctgcccgccaccccccagctgcccagcagaagcggcgtggacagccccagaagcggccccagaccccccctgccccccgacagacccagcgccggcgccccccccccccccccccccagcaccagcatcagaaacggcttccaggacagcccctgcgaggacgagtgggagagcagattctacttccaccccatcagcgacctgcccccccccgagccctacgtgcagaccaccaagagctaccccagcaagctggccagaaacgagagcagaagcggcagcaacagaagagagagaggcgccccccccctgccccccatccccagatag

SEQ ID NO: 13546 - DNA, 1482 bp, Artificial Sequence
  Description of Artificial Sequence: Synthetic coding sequence
atgcccgtgccccccccccccgcccccccccccccccccaccttcgccctggccaacaccgagaagcccaccctgaacaagaccgagcaggccggcagaaacgccctgctgagcgacatcagcaagggcaagaagctgaagaagaccgtgaccaacgacagaagcgcccccatcctggacaagcccaagggcgccggcgccggcggcggcggcggcggcttcggcggcggcggcggcttcggcggcggcggcggcggcggcggcggcggcagcttcggcggcggcggcccccccggcctgggcggcctgttccaggccggcatgcccaagctgagaagcaccgccaacagagacaacgacagcggcggcagcagaccccccctgctgccccccggcggcagaagcaccagcgccaagcccttcagcccccccagcggccccggcagattccccgtgcccagccccggccacagaagcggcccccccgagccccagagaaacagaatgcccccccccagacccgacgtgggcagcaagcccgacagcatccccccccccgtgcccagcacccccagacccatccagagcagcccccacaacagaggcagcccccccgtgcccggcggccccagacagcccagccccggccccacccccccccccttccccggcaacagaggcaccgccctgggcggcggcagcatcagacagagccccctgagcagcagcagccccttcagcaacagaccccccctgccccccacccccagcagagccctggacgacaagcccccccccccccccccccccgtgggcaacagacccagcatccacagagaggccgtgccccccccccccccccagaacaacaagccccccgtgcccagcacccccagacccagcgccagcagccaggcccccccccccccccccccccccagcagacccggccccccccccctgccccccagcagcagcggcaacgacgagacccccagactgccccagagaaacctgagcctgagcagcagcaccccccccctgcccagccccggcagaagcggccccctgccccccccccccagcgagagaccccccccccccgtgagagacccccccggcagaagcggccccctgcccccccccccccccgtgagcagaaacggcagcaccagcagagccctgcccgccaccccccagctgcccagcagaagcggcgtggacagccccagaagcggccccagaccccccctgccccccgacagacccagcgccggcgccccccccccccccccccccagcaccagcatcagaaacggcttccaggacagcccctgcgaggacgagtgggagagcagattctacttccaccccatcagcgacctgcccccccccgagccctacgtgcagaccaccaagagctaccccagcaagctggccagaaacgagagcagaagcgagtacttctgccagggcttctag

SEQ ID NO: 13547 - DNA, 303 bp, Artificial Sequence
  Description of Artificial Sequence: Synthetic coding sequence
atgcccgtgccccccccccccgcccccccccccccccccaccttcgccctggccaacaccgagaagcccaccctgaacaagaccgagcaggccggcagaaacgccctgctgagcgacatcagcaagggcaagaagctgaagaagaccgtgaccaacgacagaagcgcccccatcctggacaagcccaagggcgccggcgccggcggcggcggcggcggcttcggcggcggcggcggcttcggcggcggcggcggcggcggcggcggcggcagcttcggcggcggcggcccccccggcctgtag

SEQ ID NO: 13548 - DNA, 1647 bp, Artificial Sequence
  Description of Artificial Sequence: Synthetic coding sequence
atgaagaccctggagacccagcccctggcccccgactgctgccccagcgaccaggaccccgcccccgcccaccccagcccccacgccagccccatgaacaagaacgccgacagcgagctgatgccccccccccccgagagaggcgacccccccagactgagccccgaccccgtggccggcagcgccgtgagccaggagctgagagagggcgaccccgtgagcctgagcacccccctggagaccgagttcggcagccccagcgagctgagccccagaatcgaggagcaggagctgagcgagaacaccagcctgcccgccgaggaggccaacggcagcctgagcgaggaggaggccaacggccccgagctgggcagcggcaaggccatggaggacaccagcggcgagcccgccgccgaggacgagggcgacaccgcctggaactacagcttcagccagctgcccagattcctgagcggcagctggagcgagttcagcacccagcccgagaacttcctgaagggctgcaagtgggcccccgacggcagctgcatcctgaccaacagcgccgacaacatcctgagaatctacaacctgccccccgagctgtaccacgagggcgagcaggtggagtacgccgagatggtgcccgtgctgagaatggtggagggcgacaccatctacgactactgctggtacagcctgatgagcagcgcccagcccgacaccagctacgtggccagcagcagcagagagaaccccatccacatctgggacgccttcaccggcgagctgagagccagcttcagagcctacaaccacctggacgagctgaccgccgcccacagcctgtgcttcagccccgacggcagccagctgttctgcggcttcaacagaaccgtgagagtgttcagcaccgccagacccggcagagactgcgaggtgagagccaccttcgccaagaagcagggccagagcggcatcatcagctgcatcgccttcagccccgcccagcccctgtacgcctgcggcagctacggcagaagcctgggcctgtacgcctgggacgacggcagccccctggccctgctgggcggccaccagggcggcatcacccacctgtgcttccaccccgacggcaacagattcttcagcggcgccagaaaggacgccgagctgctgtgctgggacctgagacagagcggctaccccctgtggagcctgggcagagaggtgaccaccaaccagagaatctacttcgacctggaccccaccggccagttcctggtgagcggcagcaccagcggcgccgtgagcgtgtgggacaccgacggccccggcaacgacggcaagcccgagcccgtgctgagcttcctgccccagaaggactgcaccaacggcgtgagcctgcaccccagcctgcccctgctggccaccgccagcggccagagagtgttccccgagcccaccgagagcggcgacgagggcgaggagctgggcctgcccctgctgagcaccagacacgtgcacctggagtgcagactgcagctgtggtggtgcggcggcgcccccgacagcagcatccccgacgaccaccagggcgagaagggccagggcggcaccgagggcggcgtgggcgagctgatctag

SEQ ID NO: 13549 - DNA, 1647 bp, Artificial Sequence; identical to SEQ ID NO: 13548
  Description of Artificial Sequence: Synthetic coding sequence

SEQ ID NO: 13550 - DNA, 1647 bp, Artificial Sequence; identical to SEQ ID NO: 13548
  Description of Artificial Sequence: Synthetic coding sequence

SEQ ID NO: 13551 - DNA, 567 bp, Artificial Sequence
  Description of Artificial Sequence: Synthetic coding sequence
atgaagaccctggagacccagcccctggcccccgactgctgccccagcgaccaggaccccgcccccgcccagcccgacaccagctacgtggccagcagcagcagagagaaccccatccacatctgggacgccttcaccggcgagctgagagccagcttcagagcctacaaccacctggacgagctgaccgccgcccacagcctgtgcttcagccccgacggcagccagctgttctgcggcttcaacagaaccgtgagagtgttcagcaccgccagacccggcagagactgcgaggtgagagccaccttcggcaagcacctgtgcctgcagggcagaagaagaggcaagggcaccgccacctgcaccggcgccttctgcgagcccggcgccacctgcggcggcagcagaagacccctgtacggccccggcagcagatgcagccccgtgggcagaggcgccaacagactgagagccggcagaaagcccagccagggccagcccgccggccagagaaccgccagcttcctgaacagctaccccgtgagctgcggcgccttcggcctgtag

SEQ ID NO: 13552 - DNA, 1647 bp, Artificial Sequence; identical to SEQ ID NO: 13548
  Description of Artificial Sequence: Synthetic coding sequence

SEQ ID NO: 13553 - DNA, 1299 bp, Artificial Sequence
  Description of Artificial Sequence: Synthetic coding sequence
atggacaccgagaagagcggcaagagagagttcgacgtgagacagaccccccaggtgaacatcaaccccttcacccccgacagcctgctgctgcacagcagcggccagtgcagaagaagaaagagaacctactggaacgacagctgcggcgaggacatggaggccagcgactacgagctggaggacgagaccagacccgccaagagaatcaccatcaccgagagcaacatgaagagcagatacaccaccgagttccacgagctggagaagatcggcagcggcgagttcggcagcgtgttcaagtgcgtgaagagactggacggctgcatctacgccatcaagagaagcaagaagcccctggccggcagcgtggacgagcagaacgccctgagagaggtgtacgcccacgccgtgctgggccagcacagccacgtggtgagatacttcagcgcctgggccgaggacgaccacatgctgatccagaacgagtactgcaacggcggcagcctggccgacgccatcagcgagaactacagaatcatgagctacttcaaggaggccgagctgaaggacctgctgctgcaggtgggcagaggcctgagatacatccacagcatgagcctggtgcacatggacatcaagcccagcaacatcttcatcagcagaaccagcatccccaacgccgccagcgaggagggcgacgaggacgactgggccagcaacaaggtgatgttcaagatcggcgacctgggccacgtgaccagaatcagcagcccccaggtggaggagggcgacagcagattcctggccaacgaggtgctgcaggagaactacacccacctgcccaaggccgacatcttcgccctggccctgaccgtggtgtgcgccgccggcgccgagcccctgcccagaaacggcgaccagtggcacgagatcagacagggcagactgcccagaatcccccaggtgctgagccaggagttcaccgagctgctgaaggtgatgatccaccccgaccccgagagaagacccagcgccatggccctggtgaagcacagcgtgctgctgagcgccagcagaaagagcgccgagcagctgagaatcgagctgaacgccgagaagttcaagaacagcctgctgcagaaggagctgaagaaggcccagatggccaaggccgccgccgaggagagagccctgttcaccgacagaatggccaccagaagcaccacccagagcaacagaaccagcagactgatcggcaagaagatgaacagaagcgtgagcctgaccatctactag

SEQ ID NO: 13554 - DNA, 1941 bp, Artificial Sequence
  Description of Artificial Sequence: Synthetic coding sequence
atgagcttcctgagcagacagcagccccccccccccagaagagccggcgccgcctgcaccctgagacagaagctgatcttcagcccctgcagcgactgcgaggaggaggaggaggaggaggaggaggagggcagcggccacagcaccggcgaggacagcgccttccaggagcccgacagccccctgccccccgccagaagccccaccgagcccggccccgagagaagaagaagccccggccccgcccccggcagccccggcgagctggaggaggacctgctgctgcccggcgcctgccccggcgccgacgaggccggcggcggcgccgagggcgacagctgggaggaggagggcttcggcagcagcagccccgtgaagagccccgccgccccctacttcctgggcagcagcttcagccccgtgagatgcggcggccccggcgacgccagccccagaggctgcggcgccagaagagccggcgagggcagaagaagccccagacccgaccaccccggcacccccccccacaagaccttcagaaagctgagactgttcgacaccccccacacccccaagagcctgctgagcaaggccagaggcatcgacagcagcagcgtgaagctgagaggcagcagcctgttcatggacaccgagaagagcggcaagagagagttcgacgtgagacagaccccccaggtgaacatcaaccccttcacccccgacagcctgctgctgcacagcagcggccagtgcagaagaagaaagagaacctactggaacgacagctgcggcgaggacatggaggccagcgactacgagctggaggacgagaccagacccgccaagagaatcaccatcaccgagagcaacatgaagagcagatacaccaccgagttccacgagctggagaagatcggcagcggcgagttcggcagcgtgttcaagtgcgtgaagagactggacggctgcatctacgccatcaagagaagcaagaagcccctggccggcagcgtggacgagcagaacgccctgagagaggtgtacgcccacgccgtgctgggccagcacagccacgtggtgagatacttcagcgcctgggccgaggacgaccacatgctgatccagaacgagtactgcaacggcggcagcctggccgacgccatcagcgagaactacagaatcatgagctacttcaaggaggccgagctgaaggacctgctgctgcaggtgggcagaggcctgagatacatccacagcatgagcctggtgcacatggacatcaagcccagcaacatcttcatcagcagaaccagcatccccaacgccgccagcgaggagggcgacgaggacgactgggccagcaacaaggtgatgttcaagatcggcgacctgggccacgtgaccagaatcagcagcccccaggtggaggagggcgacagcagattcctggccaacgaggtgctgcaggagaactacacccacctgcccaaggccgacatcttcgccctggccctgaccgtggtgtgcgccgccggcgccgagcccctgcccagaaacggcgaccagtggcacgagatcagacagggcagactgcccagaatcccccaggtgctgagccaggagttcaccgagctgctgaaggtgatgatccaccccgaccccgagagaagacccagcgccatggccctggtgaagcacagcgtgctgctgagcgccagcagaaagagcgccgagcagctgagaatcgagctgaacgccgagaagttcaagaacagcctgctgcagaaggagctgaagaaggcccagatggccaaggccgccgccgaggagagagccctgttcaccgacagaatggccaccagaagcaccacccagagcaacagaaccagcagactgatcggcaagaagatgaacagaagcgtgagcctgaccatctactag

SEQ ID NO: 13555 - DNA, 1554 bp, Artificial Sequence
  Description of Artificial Sequence: Synthetic coding sequence
ctgcaggaccccgccagcacctgcgtgcccgagcccgccagccagcacaccctgagaagcggccccggctgcctgcagcagcccgagcagcagggcgtgagagaccccggcggcatctgggccaagctgggcgccgccgaggccagcgccgagagactgcagggcagaagaagcagaggcgccagcggcagcgagccccagcagatgggcagcgacgtgagagacctgaacgccctgctgcccgccgtgcccagcctgggcggcggcggcggctgcgccctgcccgtgagcggcgccgcccagtgggcccccgtgctggacttcgccccccccggcgccagcgcctacggcagcctgggcggccccgcccccccccccgccccccccccccccccccccccccccccccacagcttcatcaagcaggagcccagctggggcggcgccgagccccacgaggagcagtgcctgagcgccttcaccgtgcacttcagcggccagttcaccggcaccgccggcgcctgcagatacggccccttcggcccccccccccccagccaggccagcagcggccaggccagaatgttccccaacgccccctacctgcccagctgcctggagagccagcccgccatcagaaaccagggctacagcaccgtgaccttcgacggcacccccagctacggccacacccccagccaccacgccgcccagttccccaaccacagcttcaagcacgaggaccccatgggccagcagggcagcctgggcgagcagcagtacagcgtgcccccccccgtgtacggctgccacacccccaccgacagctgcaccggcagccaggccctgctgctgagaaccccctacagcagcgacaacctgtaccagatgaccagccagctggagtgcatgacctggaaccagatgaacctgggcgccaccctgaagggcgtggccgccggcagcagcagcagcgtgaagtggaccgagggccagagcaaccacagcaccggctacgagagcgacaaccacaccacccccatcctgtgcggcgcccagtacagaatccacacccacggcgtgttcagaggcatccaggacgtgagaagagtgcccggcgtggcccccaccctggtgagaagcgccagcgagaccagcgagaagagacccttcatgtgcgcctaccccggctgcaacaagagatacttcaagctgagccacctgcagatgcacagcagaaagcacaccggcgagaagccctaccagtgcgacttcaaggactgcgagagaagattcagcagaagcgaccagctgaagagacaccagagaagacacaccggcgtgaagcccttccagtgcaagacctgccagagaaagttcagcagaagcgaccacctgaagacccacaccagaacccacaccggcaagaccagcgagaagcccttcagctgcagatggcccagctgccagaagaagttcgccagaagcgacgagctggtgagacaccacaacatgcaccagagaaacatgaccaagctgcagctggccctgtag

SEQ ID NO: 13556 - DNA, 954 bp, Artificial Sequence
  Description of Artificial Sequence: Synthetic coding sequence
ctgcaggaccccgccagcacctgcgtgcccgagcccgccagccagcacaccctgagaagcggccccggctgcctgcagcagcccgagcagcagggcgtgagagaccccggcggcatctgggccaagctgggcgccgccgaggccagcgccgagagactgcagggcagaagaagcagaggcgccagcggcagcgagccccagcagatgggcagcgacgtgagagacctgaacgccctgctgcccgccgtgcccagcctgggcggcggcggcggctgcgccctgcccgtgagcggcgccgcccagtgggcccccgtgctggacttcgccccccccggcgccagcgcctacggcagcctgggcggccccgcccccccccccgccccccccccccccccccccccccccccccacagcttcatcaagcaggagcccagctggggcggcgccgagccccacgaggagcagtgcctgagcgccttcaccgtgcacttcagcggccagttcaccggcaccgccggcgcctgcagatacggccccttcggcccccccccccccagccaggccagcagcggccaggccagaatgttccccaacgccccctacctgcccagctgcctggagagccagcccgccatcagaaaccagggctacagcaccgtgaccttcgacggcacccccagctacggccacacccccagccaccacgccgcccagttccccaaccacagcttcaagcacgaggaccccatgggccagcagggcagcctgggcgagcagcagtacagcgtgcccccccccgtgtacggctgccacacccccaccgacagctgcaccggcagccaggccctgctgctgagaaccccctacagcagcgacaacctgtaccagatgaccagccagctggagtgcatgacctggaaccagatgaacctgggcgccaccctgaagggctag

SEQ ID NO: 13557 - DNA, 909 bp, Artificial Sequence
  Description of Artificial Sequence: Synthetic coding sequence
atggagaagggctacagcaccgtgaccttcgacggcacccccagctacggccacacccccagccaccacgccgcccagttccccaaccacagcttcaagcacgaggaccccatgggccagcagggcagcctgggcgagcagcagtacagcgtgcccccccccgtgtacggctgccacacccccaccgacagctgcaccggcagccaggccctgctgctgagaaccccctacagcagcgacaacctgtaccagatgaccagccagctggagtgcatgacctggaaccagatgaacctgggcgccaccctgaagggcgtggccgccggcagcagcagcagcgtgaagtggaccgagggccagagcaaccacagcaccggctacgagagcgacaaccacaccacccccatcctgtgcggcgcccagtacagaatccacacccacggcgtgttcagaggcatccaggacgtgagaagagtgcccggcgtggcccccaccctggtgagaagcgccagcgagaccagcgagaagagacccttcatgtgcgcctaccccggctgcaacaagagatacttcaagctgagccacctgcagatgcacagcagaaagcacaccggcgagaagccctaccagtgcgacttcaaggactgcgagagaagattcagcagaagcgaccagctgaagagacaccagagaagacacaccggcgtgaagcccttccagtgcaagacctgccagagaaagttcagcagaagcgaccacctgaagacccacaccagaacccacaccggcgagaagcccttcagctgcagatggcccagctgccagaagaagttcgccagaagcgacgagctggtgagacaccacaacatgcaccagagaaacatgaccaagctgcagctggccctgtag

SEQ ID NO: 13558 - DNA, 1545 bp, Artificial Sequence
  Description of Artificial Sequence: Synthetic coding sequence
ctgcaggaccccgccagcacctgcgtgcccgagcccgccagccagcacaccctgagaagcggccccggctgcctgcagcagcccgagcagcagggcgtgagagaccccggcggcatctgggccaagctgggcgccgccgaggccagcgccgagagactgcagggcagaagaagcagaggcgccagcggcagcgagccccagcagatgggcagcgacgtgagagacctgaacgccctgctgcccgccgtgcccagcctgggcggcggcggcggctgcgccctgcccgtgagcggcgccgcccagtgggcccccgtgctggacttcgccccccccggcgccagcgcctacggcagcctgggcggccccgcccccccccccgccccccccccccccccccccccccccccccacagcttcatcaagcaggagcccagctggggcggcgccgagccccacgaggagcagtgcctgagcgccttcaccgtgcacttcagcggccagttcaccggcaccgccggcgcctgcagatacggccccttcggcccccccccccccagccaggccagcagcggccaggccagaatgttccccaacgccccctacctgcccagctgcctggagagccagcccgccatcagaaaccagggctacagcaccgtgaccttcgacggcacccccagctacggccacacccccagccaccacgccgcccagttccccaaccacagcttcaagcacgaggaccccatgggccagcagggcagcctgggcgagcagcagtacagcgtgcccccccccgtgtacggctgccacacccccaccgacagctgcaccggcagccaggccctgctgctgagaaccccctacagcagcgacaacctgtaccagatgaccagccagctggagtgcatgacctggaaccagatgaacctgggcgccaccctgaagggcgtggccgccggcagcagcagcagcgtgaagtggaccgagggccagagcaaccacagcaccggctacgagagcgacaaccacaccacccccatcctgtgcggcgcccagtacagaatccacacccacggcgtgttcagaggcatccaggacgtgagaagagtgcccggcgtggcccccaccctggtgagaagcgccagcgagaccagcgagaagagacccttcatgtgcgcctaccccggctgcaacaagagatacttcaagctgagccacctgcagatgcacagcagaaagcacaccggcgagaagccctaccagtgcgacttcaaggactgcgagagaagattcagcagaagcgaccagctgaagagacaccagagaagacacaccggcgtgaagcccttccagtgcaagacctgccagagaaagttcagcagaagcgaccacctgaagacccacaccagaacccacaccggcgagaagcccttcagctgcagatggcccagctgccagaagaagttcgccagaagcgacgagctggtgagacaccacaacatgcaccagagaaacatgaccaagctgcagctggccctgtag

SEQ ID NO: 13559 - DNA, 1494 bp, Artificial Sequence
  Description of Artificial Sequence: Synthetic coding sequence
ctgcaggaccccgccagcacctgcgtgcccgagcccgccagccagcacaccctgagaagcggccccggctgcctgcagcagcccgagcagcagggcgtgagagaccccggcggcatctgggccaagctgggcgccgccgaggccagcgccgagagactgcagggcagaagaagcagaggcgccagcggcagcgagccccagcagatgggcagcgacgtgagagacctgaacgccctgctgcccgccgtgcccagcctgggcggcggcggcggctgcgccctgcccgtgagcggcgccgcccagtgggcccccgtgctggacttcgccccccccggcgccagcgcctacggcagcctgggcggccccgcccccccccccgccccccccccccccccccccccccccccccacagcttcatcaagcaggagcccagctggggcggcgccgagccccacgaggagcagtgcctgagcgccttcaccgtgcacttcagcggccagttcaccggcaccgccggcgcctgcagatacggccccttcggcccccccccccccagccaggccagcagcggccaggccagaatgttccccaacgccccctacctgcccagctgcctggagagccagcccgccatcagaaaccagggctacagcaccgtgaccttcgacggcacccccagctacggccacacccccagccaccacgccgcccagttccccaaccacagcttcaagcacgaggaccccatgggccagcagggcagcctgggcgagcagcagtacagcgtgcccccccccgtgtacggctgccacacccccaccgacagctgcaccggcagccaggccctgctgctgagaaccccctacagcagcgacaacctgtaccagatgaccagccagctggagtgcatgacctggaaccagatgaacctgggcgccaccctgaagggccacagcaccggctacgagagcgacaaccacaccacccccatcctgtgcggcgcccagtacagaatccacacccacggcgtgttcagaggcatccaggacgtgagaagagtgcccggcgtggcccccaccctggtgagaagcgccagcgagaccagcgagaagagacccttcatgtgcgcctaccccggctgcaacaagagatacttcaagctgagccacctgcagatgcacagcagaaagcacaccggcgagaagccctaccagtgcgacttcaaggactgcgagagaagattcagcagaagcgaccagctgaagagacaccagagaagacacaccggcgtgaagcccttccagtgcaagacctgccagagaaagttcagcagaagcgaccacctgaagacccacaccagaacccacaccggcgagaagcccttcagctgcagatggcccagctgccagaagaagttcgccagaagcgacgagctggtgagacaccacaacatgcaccagagaaacatgaccaagctgcagctggccctgtag

SEQ ID NO: 13560 - DNA, 396 bp, Artificial Sequence
  Description of Artificial Sequence: Synthetic coding sequence
atgggccagcagggcagcctgggcgagcagcagtacagcgtgcccccccccgtgtacggctgccacacccccaccgacagctgcaccggcagccaggccctgctgctgagaaccccctacagcagcgacaacctgtaccagatgaccagccagctggagtgcatgacctggaaccagatgaacctgggcgccaccctgaagggcgtggccgccggcagcagcagcagcgtgaagtggaccgagggccagagcaaccacagcaccggctacgagagcgacaaccacaccacccccatcctgtgcggcgcccagtacagaatccacacccacggcgtgttcagaggcatccaggacgtgagaagagtgcccggcgtggcccccaccctggtgagatag

SEQ ID NO: 13561 - DNA, 537 bp, Artificial Sequence
  Description of Artificial Sequence: Synthetic coding sequence
tgactgggcgccaccctgaagggcgtggccgccggcagcagcagcagcgtgaagtggaccgagggccagagcaaccacagcaccggctacgagagcgacaaccacaccacccccatcctgtgcggcgcccagtacagaatccacacccacggcgtgttcagaggcatccaggacgtgagaagagtgcccggcgtggcccccaccctggtgagaagcgccagcgagaccagcgagaagagacccttcatgtgcgcctaccccggctgcaacaagagatacttcaagctgagccacctgcagatgcacagcagaaagcacaccggcgtgaagcccttccagtgcaagacctgccagagaaagttcagcagaagcgaccacctgaagacccacaccagaacccacaccggcaagaccagcgagaagcccttcagctgcagatggcccagctgccagaagaagttcgccagaagcgacgagctggtgagacaccacaacatgcaccagagaaacatgaccaagctgcagctggccctgtag

SEQ ID NO: 13562 - DNA, 867 bp, Artificial Sequence
  Description of Artificial Sequence: Synthetic coding sequence
atggagaagggctacagcaccgtgaccttcgacggcacccccagctacggccacacccccagccaccacgccgcccagttccccaaccacagcttcaagcacgaggaccccatgggccagcagggcagcctgggcgagcagcagtacagcgtgcccccccccgtgtacggctgccacacccccaccgacagctgcaccggcagccaggccctgctgctgagaaccccctacagcagcgacaacctgtaccagatgaccagccagctggagtgcatgacctggaaccagatgaacctgggcgccaccctgaagggccacagcaccggctacgagagcgacaaccacaccacccccatcctgtgcggcgcccagtacagaatccacacccacggcgtgttcagaggcatccaggacgtgagaagagtgcccggcgtggcccccaccctggtgagaagcgccagcgagaccagcgagaagagacccttcatgtgcgcctaccccggctgcaacaagagatacttcaagctgagccacctgcagatgcacagcagaaagcacaccggcgagaagccctaccagtgcgacttcaaggactgcgagagaagattcagcagaagcgaccagctgaagagacaccagagaagacacaccggcgtgaagcccttccagtgcaagacctgccagagaaagttcagcagaagcgaccacctgaagacccacaccagaacccacaccggcaagaccagcgagaagcccttcagctgcagatggcccagctgccagaagaagttcgccagaagcgacgagctggtgagacaccacaacatgcaccagagaaacatgaccaagctgcagctggccctgtag

SEQ ID NO: 13563 - DNA, 1065 bp, Artificial Sequence
  Description of Artificial Sequence: Synthetic coding sequence
atgagagccagaccccaggtgtgcgaggccctgctgttcgccctggccctgcagaccggcgtgtgctacggcatcaagtggctggccctgagcaagacccccagcgccctggccctgaaccagacccagcactgcaagcagctggagggcctggtgagcgcccaggtgcagctgtgcagaagcaacctggagctgatgcacaccgtggtgcacgccgccagagaggtgatgaaggcctgcagaagagccttcgccgacatgagatggaactgcagcagcatcgagctggcccccaactacctgctggacctggagagaggcaccagagagagcgccttcgtgtacgccctgagcgccgccgccatcagccacgccatcgccagagcctgcaccagcggcgacctgcccggctgcagctgcggccccgtgcccggcgagccccccggccccggcaacagatggggcggctgcgccgacaacctgagctacggcctgctgatgggcgccaagttcagcgacgcccccatgaaggtgaagaagaccggcagccaggccaacaagctgatgagactgcacaacagcgaggtgggcagacaggccctgagagccagcctggagatgaagtgcaagtgccacggcgtgagcggcagctgcagcatcagaacctgctggaagggcctgcaggagctgcaggacgtggccgccgacctgaagaccagatacctgagcgccaccaaggtggtgcacagacccatgggcaccagaaagcacctggtgcccaaggacctggacatcagacccgtgaaggacagcgagctggtgtacctgcagagcagccccgacttctgcatgaagaacgagaaggtgggcagccacggcacccaggacagacagtgcaacaagaccagcaacggcagcgacagctgcgacctgatgtgctgcggcagaggctacaacccctacaccgacagagtggtggagagatgccactgcaagtaccactggtgctgctacgtgacctgcagaagatgcgagagaaccgtggagagatacgtgtgcaagtag

SEQ ID NO: 13564 - DNA, 762 bp, Artificial Sequence
  Description of Artificial Sequence: Synthetic coding sequence
atgagagccagaccccaggtgtgcgaggccctgctgttcgccctggccctgcagaccggcgtgtgctacggcatcaagtggctggccctgagcaagacccccagcgccctggccctgaaccagacccagcactgcaagcagctggagggcctggtgagcgcccaggtgcagctgtgcagaagcaacctggagctgatgcacaccgtggtgcacgccgccagagaggtgatgaaggcctgcagaagagccttcgccgacatgagatggaactgcagcagcatcgagctggcccccaactacctgctggacctggagagaggcaccagagagagcgccttcgtgtacgccctgagcgccgccgccatcagccacgccatcgccagagcctgcaccagcggcgacctgcccggctgcagctgcggccccgtgcccggcgagccccccggccccggcaacagatggggcggctgcgccgacaacctgagctacggcctgctgatgggcgccaagttcagcgacgcccccatgaaggtgaagaagaccggcagccaggccaacaagctgatgagactgcacaacagcgaggtgggcagacaggccctgagagccagcctgctggtgaacagcagatgccaggcctgggaggccgcctgcgccctgcccagcctgggcagccaccaggagcagaaggtgtggcccccctggaaggagggcagaaccagcaaggagaccgacaagatcaagaacaacctggccgcctag

SEQ ID NO: 13565 - DNA, 18 bp, Artificial Sequence
  Description of Artificial Sequence: Synthetic coding sequence
atgagagccagaccctag

SEQ ID NO: 13566 - DNA, 1143 bp, Artificial Sequence
  Description of Artificial Sequence: Synthetic coding sequence
atgaagaagagcatcggcatcctgagccccggcgtggccctgggcatggccggcagcgccatgagcagcaagttcttcctggtggccctggccatcttcttcagcttcgcccaggtggtgatcgaggccaacagctggtggagcctgggcatgaacaaccccgtgcagatgagcgaggtgtacatcatcggcgcccagcccctgtgcagccagctggccggcctgagccagggccagaagaagctgtgccacctgtaccaggaccacatgcagtacatcggcgagggcgccaagaccggcatcaaggagtgccagtaccagttcagacacagaagatggaactgcagcaccgtggacaacaccagcgtgttcggcagagtgatgcagatcggcagcagagagaccgccttcacctacgccgtgagcgccgccggcgtggtgaacgccatgagcagagcctgcagagagggcgagctgagcacctgcggctgcagcagagccgccagacccaaggacctgcccagagactggctgtggggcggctgcggcgacaacatcgactacggctacagattcgccaaggagttcgtggacgccagagagagagagagaatccacgccaagggcagctacgagagcgccagaatcctgatgaacctgcacaacaacgaggccggcagaagaaccgtgtacaacctggccgacgtggcctgcaagtgccacggcgtgagcggcagctgcagcctgaagacctgctggctgcagctggccgacttcagaaaggtgggcgacgccctgaaggagaagtacgacagcgccgccgccatgagactgaacagcagaggcaagctggtgcaggtgaacagcagattcaacagccccaccacccaggacctggtgtacatcgaccccagccccgactactgcgtgagaaacgagagcaccggcagcctgggcacccagggcagactgtgcaacaagaccagcgagggcatggacggctgcgagctgatgtgctgcggcagaggctacgaccagttcaagaccgtgcagaccgagagatgccactgcaagttccactggtgctgctacgtgaagtgcaagaagtgcaccgagatcgtggaccagttcgtgtgcaagtag

SEQ ID NO: 13567 - DNA, 390 bp, Artificial Sequence
  Description of Artificial Sequence: Synthetic coding sequence
atgaagaagagcatcggcatcctgagccccggcgtggccctgggcatggccggcagcgccatgagcagcaagttcttcctggtggccctggccatcttcttcagcttcgcccaggtggtgatcgaggccaacagctggtggagcctgggcatgaacaaccccgtgcagatgagccaggacgtgggcggccacggctggctgagagcccacgtgctgagaccctggctgagacccgtgcaggacagagccgacggcgccctgcccctgcaggtgcccctggtgctgctgagacaggtgcaggaggtgcacggcgacagaggccccgtgtgcgtgcaggtggtgggcgccacccagcacagcgcccccctgcccggccccgcctacctgtag

SEQ ID NO: 13568 - DNA, 1143 bp, Artificial Sequence; identical to SEQ ID NO: 13566
  Description of Artificial Sequence: Synthetic coding sequence

SEQ ID NO: 13569 - DNA, 645 bp, Artificial Sequence
  Description of Artificial Sequence: Synthetic coding sequence
atggccggcagcgccatgagcagcaagttcttcctggtggccctggccatcttcttcagcttcgcccaggtggtgatcgaggccaacagctggtggagcctgggcatgaacaaccccgtgcagatgagcgaggtgtacatcatcggcgcccagcccctgtgcagccagctggccggcctgagccagggccagaagaagctgtgccacctgtaccaggaccacatgcagtacatcggcgagggcgccaagaccggcatcaaggagtgccagtaccagttcagacacagaagatggaactgcagcaccgtggacaacaccagcgtgttcggcagagtgatgcagatcggcagcagagagaccgccttcacctacgccgtgagcgccgccggcgtggtgaacgccatgagcagagcctgcagagagggcgagctgagcacctgcggctgcagcagagccgccagacccaaggacctgcccagagactggctgtggggcggctgcggcgacaacatcgactacggctacagattcgccaaggagttcgtggacgccagagagagagagagaatccacgccaagggcagctacgagagcgccagaatcctgatgaacctgcacaacaacgaggccggcagaagagtgtag

SEQ ID NO: 13570 - DNA, 1098 bp, Artificial Sequence
  Description of Artificial Sequence: Synthetic coding sequence
atggccggcagcgccatgagcagcaagttcttcctggtggccctggccatcttcttcagcttcgcccaggtggtgatcgaggccaacagctggtggagcctgggcatgaacaaccccgtgcagatgagcgaggtgtacatcatcggcgcccagcccctgtgcagccagctggccggcctgagccagggccagaagaagctgtgccacctgtaccaggaccacatgcagtacatcggcgagggcgccaagaccggcatcaaggagtgccagtaccagttcagacacagaagatggaactgcagcaccgtggacaacaccagcgtgttcggcagagtgatgcagatcggcagcagagagaccgccttcacctacgccgtgagcgccgccggcgtggtgaacgccatgagcagagcctgcagagagggcgagctgagcacctgcggctgcagcagagccgccagacccaaggacctgcccagagactggctgtggggcggctgcggcgacaacatcgactacggctacagattcgccaaggagttcgtggacgccagagagagagagagaatccacgccaagggcagctacgagagcgccagaatcctgatgaacctgcacaacaacgaggccggcagaagaaccgtgtacaacctggccgacgtggcctgcaagtgccacggcgtgagcggcagctgcagcctgaagacctgctggctgcagctggccgacttcagaaaggtgggcgacgccctgaaggagaagtacgacagcgccgccgccatgagactgaacagcagaggcaagctggtgcaggtgaacagcagattcaacagccccaccacccaggacctggtgtacatcgaccccagccccgactactgcgtgagaaacgagagcaccggcagcctgggcacccagggcagactgtgcaacaagaccagcgagggcatggacggctgcgagctgatgtgctgcggcagaggctacgaccagttcaagaccgtgcagaccgagagatgccactgcaagttccactggtgctgctacgtgaagtgcaagaagtgcaccgagatcgtggaccagttcgtgtgcaagtag

SEQ ID NO: 13571 - DNA, 876 bp, Artificial Sequence
  Description of Artificial Sequence: Synthetic coding sequence
atgcagtacatcggcgagggcgccaagaccggcatcaaggagtgccagtaccagttcagacacagaagatggaactgcagcaccgtggacaacaccagcgtgttcggcagagtgatgcagatcggcagcagagagaccgccttcacctacgccgtgagcgccgccggcgtggtgaacgccatgagcagagcctgcagagagggcgagctgagcacctgcggctgcagcagagccgccagacccaaggacctgcccagagactggctgtggggcggctgcggcgacaacatcgactacggctacagattcgccaaggagttcgtggacgccagagagagagagagaatccacgccaagggcagctacgagagcgccagaatcctgatgaacctgcacaacaacgaggccggcagaagaaccgtgtacaacctggccgacgtggcctgcaagtgccacggcgtgagcggcagctgcagcctgaagacctgctggctgcagctggccgacttcagaaaggtgggcgacgccctgaaggagaagtacgacagcgccgccgccatgagactgaacagcagaggcaagctggtgcaggtgaacagcagattcaacagccccaccacccaggacctggtgtacatcgaccccagccccgactactgcgtgagaaacgagagcaccggcagcctgggcacccagggcagactgtgcaacaagaccagcgagggcatggacggctgcgagctgatgtgctgcggcagaggctacgaccagttcaagaccgtgcagaccgagagatgccactgcaagttccactggtgctgctacgtgaagtgcaagaagtgcaccgagatcgtggaccagttcgtgtgcaagtag

SEQ ID NO: 13572 - DNA, 1080 bp, Artificial Sequence
  Description of Artificial Sequence: Synthetic coding sequence
atgcccagcctgctgctgctgttcaccgccgccctgctgagcagctgggcccagctgctgaccgacgccaacagctggtggagcctggccctgaaccccgtgcagagacccgagatgttcatcatcggcgcccagcccgtgtgcagccagctgcccggcctgagccccggccagagaaagctgtgccagctgtaccaggagcacatggcctacatcggcgagggcgccaagaccggcatcaaggagtgccagcaccagttcagacagagaagatggaactgcagcaccgccgacaacgccagcgtgttcggcagagtgatgcagatcggcagcagagagaccgccttcacccacgccgtgagcgccgccggcgtggtgaacgccatcagcagagcctgcagagagggcgagctgagcacctgcggctgcagcagaaccgccagacccaaggacctgcccagagactggctgtggggcggctgcggcgacaacgtggagtacggctacagattcgccaaggagttcgtggacgccagagagagagagaagaacttcgccaagggcagcgaggagcagggcagagtgctgatgaacctgcagaacaacgaggccggcagaagagccgtgtacaagatggccgacgtggcctgcaagtgccacggcgtgagcggcagctgcagcctgaagacctgctggctgcagctggccgagttcagaaaggtgggcgacagactgaaggagaagtacgacagcgccgccgccatgagagtgaccagaaagggcagactggagctggtgaacagcagattcacccagcccacccccgaggacctggtgtacgtggaccccagccccgactactgcctgagaaacgagagcaccggcagcctgggcacccagggcagactgtgcaacaagaccagcgagggcatggacggctgcgagctgatgtgctgcggcagaggctacaaccagttcaagagcgtgcaggtggagagatgccactgcaagttccactggtgctgcttcgtgagatgcaagaagtgcaccgagatcgtggaccagtacatctgcaagtag

SEQ ID NO: 13573 - DNA, 1080 bp, Artificial Sequence; identical to SEQ ID NO: 13572
  Description of Artificial Sequence: Synthetic coding sequence

SEQ ID NO: 13574 - DNA, 1080 bp, Artificial Sequence; identical to SEQ ID NO: 13572
  Description of Artificial Sequence: Synthetic coding sequence

SEQ ID NO: 13575 - DNA, 1398 bp, Artificial Sequence
  Description of Artificial Sequence: Synthetic coding sequence
atgaccggcagagccatggaccccctgcccgccgccgccgtgggcgccgccgccgaggccgaggccgacgaggaggccgacccccccgccagcgacctgcccaccccccaggccatcgagccccaggccatcgtgcagcaggtgcccgcccccagcagaatgcagatgccccagggcaaccccctgctgctgagccacaccctgcaggagctgctggccagagacaccgtgcaggtggagctgatccccgagaagaagggcctgttcctgaagcacgtggagtacgaggtgagcagccagagattcaagagcagcgtgtacagaagatacaacgacttcgtggtgttccaggagatgctgctgcacaagttcccctacagaatggtgcccgccctgccccccaagagaatgctgggcgccgacagagagttcatcgaggccagaagaagagccctgaagagattcgtgaacctggtggccagacaccccctgttcagcgaggacgtggtgctgaagctgttcctgagcttcagcggcagcgacgtgcagaacaagctgaaggagagcgcccagtgcgtgggcgacgagttcctgaactgcaagctggccaccagagccaaggacttcctgcccgccgacatccaggcccagttcgccatcagcagagagctgatcagaaacatctacaacagcttccacaagctgagagacagagccgagagaatcgccagcagagccatcgacaacgccgccgacctgctgatcttcggcaaggagctgagcgccatcggcagcgacaccacccccctgcccagctgggccgccctgaacagcagcacctggggcagcctgaagcaggccctgaagggcctgagcgtggagttcgccctgctggccgacaaggccgcccagcagggcaagcaggaggagaacgacgtggtggagaagctgaacctgttcctggacctgctgcagagctacaaggacctgtgcgagagacacgagaagggcgtgctgcacaagcaccagagagccctgcacaagtacagcctgatgaagagacagatgatgagcgccaccgcccagaacagagagcccgagagcgtggagcagctggagagcagaatcgtggagcaggagaacgccatccagaccatggagctgagaaactacttcagcctgtactgcctgcaccaggagacccagctgatccacgtgtacctgcccctgaccagccacatcctgagagccttcgtgaacagccagatccagggccacaaggagatgagcaaggtgtggaacgacctgagacccaagctgagctgcctgttcgccggcccccacagcaccctgacccccccctgcagcccccccgaggacggcctgtgcccccactag

SEQ ID NO: 13576 - DNA, 174 bp, Artificial Sequence
  Description of Artificial Sequence: Synthetic coding sequence
atgagcagcgtgcagcagcagccccccccccccagaagagtgaccaacgtgggcagcctgctgctgaccccccaggagaacgagagcctgttcaccttcctgggcaagaagtgcgtgaccatgagcagcgccgtggtgcagctgtacgccgccgacagaaacctgagctgctag

SEQ ID NO: 13577 - DNA, 1140 bp, Artificial Sequence
  Description of Artificial Sequence: Synthetic coding sequence
atggccagaagaagcgccttccccgccgccgccctgtggctgtggagcatcctgctgtgcctgctggccctgagagccgaggccggccccccccaggaggagagcctgtacctgtggatcgacgcccaccaggccagagtgctgatcggcttcgaggaggacatcctgatcgtgagcgagggcaagatggcccccttcacccacgacttcagaaaggcccagcagagaatgcccgccatccccgtgaacatccacagcatgaacttcacctggcaggccgccggccaggccgagtacttctacgagttcctgagcctgagaagcctggacaagggcatcatggccgaccccaccgtgaacgtgcccctgctgggcaccgtgccccacaaggccagcgtggtgcaggtgggcttcccctgcctgggcaagcaggacggcgtggccgccttcgaggtggacgtgatcgtgatgaacagcgagggcaacaccatcctgcagaccccccagaacgccatcttcttcaagacctgccagcaggccgagtgccccggcggctgcagaaacggcggcttctgcaacgagagaagaatctgcgagtgccccgacggcttccacggcccccactgcgagaaggccctgtgcacccccagatgcatgaacggcggcctgtgcgtgacccccggcttctgcatctgcccccccggcttctacggcgtgaactgcgacaaggccaactgcagcaccacctgcttcaacggcggcacctgcttctaccccggcaagtgcatctgcccccccggcctggagggcgagcagtgcgagatcagcaagtgcccccagccctgcagaaacggcggcaagtgcatcggcaagagcaagtgcaagtgcagcaagggctaccagggcgacctgtgcagcaagcccgtgtgcgagcccggctgcggcgcccacggcacctgccacgagcccaacaagtgccagtgccaggagggctggcacggcagacactgcaacaagagatacgaggccagcctgatccacgccctgagacccgccggcgcccagctgagacagcacacccccagcctgaagaaggccgaggagagaagagacccccccgagagcaactacatctggtag

SEQ ID NO: 13578 - DNA, 120 bp, Artificial Sequence
  Description of Artificial Sequence: Synthetic coding sequence
aagaagagaaaggagaagaagagagagaagagaagaggcaaggagagaaaggagctgttcaagctggtgagccacgtgctggagaacagaatgggctggcagcacctgaagtggatgtag

SEQ ID NO: 13579 - DNA, 1095 bp, Artificial Sequence
  Description of Artificial Sequence: Synthetic coding sequence
atggccagagccagcgaggccgtgagcagaatcctggaggagtggcacaaggccaaggtggaggccatgaccctggacctggccctgctgagaagcgtgcagcacttcgccgaggccttcaaggccaagaacgtgcccctgcacgtgctggtgtgcaacgccgccaccttcgccctgccctggagcctgaccaaggacggcctggagaccaccttccaggtgaaccacctgggccacttctacctggtgcagctgctgagaatgttctgcgccgcccagctgctgcccgtgagcctgtggagcccccagagccccatcgacctgcagatcctgaccaccccctgggagaactggaccagcgtggccagcctgcagcagaagaccaccatcggcagatgctggctgatcaccggccccagcagcgccaccagcagcagccccaccagctgcaccgtggcccccaccagaggccacgtggagagaagcgccagctggaagtacgacgtgctgcagcacagcagccagctggtgggcgtgcacaccgccgtgtacctgggcgaggccttccaccaggtgcacgccaccggcagctgccaccacagagtgctgtgctgctgccccagaaccggcggcagcggcagagacgtgctgcagcagctgctgcccctgcacgccctgaccagaagcagcgagagaagagacggccccgaccccgtgggcagcgagagactgatccaggagagactggccagccccgccaagtggagcagcgagagaatgggcacccacaccagacccgtgtgcgtgcccagcagaaagtgccagggccccctgcccaacgtgccccccacccagatcagaaagagcaagggcaacaagagcagccacaacagagtgaagaacctgaagtaccagtgggaggccggcaacagctggggcaaggtgagcctgttctggggctgggccagacacagaagcctgtgcttcctggtggtggcctgcctgaaggtgaagacctgcctggtgtgcagattcagaatcagcctggagaagcaccagcagttcagcttcttctactgctacagaatcgcctag

SEQ ID NO: 13580 - DNA, 570 bp, Artificial Sequence
  Description of Artificial Sequence: Synthetic coding sequence
atggccgccctgagatacgccggcctggacgacaccgacagcgaggacgagctgccccccggctgggaggagagaaccaccaaggacggctgggtgtactacgccaaccacaccgaggagaagacccagtgggagcaccccaagaccggcaagagaaagagagtggccggcgacctgccctacggctgggagcaggagaccgacgagaacggccaggtgttcttcgtggaccacatcaacaagagaaccacctacctggaccccagactggccttcaccgtggacgacaaccccaccaagcccaccaccagacagagatacgacggcagcaccaccgccatggagatcctgcagggcagagacttcaccggcaaggtggtggtggtgaccggcgccaacagcggcatcggcttcgagaccgccaagagcttcgccctgcacggcgcccacgtgatcctggcctgcagaaacatggccagagccagcgaggccgtgagcagaatcctggaggagtggaagaccaagtaccaccccccccccgagaagtgcagaatcaagatcttccactag

SEQ ID NO: 13581 - DNA, 936 bp, Artificial Sequence
  Description of Artificial Sequence: Synthetic coding sequence
atggccgccctgagatacgccggcctggacgacaccgacagcgaggacgagctgccccccggctgggaggagagaaccaccaaggacggctgggtgtactacgccaaccacaccgaggagaagacccagtgggagcaccccaagaccggcaagagaaagagagtggccggcgacctgccctacggctgggagcaggagaccgacgagaacggccaggtgttcttcgtggaccacatcaacaagagaaccacctacctggaccccagactggccttcaccgtggacgacaaccccaccaagcccaccaccagacagagatacgacggcagcaccaccgccatggagatcctgcagggcagagacttcaccggcaaggtggtggtggtgaccggcgccaacagcggcatcgccaccggcagctgccaccacagagtgctgtgctgctgccccagaaccggcggcagcggcagagacgtgctgcagcagctgctgcccctgcacgccctgaccagaagcagcgagagaagagacggccccgaccccgtgggcgcccagagagaggccgaccccagaaccgcctggcagcccgtgagactgagcggcgcccagagcggctgggcccacacccccgccctgtgcgtgagcccccacgccagcgccagagccggccccctgcccaacgtgccccccacccagatcagaaagagcaagggcaacaagagcagccacaacagagtgaagaacctgaagtaccagtgggaggccggcaacagctggggcaaggtgagcctgttctggggctgggccagacacagaagcctgtgcttcctggtggtggcctgcctgaaggtgaagacctgcctggtgtgcagattcagaatcagcctggagaagcaccagcagttcagcttcttctactgctacagaatcgcctag

SEQ ID NO: 13582 - DNA, 705 bp, Artificial Sequence
  Description of Artificial Sequence: Synthetic coding sequence
atggccgccctgagatacgccggcctggacgacaccgacagcgaggacgagctgccccccggctgggaggagagaaccaccaaggacggctgggtgtactacgccaaccacaccgaggagaagacccagtgggagcaccccaagaccggcaagagaaagagagtggccggcgacctgccctacggctgggagcaggagaccgacgagaacggccaggtgttcttcgtggaccacatcaacaagagaaccacctacctggaccccagactggccttcaccgtggacgacaaccccaccaagcccaccaccagacagagatacgacggcagcaccaccgccatggagatcctgcagggcagagacttcaccggcaaggtggtggtggtgaccggcgccaacagcggcatcggcttcgagaccgccaagagcttcgccctgcacggcgcccacgtgatcctggcctgcagaaacatggccagagccagcgaggccgtgagcagaatcctggaggagtggcagcagggcgccgccaccaccgtgtactgcgccgccgtgcccgagctggagggcctgggcggcatgtacttcaacaactgctgcagatgcatgcccagccccgaggcccagagcgaggagaccgccagaaccctgtgggccctgagcgagagactgatccaggagagactgggcagccagagcggctag

SEQ ID NO: 13583 - DNA, 1245 bp, Artificial Sequence
  Description of Artificial Sequence: Synthetic coding sequence
atggccgccctgagatacgccggcctggacgacaccgacagcgaggacgagctgccccccggctgggaggagagaaccaccaaggacggctgggtgtactacgccaaccacaccgaggagaagacccagtgggagcaccccaagaccggcaagagaaagagagtggccggcgacctgccctacggctgggagcaggagaccgacgagaacggccaggtgttcttcgtggaccacatcaacaagagaaccacctacctggaccccagactggccttcaccgtggacgacaaccccaccaagcccaccaccagacagagatacgacggcagcaccaccgccatggagatcctgcagggcagagacttcaccggcaaggtggtggtggtgaccggcgccaacagcggcatcggcttcgagaccgccaagagcttcgccctgcacggcgcccacgtgatcctggcctgcagaaacatggccagagccagcgaggccgtgagcagaatcctggaggagtggcacaaggccaaggtggaggccatgaccctggacctggccctgctgagaagcgtgcagcacttcgccgaggccttcaaggccaagaacgtgcccctgcacgtgctggtgtgcaacgccgccaccttcgccctgccctggagcctgaccaaggacggcctggagaccaccttccaggtgaaccacctgggccacttctacctggtgcagctgctgcaggacgtgctgtgcagaagcgcccccgccagagtgatcgtggtgagcagcgagagccacagattcaccgacatcaacgacagcctgggcaagctggacttcagcagactgagccccaccaagaacgactactgggccatgctggcctacaacagaagcaagctgtgcaacatcctgttcagcaacgagctgcacagaagactgagccccagaggcgtgaccagcaacgccgtgcaccccggcaacatgatgtacagcaacatccacagaagctggtgggtgtacaccctgctgttcaccctggccagacccttcaccaagagcatgcagcagggcgccgccaccaccgtgtactgcgccgccgtgcccgagctggagggcctgggcggcatgtacttcaacaactgctgcagatgcatgcccagccccgaggcccagagcgaggagaccgccagaaccctgtgggccctgagcgagagactgatccaggagagactgggcagccagagcggctag

SEQ ID NO: 13584 - DNA, 642 bp, Artificial Sequence
  Description of Artificial Sequence: Synthetic coding sequence
atggccgccctgagatacgccggcctggacgacaccgacagcgaggacgagctgccccccggctgggaggagagaaccaccaaggacggctgggtgtactacgccaaccacaccgaggagaagacccagtgggagcaccccaagaccggcaagagaaagagagtggccggcgacctgccctacggctgggagcaggagaccgacgagaacggccaggtgttcttcgtggaccacatcaacaagagaaccacctacctggaccccagactggccttcaccgtggacgacaaccccaccaagcccaccaccagacagagatacgacggcagcaccaccgccatggagatcctgcagggcagagacttcaccggcaaggtggtggtggtgaccggcgccaacagcggcatcggcaaggccagctgccacgtgggcagaatcctgaagcacaccagagtggaggagctgagcctgctgcccaccgccatcaacagagagctgccccccccctgcaccgtgctgctgagccagaactggagagtgtgggagggctgcaccagcaccaccgccgccgccgcctgcccccaccagaagctgagagccaagagaagacccggcccctgcggcagaagcgccagaggctag

SEQ ID NO: 13585 - DNA, 1245 bp, Artificial Sequence; identical to SEQ ID NO: 13583
  Description of Artificial Sequence: Synthetic coding sequence

SEQ ID NO: 13586 - DNA, 111 bp, Artificial Sequence
  Description of Artificial Sequence: Synthetic coding sequence
atggccgccctgagatacgccggcctggacgacaccgacagcgaggacgagctgccccccggctgggaggagagaaccaccaaggacggctgggtgtactacgccaagtag

SEQ ID NO: 13587 - DNA, 1047 bp, Artificial Sequence
  Description of Artificial Sequence: Synthetic coding sequence
atggcccacagccagaacagcctggagctgcccatcaacatcaacgccacccagatcaccaccgcctacggccacagagccctgcccaagctgaaggaggagctgcagagcgaggacctgcagaccagacagaaggccctgatggccctgtgcgacctgatgcacgaccccgagtgcatctacaaggccatgaacatcggctgcatggagaacctgaaggccctgctgaaggacagcaacagcatggtgagaatcaagaccaccgaggtgctgcacatcaccgccagccacagcgtgggcagatacgccttcctggagcacgacatcgtgctggccctgagcttcctgctgaacgaccccagccccgtgtgcagaggcaacctgtacaaggcctacatgcagctggtgcaggtgcccagaggcgcccaggagatcatcagcaagggcctgatcagcagcctggtgtggaagctgcaggtggaggtggaggaggaggagttccaggagttcatcctggacaccctggtgctgtgcctgcaggaggacgccaccgaggccctgggcagcaacgtggtgctggtgctgaagcagaagctgctgagcgccaaccagaacatcagaagcaaggccgccagagccctgctgaacgtgagcatcagcagagagggcaagaagcaggtgtgccacttcgacgtgatccccatcctggtgcacctgctgaaggaccccgtggagcacgtgaagagcaacgccgccggcgccctgatgttcgccaccgtgatcaccgagggcaagtacgccgccctggaggcccaggccatcggcctgctgctggagctgctgcacagccccatgaccatcgccagactgaacgccaccaaggccctgaccatgctggccgaggcccccgagggcagaaaggccctgcagacccacgtgcccaccttcagagccatggaggtggagacctacgagaagccccaggtggccgaggccctgcagagagccgccagaatcgccatcagcgtgatcgagttcaagccctag

SEQ ID NO: 13588 - DNA, 1131 bp, Artificial Sequence
  Description of Artificial Sequence: Synthetic coding sequence
atggtggtggtggccgccgcccccaaccccgccgacggcacccccaaggtgctgctgctgagcggccagcccgccagcgccgccggcgcccccgccggccaggccctgcccctgatggtgcccgcccagagaggcgccagccccgaggccgccagcggcggcctgccccaggccagaaagagacagagactgacccacctgagccccgaggagaaggccctgagaagaaagctgaagaacagagtggccgcccagaccgccagagacagaaagaaggccagaatgagcgagctggagcagcaggtggtggacctggaggaggagaaccagaagctgctgctggagaaccagctgctgagagagaagacccacggcctggtggtggagaaccaggagctgagacagagactgggcatggacgccctggtggccgaggaggaggccgaggccaagggcaacgaggtgagacccgtggccggcagcgccgagagcgccgccggcgccggccccgtggtgaccccccccgagcacctgcccatggacagcggcggcatcgacagcagcgacagcgagagcgacatcctgctgggcatcctggacaacctggaccccgtgatgttcttcaagtgccccagccccgagcccgccagcctggaggagctgcccgaggtgtaccccgagggccccagcagcctgcccgccagcctgagcctgagcgtgggcaccagcagcgccaagctggaggccatcaacgagctgatcagattcgaccacatctacaccaagcccctggtgctggagatccccagcgagaccgagagccaggccaacgtggtggtgaagatcgaggaggcccccctgagccccagcgagaacgaccaccccgagttcatcgtgagcgtgaaggaggagcccgtggaggacgacctggtgcccgagctgggcatcagcaacctgctgagcagcagccactgccccaagcccagcagctgcctgctggacgcctacagcgactgcggctacggcggcagcctgagccccttcagcgacatgagcagcctgctgggcgtgaaccacagctgggaggacaccttcgccaacgagctgttcccccagctgatcagcgtgtag

SEQ ID NO: 13589 - DNA, 801 bp, Artificial Sequence
  Description of Artificial Sequence: Synthetic coding sequence
atggtggtggtggccgccgcccccaaccccgccgacggcacccccaaggtgctgctgctgagcggccagcccgccagcgccgccggcgcccccgccggccaggccctgcccctgatggtgcccgcccagagaggcgccagccccgaggccgccagcggcggcctgccccaggccagaaagagacagagactgacccacctgagccccgaggagaaggccctgagaagaaagctgaagaacagagtggccgcccagaccgccagagacagaaagaaggccagaatgagcgagctggagcagcaggtggtggacctggaggaggaggtgaagctgctgaagaaccagaagctgctgctggagaaccagctgctgagagagaagacccacggcctggtggtggagaaccaggagctgagacagagactgggcatggacgccctggtggccgaggaggaggccgaggccaagggcaacgaggtgagacccgtggccggcagcgccgagagcgccgccctgagactgagagcccccctgcagcaggtgcaggcccagctgagccccctgcagaacatcagcccctggatcctggccgtgctgaccctgcagatccagagcctgatcagctgctgggccttctggaccacctggacccagagctgcagcagcaacgccctgccccagagcctgcccgcctggagaagcagccagagaagcacccagaaggaccccgtgccctaccagccccccttcctgtgccagtggggcagacaccagcccagctggaagcccctgatgaactag

SEQ ID NO: 13590 - DNA, 636 bp, Artificial Sequence
  Description of Artificial Sequence: Synthetic coding sequence
atgagagcccccgtgttccaggccctgctgctgtgcggcagaagactggtggtgcagcccctgaacagcgacatgagaaagctgaagaacagagtggccgcccagaccgccagagacagaaagaaggccagaatgagcgagctggagcagcaggtggtggacctggaggaggagaaccagaagctgctgctggagaaccagctgctgagagagaagacccacggcctggtggtggagaaccaggagctgagacagagactgggcatggacgccctggtggccgaggaggaggccgaggccaagggcaacgaggtgagacccgtggccggcagcgccgagagcgccgccctgagactgagagcccccctgcagcaggtgcaggcccagctgagccccctgcagaacatcagcccctggatcctggccgtgctgaccctgcagatccagagcctgatcagctgctgggccttctggaccacctggacccagagctgcagcagcaacgccctgccccagagcctgcccgcctggagaagcagccagagaagcacccagaaggaccccgtgccctaccagccccccttcctgtgccagtggggcagacaccagcccagctggaagcccctgatgaactag

SEQ ID NO: 13591 - DNA, 822 bp, Artificial Sequence
  Description of Artificial Sequence: Synthetic coding sequence
atggccgccgccgacggcgccctgcccgaggccgccgccctggagcagcccgccgagctgcccgccagcgtgagagccagcatcgagagaaagagacagagagccctgatgctgagacaggccagactggccgccagaccctacagcgccaccgccgccgccgccaccggcggcatggccaacgtgaaggccgcccccaagatcatcgacaccggcggcggcttcatcctggaggaggaggaggaggaggagcagaagatcggcaaggtggtgcaccagcccggccccgtgatggagttcgactacgtgatctgcgaggagtgcggcaaggagttcatggacagctacctgatgaaccacttcgacctgcccacctgcgacaactgcagagacgccgacgacaagcacaagctgatcaccaagaccgaggccaagcaggagtacctgctgaaggactgcgacctggagaagagagagccccccctgaagttcatcgtgaagaagaacccccaccacagccagtggggcgacatgaagctgtacctgaagctgcagatcgtgaagagaagcctggaggtgtggggcagccaggaggccctggaggaggccaaggaggtgagacaggagaacagagagaagatgaagcagaagaagttcgacaagaaggtgaaggagctgagaagagccgtgagaagcagcgtgtggaagagagagaccatcgtgcaccagcacgagtacggccccgaggagaacctggaggacgacatgtacagaaagacctgcaccatgtgcggccacgagctgacctacgagaagatgtag

SEQ ID NO: 13592 - DNA, 2823 bp, Artificial Sequence
  Description of Artificial Sequence: Synthetic coding sequence
atggccagaaagagagccgccggcggcgagcccagaggcagagagctgagaagccagaagagcaaggccaagagcaaggccagaagagaggaggaggaggaggacgccttcgaggacgagaagccccccaagaagagcctgctgagcaaggtgagccagggcaagagaaagagaggctgcagccaccccggcggcagcgccgacggccccgccaagaagaaggtggccaaggtgaccgtgaagagcgagaacctgaaggtgatcaaggacgaggccctgagcgacggcgacgacctgagagacttccccagcgacctgaagaaggcccaccacctgaagagaggcgccaccatgaacgaggacagcaacgaggaggaggaggagagcgagaacgactgggaggaggtggaggagctgagcgagcccgtgctgggcgacgtgagagagagcaccgccttcagcagaagcctgctgcccgtgaagcccgtggagatcgagatcgagacccccgagcaggccaagaccagagagagaagcgagaagatcaagctggagttcgagacctacctgagaagagccatgaagagattcaacaagggcgtgcacgaggacacccacaaggtgcacctgctgtgcctgctggccaacggcttctacagaaacaacatctgcagccagcccgacctgcacgccatcggcctgagcatcatccccgccagattcaccagagtgctgcccagagacgtggacacctactacctgagcaacctggtgaagtggttcatcggcaccttcaccgtgaacgccgagctgagcgccagcgagcaggacaacctgcagaccaccctggagagaagattcgccatctacagcgccagagacgacgaggagctggtgcacatcttcctgctgatcctgagagccctgcagctgctgaccagactggtgctgagcctgcagcccatccccctgaagagcgccaccgccaagggcaagaagcccagcaaggagagactgaccgccgaccccggcggcagcagcgagaccagcagccaggtgctggagaaccacaccaagcccaagaccagcaagggcaccaagcaggaggagaccttcgccaagggcacctgcagacccagcgccaagggcaagagaaacaagggcggcagaaagaagagaagcaagcccagcagcagcgaggaggacgagggccccggcgacaagcaggagaaggccacccagagaagaccccacggcagagagagaagagtggccagcagagtgagctacaaggaggagagcggcagcgacgaggccggcagcggcagcgacttcgagctgagcagcggcgaggccagcgaccccagcgacgaggacagcgagcccggcccccccaagcagagaaaggcccccgccccccagagaaccaaggccggcagcaagagcgccagcagaacccacagaggcagccacagaaaggaccccagcctgcccgccgccagcagcagcagcagcagcagcaagagaggcaagaagatgtgcagcgacggcgagaaggccgagaagagaagcatcgccggcatcgaccagtggctggaggtgttctgcgagcaggaggagaagtgggtgtgcgtggactgcgtgcacggcgtggtgggccagcccctgacctgctacaagtacgccaccaagcccatgacctacgtggtgggcatcgacagcgacggctgggtgagagacgtgacccagagatacgaccccgtgtggatgaccgtgaccagaaagtgcagagtggacgccgagtggtgggccgagaccctgagaccctaccagagccccttcatggacagagagaagaaggaggacctggagttccaggccaagcacatggaccagcccctgcccaccgccatcggcctgtacaagaaccaccccctgtacgccctgaagagacacctgctgaagtacgaggccatctaccccgagaccgccgccatcctgggctactgcagaggcgaggccgtgtacagcagagactgcgtgcacaccctgcacagcagagacacctggctgaagaaggccagagtggtgagactgggcgaggtgccctacaagatggtgaagggcttcagcaacagagccagaaaggccagactggccgagccccagctgagagaggagaacgacctgggcctgttcggctactggcagaccgaggagtaccagccccccgtggccgtggacggcaaggtgcccagaaacgagttcggcaacgtgtacctgttcctgcccagcatgatgcccatcggctgcgtgcagctgaacctgcccaacctgcacagagtggccagaaagctggacatcgactgcgtgcaggccatcaccggcttcgacttccacggcggctacagccaccccgtgaccgacggctacatcgtgtgcgaggagttcaaggacgtgctgctgaccgcctgggagaacgagcaggccgtgatcgagagaaaggagaaggagaagaaggagaagagagccctgggcaactggaagctgctggccaagggcctgctgatcagagagagactgaagagaagatacggccccaagagcgaggccgccgccccccacaccgacgccggcggcggcctgagcagcgacgaggaggagggcaccagcagccaggccgaggccgccagaatcctggccgccagctggccccagaacagagaggacgaggagaagcagaagctgaagggcggccccaagaagaccaagagagagaagaaggccgccgccagccacctgttccccttcgagcagctgtag

SEQ ID NO: 13593 - DNA, 2712 bp, Artificial Sequence
  Description of Artificial Sequence: Synthetic coding sequence
atggccagaaagagagccgccggcggcgagcccagaggcagagagctgagaagccagaagagcaaggccaagagcaaggccagaagagaggaggaggaggaggacgccttcgaggacgagaagccccccaagaagagcctgctgagcaaggtgagccagggcaagagaaagagaggctgcagccaccccggcggcagcgccgacggccccgccaagaagaaggtggccaaggtgaccgtgaagagcgagaacctgaaggtgatcaaggacgaggccctgagcgacggcgacgacctgagagacttccccagcgacctgaagaaggcccaccacctgaagagaggcgccaccatgaacgaggacagcaacgaggaggaggaggagagcgagaacgactgggaggaggccaagaccagagagagaagcgagaagatcaagctggagttcgagacctacctgagaagagccatgaagagattcaacaagggcgtgcacgaggacacccacaaggtgcacctgctgtgcctgctggccaacggcttctacagaaacaacatctgcagccagcccgacctgcacgccatcggcctgagcatcatccccgccagattcaccagagtgctgcccagagacgtggacacctactacctgagcaacctggtgaagtggttcatcggcaccttcaccgtgaacgccgagctgagcgccagcgagcaggacaacctgcagaccaccctggagagaagattcgccatctacagcgccagagacgacgaggagctggtgcacatcttcctgctgatcctgagagccctgcagctgctgaccagactggtgctgagcctgcagcccatccccctgaagagcgccaccgccaagggcaagaagcccagcaaggagagactgaccgccgaccccggcggcagcagcgagaccagcagccaggtgctggagaaccacaccaagcccaagaccagcaagggcaccaagcaggaggagaccttcgccaagggcacctgcagacccagcgccaagggcaagagaaacaagggcggcagaaagaagagaagcaagcccagcagcagcgaggaggacgagggccccggcgacaagcaggagaaggccacccagagaagaccccacggcagagagagaagagtggccagcagagtgagctacaaggaggagagcggcagcgacgaggccggcagcggcagcgacttcgagctgagcagcggcgaggccagcgaccccagcgacgaggacagcgagcccggcccccccaagcagagaaaggcccccgccccccagagaaccaaggccggcagcaagagcgccagcagaacccacagaggcagccacagaaaggaccccagcctgcccgccgccagcagcagcagcagcagcagcaagagaggcaagaagatgtgcagcgacggcgagaaggccgagaagagaagcatcgccggcatcgaccagtggctggaggtgttctgcgagcaggaggagaagtgggtgtgcgtggactgcgtgcacggcgtggtgggccagcccctgacctgctacaagtacgccaccaagcccatgacctacgtggtgggcatcgacagcgacggctgggtgagagacgtgacccagagatacgaccccgtgtggatgaccgtgaccagaaagtgcagagtggacgccgagtggtgggccgagaccctgagaccctaccagagccccttcatggacagagagaagaaggaggacctggagttccaggccaagcacatggaccagcccctgcccaccgccatcggcctgtacaagaaccaccccctgtacgccctgaagagacacctgctgaagtacgaggccatctaccccgagaccgccgccatcctgggctactgcagaggcgaggccgtgtacagcagagactgcgtgcacaccctgcacagcagagacacctggctgaagaaggccagagtggtgagactgggcgaggtgccctacaagatggtgaagggcttcagcaacagagccagaaaggccagactggccgagccccagctgagagaggagaacgacctgggcctgttcggctactggcagaccgaggagtaccagccccccgtggccgtggacggcaaggtgcccagaaacgagttcggcaacgtgtacctgttcctgcccagcatgatgcccatcggctgcgtgcagctgaacctgcccaacctgcacagagtggccagaaagctggacatcgactgcgtgcaggccatcaccggcttcgacttccacggcggctacagccaccccgtgaccgacggctacatcgtgtgcgaggagttcaaggacgtgctgctgaccgcctgggagaacgagcaggccgtgatcgagagaaaggagaaggagaagaaggagaagagagccctgggcaactggaagctgctggccaagggcctgctgatcagagagagactgaagagaagatacggccccaagagcgaggccgccgccccccacaccgacgccggcggcggcctgagcagcgacgaggaggagggcaccagcagccaggccgaggccgccagaatcctggccgccagctggccccagaacagagaggacgaggagaagcagaagctgaagggcggccccaagaagaccaagagagagaagaaggccgccgccagccacctgttccccttcgagcagctgtag

SEQ ID NO: 13594 - DNA, 423 bp, Artificial Sequence
  Description of Artificial Sequence: Synthetic coding sequence
atggccagaaagagagccgccggcggcgagcccagaggcagagagctgagaagccagaagagcaaggccaagagcaaggccagaagagaggaggaggaggaggacgccttcgaggacgagaagccccccaagaagagcctgctgagcaaggtgagccagggcaagagaaagagaggctgcagccaccccggcggcagcgccgacggccccgccaagaagaaggtggccaaggtgaccgtgaagagcgagaacctgaaggtgatcaaggacgaggccctgagcgacggcgacgacctgagagacttccccagcgacctgaagaaggcccaccacctgaagagaggcgccaccatgaacgaggacagcaacgaggaggaggaggagagcgagaacgactgggaggaggtggaggtgaagagatag

SEQ ID NO: 13595 - DNA, 507 bp, Artificial Sequence
  Description of Artificial Sequence: Synthetic coding sequence
atggccagaaagagagccgccggcggcgagcccagaggcagagagctgagaagccagaagagcaaggccaagagcaaggccagacacgccttcgaggacgagaagccccccaagaagagcctgctgagcaaggtgagccagggcaagagaaagagaggctgcagccaccccggcggcagcgccgacggccccgccaagaagaaggtggccaaggtgaccgtgaagagcgagaacctgaaggtgatcaaggacgaggccctgagcgacggcgacgacctgagagacttccccagcgacctgaagaaggcccaccacctgaagagaggcgccaccatgaacgaggacagcaacgaggaggaggaggagagcgagaacgactgggaggaggtggaggagctgagcgagcccgtgctgggcgacgtgagagagagcaccgccttcagcagaagcctgctgcccgtgaagcccgtggagatcgagatcgagacccccgagcaggccaagtag

SEQ ID NO: 13596 - DNA, 462 bp, Artificial Sequence
  Description of Artificial Sequence: Synthetic coding sequence
agcagcagcaagagaggcaagaagatgtgcagcgacggcgagaaggccgagaagagaagcatcgccggcatcgaccagtggctggaggtgttctgcgagcaggaggagaagtgggtgtgcgtggactgcgtgcacggcgtggtgggccagcccctgacctgctacaagtacgccaccaagcccatgacctacgtggtgggcatcgacagcgacggctgggtgagagacgtgacccagagatacgaccccgtgtggatgaccgtgaccagaaagtgcagagtggacgccgagtggtgggccgagaccctgagaccctaccagagccccttcatggacagagagaagaaggaggacctggagggcctgtgcgcccacagcgccttccagggccacgtggccgaggagagcaagagcggcgaggcctggagaagcaccctgcaggacggcgagagactgttctag

SEQ ID NO: 13597 - DNA, 177 bp, Artificial Sequence
  Description of Artificial Sequence: Synthetic coding sequence
atgtgcagcgacggcgagaaggccgagaagagaagcatcgccggcatcgaccagtggctggaggtgttctgcgagcaggaggagaagtgggtgtgcgtggactgcagatgcggcggccccgccagcgacctgctgcaggtgagacaccaggcccacgacctgtgcggcggccactag

SEQ ID NO: 13598 - DNA, 231 bp, Artificial Sequence
  Description of Artificial Sequence: Synthetic coding sequence
aaggccacccagagaagaccccacggcagagagagaagagtggccagcagagtgagctacaaggaggagagcggcagcgacgaggccggcagcggcagcgacttcgagctgagcagcggcgaggccagcgaccccagcgacgaggacagcgagcccggcccccccaagcagagaaaggcccccgccccccagagaaccaaggccggcagcaagagcgccagcagaacctag

SEQ ID NO: 13599 - DNA, 849 bp, Artificial Sequence
  Description of Artificial Sequence: Synthetic coding sequence
atggagggcgacttcagcgtgtgcagaaactgcaagagacacgtggtgagcgccaacttcaccctgcacgaggcctactgcctgagattcctggtgctgtgccccgagtgcgaggagcccgtgcccaaggagaccatggaggagcactgcaagctggagcaccagcaggccaacgagtgccaggagagacccgtggagtgcaagttctgcaagctggacatgcagctgagcaagctggagctgcacgagagctactgcggcagcagaaccgagctgtgccagggctgcggccagttcatcatgcacagaatgctggcccagcacagagacgtgtgcagaagcgagcaggcccagctgggcaagggcgagagaatcagcgcccccgagagagagatctactgccactactgcaaccagatgatccccgagaacaagtacttccaccacatgggcaagtgctgccccgacagcgagttcaagaagcacttccccgtgggcaaccccgagatcctgcccagcagcctgcccagccaggccgccgagaaccagaccagcaccatggagaaggacgtgagacccaagaccagaagcatcaacagattccccctgcacagcgagagcagcagcaagaaggcccccagaagcaagaacaagaccctggaccccctgctgatgagcgagcccaagcccagaaccagcagccccagaggcgacaaggccgcctacgacatcctgagaagatgcagccagtgcggcatcctgctgcccctgcccatcctgaaccagcaccaggagaagtgcagatggctggccagcagcaagggcaagcaggtgagaaacttcagctag

SEQ ID NO: 13600 - DNA, 906 bp, Artificial Sequence
  Description of Artificial Sequence: Synthetic coding sequence
atggagggcgacttcagcgtgtgcagaaactgcaagagacacgtggtgagcgccaacttcaccctgcacgaggcctactgcctgagattcctggtgctgtgccccgagtgcgaggagcccgtgcccaaggagaccatggaggagcactgcaagctggagcaccagcaggtgggctgcaccatgtgccagcagagcatgcagaagagcagcctggagttccacaaggccaacgagtgccaggagagacccgtggagtgcaagttctgcaagctggacatgcagctgagcaagctggagctgcacgagagctactgcggcagcagaaccgagctgtgccagggctgcggccagttcatcatgcacagaatgctggcccagcacagagacgtgtgcagaagcgagcaggcccagctgggcaagggcgagagaatcagcgcccccgagagagagatctactgccactactgcaaccagatgatccccgagaacaagtacttccaccacatgggcaagtgctgccccgacagcgagttcaagaagcacttccccgtgggcaaccccgagatcctgcccagcagcctgcccagccaggccgccgagaaccagaccagcaccatggagaaggacgtgagacccaagaccagaagcatcaacagattccccctgcacagcgagagcagcagcaagaaggcccccagaagcaagaacaagaccctggaccccctgctgatgagcgagcccaagcccagaaccagcagccccagaggcgacaaggccgcctacgacatcctgagaagatgcagccagtgcggcatcctgctgcccctgcccatcctgaaccagcaccaggagaagtgcagatggctggccagcagcaagggcaagcaggtgagaaacttcagctag

SEQ ID NO: 13601 - DNA, 600 bp, Artificial Sequence
  Description of Artificial Sequence: Synthetic coding sequence
atgagcctgcactacggctgctgctgccccgagtgcaccagcgtggccatcaaggagatgatgtgggtgatcagacccagagtggcctgcgtggtgaaggacgccggcagcgccggcgagagaatcagcgcccccgagagagagatctactgccactactgcaaccagatgatccccgagaacaagtacttccaccacatgggcaagtgctgccccgacagcgagttcaagaagcacttccccgtgggcaaccccgagatcctgcccagcagcctgcccagccaggccgccgagaaccagaccagcaccatggagaaggacgtgagacccaagaccagaagcatcaacagattccccctgcacagcgagagcagcagcaagaaggcccccagaagcaagaacaagaccctggaccccctgctgatgagcgagcccaagcccagaaccagcagccccagaggcgacaaggccgcctacgacatcctgagaagatgcagccagtgcggcatcctgctgcccctgcccatcctgaaccagcaccaggagaagtgcagatggctggccagcagcaagggcaagcaggtgagaaacttcagctag

SEQ ID NO: 13602 - DNA, 495 bp, Artificial Sequence
  Description of Artificial Sequence: Synthetic coding sequence
atggagggcgacttcagcgtgtgcagaaactgcaagagacacgtggtgagcgccaacttcaccctgcacgaggcctactgcctgagattcctggtgctgtgccccgagtgcgaggagcccgtgcccaaggagaccatggaggagcactgcaagctggagcaccagcaggtgggctgcaccatgtgccagcagagcatgcagaagagcagcctggagttccacaaggccaacgagtgccaggagagacccgtggagtgcaagttctgcaagctggacatgcagctgagcaagctggagctgcacgagagctactgcggcagcagaaccgagctgtgccagggctgcggccagttcatcatgcacagaatgctggcccagcacagagacgtgtgcagaagcgagcaggcccagctgggcaaggagaccagccccgaccccggcaagtgcctgagcatcaccgtggccgccgccctgagcgcccacctgtggccctag

SEQ ID NO: 13603 - DNA, 906 bp, Artificial Sequence
  Description of Artificial Sequence: Synthetic coding sequence
atggagggcgacttcagcgtgtgcagaaactgcaagagacacgtggtgagcgccaacttcaccctgcacgaggcctactgcctgagattcctggtgctgtgccccgagtgcgaggagcccgtgcccaaggagaccatggaggagcactgcaagctggagcaccagcaggtgagcgagatgggcagcggcagaggcaagtgcagcatcctgcccgccagaaagaaggccaacgagtgccaggagagacccgtggagtgcaagttctgcaagctggacatgcagctgagcaagctggagctgcacgagagctactgcggcagcagaaccgagctgtgccagggctgcggccagttcatcatgcacagaatgctggcccagcacagagacgtgtgcagaagcgagcaggcccagctgggcaagggcgagagaatcagcgcccccgagagagagatctactgccactactgcaaccagatgatccccgagaacaagtacttccaccacatgggcaagtgctgccccgacagcgagttcaagaagcacttccccgtgggcaaccccgagatcctgcccagcagcctgcccagccaggccgccgagaaccagaccagcaccatggagaaggacgtgagacccaagaccagaagcatcaacagattccccctgcacagcgagagcagcagcaagaaggcccccagaagcaagaacaagaccctggaccccctgctgatgagcgagcccaagcccagaaccagcagccccagaggcgacaaggccgcctacgacatcctgagaagatgcagccagtgcggcatcctgctgcccctgcccatcctgaaccagcaccaggagaagtgcagatggctggccagcagcaagggcaagcaggtgagaaacttcagctag

SEQ ID NO: 13604 - DNA, 1494 bp, Artificial Sequence
  Description of Artificial Sequence: Synthetic coding sequence
atgaccttcaacagcttcgagggcagcaagacctgcgtgcccgccgacatcaacaaggaggaggagttcgtggaggagttcaacagactgaagaccttcgccaacttccccagcggcagccccgtgagcgccagcaccctggccagagccggcttcctgtacaccggcgagggcgacaccgtgagatgcttcagctgccacgccgccgtggacagatggcagtacggcgacagcgccgtgggcagacacagaaaggtgagccccaactgcagattcatcaacggcttctacctggagaacagcgccacccagagcaccaacagcggcatccagaacggccagtacaaggtggagaactacctgggcagcagagaccacttcgccctggacagacccagcgagacccacgccgactacctgctgagaaccggccaggtggtggacatcagcgacaccatctaccccagaaaccccgccatgtacagcgaggaggccagactgaagagcttccagaactggcccgactacgcccacctgacccccagagagctggccagcgccggcctgtactacaccggcatcggcgaccaggtgcagtgcttctgctgcggcggcaagctgaagaactgggagccctgcgacagagcctggagcgagcacagaagacacttccccaactgcttcttcgtgctgggcagaaacctgaacatcagaagcgagagcgacgccgtgagcagcgacagaaacttccccaacagcaccaacctgcccagaaaccccagcatggccgactacgaggccagaatcttcaccttcggcacctggatctacagcgtgaacaaggagcagctggccagagccggcttctacgccctgggcgagggcgacaaggtgaagtgcttccactgcggcggcggcctgaccgactggaagcccagcgaggacccctgggagcagcacgccaagtggtaccccggctgcaagtacctgctggagcagaagggccaggagtacatcaacaacatccacctgacccacagcctggaggagtgcctggtgagaaccaccgagaagacccccagcctgaccagaagaatcgacgacaccatcttccagaaccccatggtgcaggaggccatcagaatgggcttcagcttcaaggacatcaagaagatcatggaggagaagatccagatcagcggcagcaactacaagagcctggaggtgctggtggccgacctggtgaacgcccagaaggacagcatgcaggacgagagcagccagaccagcctgcagaaggagatcagcaccgaggagcagctgagaagactgcaggaggagaagctgtgcaagatctgcatggacagaaacatcgccatcgtgttcgtgccctgcggccacctggtgacctgcaagcagtgcgccgaggccgtggacaagtgccccatgtgctacaccgtgatcaccttcaagcagaagatcttcatgagctag

SEQ ID NO: 13605 - DNA, 1494 bp, Artificial Sequence; identical to SEQ ID NO: 13604
  Description of Artificial Sequence: Synthetic coding sequence

SEQ ID NO: 13606 - DNA, 51 bp, Artificial Sequence
  Description of Artificial Sequence: Synthetic coding sequence
atgaccttcaacagcttcgagggcagcaagacctgcgtgcccgccgactag

SEQ ID NO: 13607 - DNA, 471 bp, Artificial Sequence
  Description of Artificial Sequence: Synthetic coding sequence
atgaccttcaacagcttcgagggcagcaagacctgcgtgcccgccgacatcaacaaggaggaggagttcgtggaggagttcaacagactgaagaccttcgccaacttccccagcggcagccccgtgagcgccagcaccctggccagagccggcttcctgtacaccggcgagggcgacaccgtgagatgcttcagctgccacgccgccgtggacagatggcagtacggcgacagcgccgtgggcagacacagaaaggtgagccccaactgcagattcatcaacggcttctacctggagaacagcgccacccagagcaccaacagcggcatccagaacggccagtacaaggtggagaactacctgggcagcagagaccacttcgccctggacagacccagcgagacccacgccgactacctgctgagaaccggccaggtggtggacatcagcgacaccatctaccccagatag

SEQ ID NO: 13608 - DNA, 1494 bp, Artificial Sequence; identical to SEQ ID NO: 13604
  Description of Artificial Sequence: Synthetic coding sequence

SEQ ID NO: 13609 - DNA, 2568 bp, Artificial Sequence
  Description of Artificial Sequence: Synthetic coding sequence
atggtggtgatggccagactgagcagacccgagagacccgacctggtgttcgaggaggaggacctgccctacgaggaggagatcatgagaaaccagttcagcgtgaagtgctggctgagatacatcgagttcaagcagggcgcccccaagcccagactgaaccagctgtacgagagagccctgaagctgctgccctgcagctacaagctgtggtacagatacctgaaggccagaagagcccaggtgaagcacagatgcgtgaccgaccccgcctacgaggacgtgaacaactgccacgagagagccttcgtgttcatgcacaagatgcccagactgtggctggactactgccagttcctgatggaccagggcagagtgacccacaccagaagaaccttcgacagagccctgagagccctgcccatcacccagcacagcagaatctggcccctgtacctgagattcctgagaagccaccccctgcccgagaccgccgtgagaggctacagaagattcctgaagctgagccccgagagcgccgaggagtacatcgagtacctgaagagcagcgacagactggacgaggccgcccagagactggccaccgtggtgaacgacgagagattcgtgagcaaggccggcaagagcaactaccagctgtggcacgagctgtgcgacctgatcagccagaaccccgacaaggtgcagagcctgaacgtggacgccatcatcagaggcggcctgaccagattcaccgaccagctgggcaagctgtggtgcagcctggccgactactacatcagaagcggccacttcgagaaggccagagacgtgtacgaggaggccatcagaaccgtgatgaccgtgagagacttcacccaggtgttcgacagctacgcccagttcgaggagagcatgatcgccgccaagatggagaccgccagcgagctgggcagagaggaggaggacgacgtggacctggagctgagactggccagattcgagcagctgatcagcagaagacccctgctgctgaacagcgtgctgctgagacagaacccccaccacgtgcacgagtggcacaagagagtggccctgcaccagggcagacccagagagatcatcaacacctacaccgaggccgtgcagaccgtggaccccttcaaggccaccggcaagccccacaccctgtgggtggccttcgccaagttctacgaggacaacggccagctggacgacgccagagtgatcctggagaaggccaccaaggtgaacttcaagcaggtggacgacctggccagcgtgtggtgccagtgcggcgagctggagctgagacacgagaactacgacgaggccctgagactgctgagaaaggccaccgccctgcccgccagaagagccgagtacttcgacggcagcgagcccgtgcagaacagagtgtacaagagcctgaaggtgtggagcatgctggccgacctggaggagagcctgggcaccttccagagcaccaaggccgtgtacgacagaatcctggacctgagaatcgccaccccccagatcgtgatcaactacgccatgttcctggaggagcacaagtacttcgaggagagcttcaaggcctacgagagaggcatcagcctgttcaagtggcccaacgtgagcgacatctggagcacctacctgaccaagttcatcgccagatacggcggcagaaagctggagagagccagagacctgttcgagcaggccctggacggctgcccccccaagtacgccaagaccctgtacctgctgtacgcccagctggaggaggagtggggcctggccagacacgccatggccgtgtacgagagagccaccagagccgtggagcccgcccagcagtacgacatgttcaacatctacatcaagagagccgccgagatctacggcgtgacccacaccagaggcatctaccagaaggccatcgaggtgctgagcgacgagcacgccagagagatgtgcctgagattcgccgacatggagtgcaagctgggcgagatcgacagagccagagccatctacagcttctgcagccagatctgcgaccccagaaccaccggcgccttctggcagacctggaaggacttcgaggtgagacacggcaacgaggacaccatcaaggagatgctgagaatcagaagaagcgtgcaggccacctacaacacccaggtgaacttcatggccagccagatgctgaaggtgagcggcagcgccaccggcaccgtgagcgacctggcccccggccagagcggcatggacgacatgaagctgctggagcagagagccgagcagctggccgccgaggccgagagagaccagcccctgagagcccagagcaagatcctgttcgtgagaagcgacgccagcagagaggagctggccgagctggcccagcaggtgaaccccgaggagatccagctgggcgaggacgaggacgaggacgagatggacctggagcccaacgaggtgagactggagcagcagagcgtgcccgccgccgtgttcggcagcctgaaggaggactag

SEQ ID NO: 13610 - DNA, 2559 bp, Artificial Sequence
  Description of Artificial Sequence: Synthetic coding sequence
atggccagactgagcagacccgagagacccgacctggtgttcgaggaggaggacctgccctacgaggaggagatcatgagaaaccagttcagcgtgaagtgctggctgagatacatcgagttcaagcagggcgcccccaagcccagactgaaccagctgtacgagagagccctgaagctgctgccctgcagctacaagctgtggtacagatacctgaaggccagaagagcccaggtgaagcacagatgcgtgaccgaccccgcctacgaggacgtgaacaactgccacgagagagccttcgtgttcatgcacaagatgcccagactgtggctggactactgccagttcctgatggaccagggcagagtgacccacaccagaagaaccttcgacagagccctgagagccctgcccatcacccagcacagcagaatctggcccctgtacctgagattcctgagaagccaccccctgcccgagaccgccgtgagaggctacagaagattcctgaagctgagccccgagagcgccgaggagtacatcgagtacctgaagagcagcgacagactggacgaggccgcccagagactggccaccgtggtgaacgacgagagattcgtgagcaaggccggcaagagcaactaccagctgtggcacgagctgtgcgacctgatcagccagaaccccgacaaggtgcagagcctgaacgtggacgccatcatcagaggcggcctgaccagattcaccgaccagctgggcaagctgtggtgcagcctggccgactactacatcagaagcggccacttcgagaaggccagagacgtgtacgaggaggccatcagaaccgtgatgaccgtgagagacttcacccaggtgttcgacagctacgcccagttcgaggagagcatgatcgccgccaagatggagaccgccagcgagctgggcagagaggaggaggacgacgtggacctggagctgagactggccagattcgagcagctgatcagcagaagacccctgctgctgaacagcgtgctgctgagacagaacccccaccacgtgcacgagtggcacaagagagtggccctgcaccagggcagacccagagagatcatcaacacctacaccgaggccgtgcagaccgtggaccccttcaaggccaccggcaagccccacaccctgtgggtggccttcgccaagttctacgaggacaacggccagctggacgacgccagagtgatcctggagaaggccaccaaggtgaacttcaagcaggtggacgacctggccagcgtgtggtgccagtgcggcgagctggagctgagacacgagaactacgacgaggccctgagactgctgagaaaggccaccgccctgcccgccagaagagccgagtacttcgacggcagcgagcccgtgcagaacagagtgtacaagagcctgaaggtgtggagcatgctggccgacctggaggagagcctgggcaccttccagagcaccaaggccgtgtacgacagaatcctggacctgagaatcgccaccccccagatcgtgatcaactacgccatgttcctggaggagcacaagtacttcgaggagagcttcaaggcctacgagagaggcatcagcctgttcaagtggcccaacgtgagcgacatctggagcacctacctgaccaagttcatcgccagatacggcggcagaaagctggagagagccagagacctgttcgagcaggccctggacggctgcccccccaagtacgccaagaccctgtacctgctgtacgcccagctggaggaggagtggggcctggccagacacgccatggccgtgtacgagagagccaccagagccgtggagcccgcccagcagtacgacatgttcaacatctacatcaagagagccgccgagatctacggcgtgacccacaccagaggcatctaccagaaggccatcgaggtgctgagcgacgagcacgccagagagatgtgcctgagattcgccgacatggagtgcaagctgggcgagatcgacagagccagagccatctacagcttctgcagccagatctgcgaccccagaaccaccggcgccttctggcagacctggaaggacttcgaggtgagacacggcaacgaggacaccatcaaggagatgctgagaatcagaagaagcgtgcaggccacctacaacacccaggtgaacttcatggccagccagatgctgaaggtgagcggcagcgccaccggcaccgtgagcgacctggcccccggccagagcggcatggacgacatgaagctgctggagcagagagccgagcagctggccgccgaggccgagagagaccagcccctgagagcccagagcaagatcctgttcgtgagaagcgacgccagcagagaggagctggccgagctggcccagcaggtgaaccccgaggagatccagctgggcgaggacgaggacgaggacgagatggacctggagcccaacgaggtgagactggagcagcagagcgtgcccgccgccgtgttcggcagcctgaaggaggactag

SEQ ID NO: 13611 - DNA, 1902 bp, Artificial Sequence
  Description of Artificial Sequence: Synthetic coding sequence
atgcccgagatcagactgagacacgtggtgagctgcagcagccaggacagcacccactgcgccgagaacctgctgaaggccgacacctacagaaagtggagagccgccaaggccggcgagaagaccatcagcgtggtgctgcagctggagaaggaggagcagatccacagcgtggacatcggcaacgacggcagcgccttcgtggaggtgctggtgggcagcagcgccggcggcgccggcgagcaggactacgaggtgctgctggtgaccagcagcttcatgagccccagcgagagcagaagcggcagcaaccccaacagagtgagaatgttcggccccgacaagctggtgagagccgccgccgagaagagatgggacagagtgaagatcgtgtgcagccagccctacagcaaggacagccccttcggcctgagcttcgtgagattccacagcccccccgacaaggacgaggccgaggcccccagccagaaggtgaccgtgaccaagctgggccagttcagagtgaaggaggaggacgagagcgccaacagcctgagacccggcgccctgttcttcagcagaatcaacaagaccagccccgtgaccgccagcgaccccgccggccccagctacgccgccgccaccctgcaggccagcagcgccgccagcagcgccagccccgtgagcagagccatcggcagcaccagcaagccccaggagagccccaagggcaagagaaagctggacctgaaccaggaggagaagaagacccccagcaagccccccgcccagctgagccccagcgtgcccaagagacccaagctgcccgcccccaccagaacccccgccaccgcccccgtgcccgccagagcccagggcgccgtgaccggcaagcccagaggcgagggcaccgagcccagaagacccagagccggccccgaggagctgggcaagatcctgcagggcgtggtggtggtgctgagcggcttccagaaccccttcagaagcgagctgagagacaaggccctggagctgggcgccaagtacagacccgactggaccagagacagcacccacctgatctgcgccttcgccaacacccccaagtacagccaggtgctgggcctgggcggcagaatcgtgagaaaggagtgggtgctggactgccacagaatgagaagaagactgcccagccagagatacctgatggccggccccggcagcagcagcgaggaggacgaggccagccacagcggcggcagcggcgacgaggcccccaagctgccccagaagcagccccagaccaagaccaagcccacccaggccgccggccccagcagcccccagaagccccccacccccgaggagaccaaggccgccagccccgtgctgcaggaggacatcgacatcgagggcgtgcagagcgagggccaggacaacggcgccgaggacagcggcgacaccgaggacgagctgagaagagtggccgagcagaaggagcacagactgccccccggccaggaggagaacggcgaggacccctacgccggcagcaccgacgagaacaccgacagcgaggagcaccaggagccccccgacctgcccgtgcccgagctgcccgacttcttccagggcaagcacttcttcctgtacggcgagttccccggcgacgagagaagaaagctgatcagatacgtgaccgccttcaacggcgagctggaggacaacatgagcgacagagtgcagttcgtgatcaccgcccaggagtgggaccccagcttcgaggaggccctgatggacaaccccagcctggccttcgtgagacccagatggatctacagctgcaacgagaagcagaagctgctgccccaccagctgtacggcgtggtgccccaggcctag

SEQ ID NO: 13612 - DNA, 1944 bp, Artificial Sequence
  Description of Artificial Sequence: Synthetic coding sequence
agcaccagcagcttctggcccggcgaggcccacgacgtggacatgcccgagatcagactgagacacgtggtgagctgcagcagccaggacagcacccactgcgccgagaacctgctgaaggccgacacctacagaaagtggagagccgccaaggccggcgagaagaccatcagcgtggtgctgcagctggagaaggaggagcagatccacagcgtggacatcggcaacgacggcagcgccttcgtggaggtgctggtgggcagcagcgccggcggcgccggcgagcaggactacgaggtgctgctggtgaccagcagcttcatgagccccagcgagagcagaagcggcagcaaccccaacagagtgagaatgttcggccccgacaagctggtgagagccgccgccgagaagagatgggacagagtgaagatcgtgtgcagccagccctacagcaaggacagccccttcggcctgagcttcgtgagattccacagcccccccgacaaggacgaggccgaggcccccagccagaaggtgaccgtgaccaagctgggccagttcagagtgaaggaggaggacgagagcgccaacagcctgagacccggcgccctgttcttcagcagaatcaacaagaccagccccgtgaccgccagcgaccccgccggccccagctacgccgccgccaccctgcaggccagcagcgccgccagcagcgccagccccgtgagcagagccatcggcagcaccagcaagccccaggagagccccaagggcaagagaaagctggacctgaaccaggaggagaagaagacccccagcaagccccccgcccagctgagccccagcgtgcccaagagacccaagctgcccgcccccaccagaacccccgccaccgcccccgtgcccgccagagcccagggcgccgtgaccggcaagcccagaggcgagggcaccgagcccagaagacccagagccggccccgaggagctgggcaagatcctgcagggcgtggtggtggtgctgagcggcttccagaaccccttcagaagcgagctgagagacaaggccctggagctgggcgccaagtacagacccgactggaccagagacagcacccacctgatctgcgccttcgccaacacccccaagtacagccaggtgctgggcctgggcggcagaatcgtgagaaaggagtgggtgctggactgccacagaatgagaagaagactgcccagccagagatacctgatggccggccccggcagcagcagcgaggaggacgaggccagccacagcggcggcagcggcgacgaggcccccaagctgccccagaagcagccccagaccaagaccaagcccacccaggccgccggccccagcagcccccagaagccccccacccccgaggagaccaaggccgccagccccgtgctgcaggaggacatcgacatcgagggcgtgcagagcgagggccaggacaacggcgccgaggacagcggcgacaccgaggacgagctgagaagagtggccgagcagaaggagcacagactgccccccggccaggaggagaacggcgaggacccctacgccggcagcaccgacgagaacaccgacagcgaggagcaccaggagccccccgacctgcccgtgcccgagctgcccgacttcttccagggcaagcacttcttcctgtacggcgagttccccggcgacgagagaagaaagctgatcagatacgtgaccgccttcaacggcgagctggaggacaacatgagcgacagagtgcagttcgtgatcaccgcccaggagtgggaccccagcttcgaggaggccctgatggacaaccccagcctggccttcgtgagacccagatggatctacagctgcaacgagaagcagaagctgctgccccaccagctgtacggcgtggtgccccaggcctag

SEQ ID NO: 13613 - DNA, 1203 bp, Artificial Sequence
  Description of Artificial Sequence: Synthetic coding sequence
atgcccgagatcagactgagacacgtggtgagctgcagcagccaggacagcacccactgcgccgagaacctgctgaaggccgacacctacagaaagtggagagccgccaaggccggcgagaagaccatcagcgtggtgctgcagctggagaaggaggagcagatccacagcgtggacatcggcaacgacggcagcgccttcgtggaggtgctggtgggcagcagcgccggcggcgccggcgagcaggactacgaggtgctgctggtgaccagcagcttcatgagccccagcgagagcagaagcggcagcaaccccaacagagtgagaatgttcggccccgacaagctggtgagagccgccgccgagaagagatgggacagagtgaagatcgtgtgcagccagccctacagcaaggacagccccttcggcctgagcttcgtgagattccacagcccccccgacaaggacgaggccgaggcccccagccagaaggtgaccgtgaccaagctgggccagttcagagtgaaggaggaggacgagagcgccaacagcctgagacccggcgccctgttcttcagcagaatcaacaagaccagccccgtgaccgccagcgaccccgccggccccagctacgccgccgccaccctgcaggccagcagcgccgccagcagcgccagccccgtgagcagagccatcggcagcaccagcaagccccaggagagccccaagggcaagagaaagctggacctgaaccaggaggagaagaagacccccagcaagccccccgcccagctgagccccagcgtgcccaagagacccaagctgcccgcccccaccagaacccccgccaccgcccccgtgcccgccagagcccagggcgccgtgaccggcaagcccagaggcgagggcaccgagcccagaagacccagagccggccccgaggagctgggcaagatcctgcagggcgtggtggtggtgctgagcggcttccagaaccccttcagaagcgagctgagagacaaggccctggagctgggcgccaagtacagacccgactggaccagagacagcacccacctgatctgcgccttcgccaacacccccaagctgccccagaaggtgcccccccagcacacccccgaccagaaccaggcccacagcggcagctggacccagctgacccccgaggcccccaacccctag

SEQ ID NO: 13614 - DNA, 1809 bp, Artificial Sequence
  Description of Artificial Sequence: Synthetic coding sequence
atgcccgagatcagactgagacacgtggtgagctgcagcagccaggacagcctggagaaggaggagcagatccacagcgtggacatcggcaacgacggcagcgccttcgtggaggtgctggtgggcagcagcgccggcggcgccggcgagcaggactacgaggtgctgctggtgaccagcagcttcatgagccccagcgagagcagaagcggcagcaaccccaacagagtgagaatgttcggccccgacaagctggtgagagccgccgccgagaagagatgggacagagtgaagatcgtgtgcagccagccctacagcaaggacagccccttcggcctgagcttcgtgagattccacagcccccccgacaaggacgaggccgaggcccccagccagaaggtgaccgtgaccaagctgggccagttcagagtgaaggaggaggacgagagcgccaacagcctgagacccggcgccctgttcttcagcagaatcaacaagaccagccccgtgaccgccagcgaccccgccggccccagctacgccgccgccaccctgcaggccagcagcgccgccagcagcgccagccccgtgagcagagccatcggcagcaccagcaagccccaggagagccccaagggcaagagaaagctggacctgaaccaggaggagaagaagacccccagcaagccccccgcccagctgagccccagcgtgcccaagagacccaagctgcccgcccccaccagaacccccgccaccgcccccgtgcccgccagagcccagggcgccgtgaccggcaagcccagaggcgagggcaccgagcccagaagacccagagccggccccgaggagctgggcaagatcctgcagggcgtggtggtggtgctgagcggcttccagaaccccttcagaagcgagctgagagacaaggccctggagctgggcgccaagtacagacccgactggaccagagacagcacccacctgatctgcgccttcgccaacacccccaagtacagccaggtgctgggcctgggcggcagaatcgtgagaaaggagtgggtgctggactgccacagaatgagaagaagactgcccagccagagatacctgatggccggccccggcagcagcagcgaggaggacgaggccagccacagcggcggcagcggcgacgaggcccccaagctgccccagaagcagccccagaccaagaccaagcccacccaggccgccggccccagcagcccccagaagccccccacccccgaggagaccaaggccgccagccccgtgctgcaggaggacatcgacatcgagggcgtgcagagcgagggccaggacaacggcgccgaggacagcggcgacaccgaggacgagctgagaagagtggccgagcagaaggagcacagactgccccccggccaggaggagaacggcgaggacccctacgccggcagcaccgacgagaacaccgacagcgaggagcaccaggagccccccgacctgcccgtgcccgagctgcccgacttcttccagggcaagcacttcttcctgtacggcgagttccccggcgacgagagaagaaagctgatcagatacgtgaccgccttcaacggcgagctggaggacaacatgagcgacagagtgcagttcgtgatcaccgcccaggagtgggaccccagcttcgaggaggccctgatggacaaccccagcctggccttcgtgagacccagatggatctacagctgcaacgagaagcagaagctgctgccccaccagctgtacggcgtggtgccccaggcctag

SEQ ID NO: 13615 - DNA, 843 bp, Artificial Sequence
  Description of Artificial Sequence: Synthetic coding sequence
atgtgcagcgccttccacagagccgagagcggcaccgagctgctggccagactggagggcagaagcagcctgaaggagatcgagcccaacctgttcgccgacgaggacagccccgtgcacggcgacatcctggagttccacggccccgagggcaccggcaagaccgagatgctgtaccacctgaccgccagatgcatcctgcccaagagcgagggcggcctggaggtggaggtgctgttcatcgacaccgactaccacttcgacatgctgagactggtgaccatcctggagcacagactgagccagagcagcgaggagatcatcaagtactgcctgggcagattcttcctggtgtactgcagcagcagcacccacctgctgctgaccctgtacagcctggagagcatgttctgcagccaccccagcctgtgcctgctgatcctggacagcctgagcgccttctactggatcgacagagtgaacggcggcgagagcgtgaacctgcaggagagcaccctgagaaagtgcagccagtgcctggagaagctggtgaacgactacagactggtgctgttcgccaccacccagaccatcatgcagaaggccagcagcagcagcgaggagcccagccacgccagcagaagactgtgcgacgtggacatcgactacagaccctacctgtgcaaggcctggcagcagctggtgaagcacagaatgttcttcagcaagcaggacgacagccagagcagcaaccagttcagcctggtgagcagatgcctgaagagcaacagcctgaagaagcacttcttcatcatcggcgagagcggcgtggagttctgctag

SEQ ID NO: 13616 - DNA, 1041 bp, Artificial Sequence
  Description of Artificial Sequence: Synthetic coding sequence
atggacctggacctgctggacctgaaccccagaatcatcgccgccatcaagaaggccaagctgaagagcgtgaaggaggtgctgcacttcagcggccccgacctgaagagactgaccaacctgagcagccccgaggtgtggcacctgctgagaaccgccagcctgcacctgagaggcagcagcatcctgaccgccctgcagctgcaccagcagaaggagagattccccacccagcaccagagactgagcctgggctgccccgtgctggacgccctgctgagaggcggcctgcccctggacggcatcaccgagctggccggcagaagcagcgccggcaagacccagctggccctgcagctgtgcctggccgtgcagttccccagacagcacggcggcctggaggccggcgccgtgtacatctgcaccgaggacgccttcccccacaagagactgcagcagctgatggcccagcagcccagactgagaaccgacgtgcccggcgagctgctgcagaagctgagattcggcagccagatcttcatcgagcacgtggccgacgtggacaccctgctggagtgcgtgaacaagaaggtgcccgtgctgctgagcagaggcatggccagactggtggtgatcgacagcgtggccgcccccttcagatgcgagttcgacagccaggccagcgcccccagagccagacacctgcagagcctgggcgccaccctgagagagctgagcagcgccttccagagccccgtgctgtgcatcaaccaggtgaccgaggccatggaggagcagggcgccgcccacggccccctgggcttctgggacgagagagtgagccccgccctgggcatcacctgggccaaccagctgctggtgagactgctggccgacagactgagagaggaggaggccgccctgggctgccccgccagaaccctgagagtgctgagcgccccccacctgccccccagcagctgcagctacaccatcagcgccgagggcgtgagaggcacccccggcacccagagccactag

SEQ ID NO: 13617 - DNA, 1041 bp, Artificial Sequence; identical to SEQ ID NO: 13616
  Description of Artificial Sequence: Synthetic coding sequence

SEQ ID NO: 13618 - DNA, 1041 bp, Artificial Sequence; identical to SEQ ID NO: 13616
  Description of Artificial Sequence: Synthetic coding sequence

SEQ ID NO: 13619 - DNA, 144 bp, Artificial Sequence
  Description of Artificial Sequence: Synthetic coding sequence
atggacctggacctgctggacctgaaccccagaatcatcgccgccatcaagaaggccaagctgaagagcgtgaaggaggtgctgcacttcagcggccccgacctgaagagactgaccaacctgagcagccccgaggtgtggtag

SEQ ID NO: 13620 - DNA, 138 bp, Artificial Sequence
  Description of Artificial Sequence: Synthetic coding sequence
atggacctggacctgctggacctgaaccccagaatcatcgccgccatcaagaaggccaagctgaagagcgtgaaggaggtgctgcacttcagcggccccgacctgaagagactgaccaacctgagcagccccgagtag

SEQ ID NO: 13621 - DNA, 1041 bp, Artificial Sequence; identical to SEQ ID NO: 13616
  Description of Artificial Sequence: Synthetic coding sequence

SEQ ID NO: 13622 - DNA, 1041 bp, Artificial Sequence; identical to SEQ ID NO: 13616
  Description of Artificial Sequence: Synthetic coding sequence

SEQ ID NO: 13623 - DNA, 309 bp, Artificial Sequence
  Description of Artificial Sequence: Synthetic coding sequence
atggacctggacctgctggacctgaaccccagaatcatcgccgccatcaagaaggccaagctgaagagcgtgaaggaggtgctgcacttcagcggccccgacctgaagagactgaccaacctgagcagccccgaggtgtggcacctgctgagaaccgccagcctgcacctgagaggcagcagcatcctgaccgccctgcagctgcaccagcagaaggagagattccccacccagcaccagagactgagcctgggctgccccgtgctggacgccctgctgagaggcggcctgcccctggacggcatctag

SEQ ID NO: 13624 - DNA, 186 bp, Artificial Sequence
  Description of Artificial Sequence: Synthetic coding sequence
atggacctggacctgctggacctgaaccccagaatcatcgccgccatcaagaaggccaagctgaagagcgtgaaggaggtgctgcacttcagcggccccgacctgaagagactgaccaacctgagcagccccgaggtgtggcacctgctgagaaccgccagcctgcacctgagaggcagcagctag

SEQ ID NO: 13625 - DNA, 339 bp, Artificial Sequence
  Description of Artificial Sequence: Synthetic coding sequence
atggacctggacctgctggacctgaaccccagaatcatcgccgccatcaagaaggccaagctgaagagcgtgaaggaggtgctgcacttcagcggccccgacctgaagagactgaccaacctgagcagccccgaggtgtggcacctgctgagaaccgccagcctgcacctgagaggcagcagcatcctgaccgccctgcagctgcaccagcagaaggagagattccccacccagcaccagagactgagcctgggctgccccgtgctggacgccctgctgagaggcggcctgcccctggacggcatcaccgagctggccggcagaagcagcgccggctag

SEQ ID NO: 13626 - DNA, 1005 bp, Artificial Sequence
  Description of Artificial Sequence: Synthetic coding sequence
atggagagaaagatcagcagaatccacctggtgagcgagcccagcatcacccacttcctgcaggtgagctgggagaagaccctggagagcggcttcgtgatcaccctgaccgacggccacagcgcctggaccggcaccgtgagcgagagcgagatcagccaggaggccgacgacatggccatggagaagggcaagtacgtgggcgagctgagaaaggccctgctgagcggcgccggccccgccgacgtgtacaccttcaacttcagcaaggagagctgctacttcttcttcgagaagaacctgaaggacgtgagcttcagactgggcagcttcaacctggagaaggtggagaaccccgccgaggtgatcagagagctgatctgctactgcctggacaccatcgccgagaaccaggccaagaacgagcacctgcagaaggagaacgagagactgctgagagactggaacgacgtgcagggcagattcgagaagtgcgtgagcgccaaggaggccctggagaccgacctgtacaagagattcatcctggtgctgaacgagaagaagaccaagatcagaagcctgcacaacaagctgctgaacgccgcccaggagagagagaaggacatcaagcaggagggcgagaccgccatctgcagcgagatgaccgccgacagagaccccgtgtacgacgagagcaccgacgaggagagcgagaaccagaccgacctgagcggcctggccagcgccgccgtgagcaaggacgacagcatcatcagcagcctggacgtgaccgacatcgcccccagcagaaagagaagacagagaatgcagagaaacctgggcaccgagcccaagatggccccccaggagaaccagctgcaggagaaggagaagcccgacagcagcctgcccgagaccagcaagaaggagcacatcagcgccgagaacatgagcctggagaccctgagaaacagcagccccgaggacctgttcgacgagatctag

SEQ ID NO: 13627 - DNA, 1011 bp, Artificial Sequence
  Description of Artificial Sequence: Synthetic coding sequence
atggagagaaagatcagcagaatccacctggtgagcgagcccagcatcacccacttcctgcaggtgagctgggagaagaccctggagagcggcttcgtgatcaccctgaccgacggccacagcgcctggaccggcaccgtgagcgagagcgagatcagccaggaggccgacgacatggccatggagaagggcaagtacgtgggcgagctgagaaaggccctgctgagcggcgccggccccgccgacgtgtacaccttcaacttcagcaaggagagctgctacttcttcttcgagaagaacctgaaggacgtgagcttcagactgggcagcttcaacctggagaaggtggagaaccccgccgaggtgatcagagagctgatctgctactgcctggacaccatcgccgagaaccaggccaagaacgagcacctgcagaaggagaacgagagactgctgagagactggaacgacgtgcagggcagattcgagaagtgcgtgagcgccaaggaggccctggagaccgacctgtacaagagattcatcctggtgctgaacgagaagaagaccaagatcagaagcctgcacaacaagctgctgaacgccgcccaggagagagagaaggacatcaagcaggagggcgagaccgccatctgcagcgagatgaccgccgacagagaccccgtgtacgacgagagcaccgacgaggagagcgagaaccagaccgacctgagcggcctggccagcgccgccgtgagcaaggacgacagcatcatcagcagcctggacgtgaccgacatcgcccccagcagaaagagaagacagagaatgcagagaaacctgggcaccgagcccaagatggccccccaggagaaccagctgcaggagaaggagaacagcagacccgacagcagcctgcccgagaccagcaagaaggagcacatcagcgccgagaacatgagcctggagaccctgagaaacagcagccccgaggacctgttcgacgagatctag

SEQ ID NO: 13628 - DNA, 1005 bp, Artificial Sequence; identical to SEQ ID NO: 13626
  Description of Artificial Sequence: Synthetic coding sequence

SEQ ID NO: 13629 - DNA, 1011 bp, Artificial Sequence; identical to SEQ ID NO: 13627
  Description of Artificial Sequence: Synthetic coding sequence

SEQ ID NO: 13630 - DNA, 186 bp, Artificial Sequence
  Description of Artificial Sequence: Synthetic coding sequence
atgcagagaaacctgggcaccgagcccaagatggccccccaggagaaccagctgcaggagaaggagaacagcagacccgacagcagcctgcccgagaccagcaagaaggagcacatcagcgccgagaacatgagcctggagaccctgagaaacagcagccccgaggacctgttcgtgagcatctag

SEQ ID NO: 13631 - DNA, 2199 bp, Artificial Sequence
  Description of Artificial Sequence: Synthetic coding sequence
atggtgagaagcggcaacaaggccgccgtggtgctgtgcatggacgtgggcttcaccatgagcaacagcatccccggcatcgagagccccttcgagcaggccaagaaggtgatcaccatgttcgtgcagagacaggtgttcgccgagaacaaggacgagatcgccctggtgctgttcggcaccgacggcaccgacaaccccctgagcggcggcgaccagtaccagaacatcaccgtgcacagacacctgatgctgcccgacttcgacctgctggaggacatcgagagcaagatccagcccggcagccagcaggccgacttcctggacgccctgatcgtgagcatggacgtgatccagcacgagaccatcggcaagaagttcgagaagagacacatcgagatcttcaccgacctgagcagcagattcagcaagagccagctggacatcatcatccacagcctgaagaagtgcgacatcagcctgcagttcttcctgcccttcagcctgggcaaggaggacggcagcggcgacagaggcgacggccccttcagactgggcggccacggccccagcttccccctgaagggcatcaccgagcagcagaaggagggcctggagatcgtgaagatggtgatgatcagcctggagggcgaggacggcctggacgagatctacagcttcagcgagagcctgagaaagctgtgcgtgttcaagaagatcgagagacacagcatccactggccctgcagactgaccatcggcagcaacctgagcatcagaatcgccgcctacaagagcatcctgcaggagagagtgaagaagacctggaccgtggtggacgccaagaccctgaagaaggaggacatccagaaggagaccgtgtactgcctgaacgacgacgacgagaccgaggtgctgaaggaggacatcatccagggcttcagatacggcagcgacatcgtgcccttcagcaaggtggacgaggagcagatgaagtacaagagcgagggcaagtgcttcagcgtgctgggcttctgcaagagcagccaggtgcagagaagattcttcatgggcaaccaggtgctgaaggtgttcgccgccagagacgacgaggccgccgccgtggccctgagcagcctgatccacgccctggacgacctggacatggtggccatcgtgagatacgcctacgacaagagagccaacccccaggtgggcgtggccttcccccacatcaagcacaactacgagtgcctggtgtacgtgcagctgcccttcatggaggacctgagacagtacatgttcagcagcctgaagaacagcaagaagtacgcccccaccgaggcccagctgaacgccgtggacgccctgatcgacagcatgagcctggccaagaaggacgagaagaccgacaccctggaggacctgttccccaccaccaagatccccaaccccagattccagagactgttccagtgcctgctgcacagagccctgcaccccagagagcccctgccccccatccagcagcacatctggaacatgctgaacccccccgccgaggtgaccaccaagagccagatccccctgagcaagatcaagaccctgttccccctgatcgaggccaagaagaaggaccaggtgaccgcccaggagatcttccaggacaaccacgaggacggccccaccgccaagaagctgaagaccgagcagggcggcgcccacttcagcgtgagcagcctggccgagggcagcgtgaccagcgtgggcagcgtgaaccccgccgagaacttcagagtgctggtgaagcagaagaaggccagcttcgaggaggccagcaaccagctgatcaaccacatcgagcagttcctggacaccaacgagaccccctacttcatgaagagcatcgactgcatcagagccttcagagaggaggccatcaagttcagcgaggagcagagattcaacaacttcctgaaggccctgcaggagaaggtggagatcaagcagctgaaccacttctgggagatcgtggtgcaggacggcatcaccctgatcaccaaggaggaggccagcggcagcagcgtgaccgccgaggaggccaagaagttcctggcccccaaggacaagcccagcggcgacaccgccgccgtgttcgaggagggcggcgacgtggacgacctgctggacatgatctag

SEQ ID NO: 13632 - DNA, 2199 bp, Artificial Sequence; identical to SEQ ID NO: 13631
  Description of Artificial Sequence: Synthetic coding sequence

SEQ ID NO: 13633 - DNA, 1830 bp, Artificial Sequence
  Description of Artificial Sequence: Synthetic coding sequence
atgagcggctgggagagctactacaagaccgagggcgacgaggaggccgaggaggagcaggaggagaacctggaggccagcggcgactacaagtacagcggcagagacagcctgatcttcctggtggacgccagcaaggccatgttcgagagccagagcgaggacgagctgacccccttcgacatgagcatccagtgcatccagagcgtgtacatcagcaagatcatcagcagcgacagagacctgctggccgtggtgttctacggcaccgagaaggacaagaacagcgtgaacttcaagaacatctacgtgctgcaggagctggacaaccccggcgccaagagaatcctggagctggaccagttcaagggccagcagggccagaagagattccaggacatgatgggccacggcagcgactacagcctgagcgaggtgctgtgggtgtgcgccaacctgttcagcgacgtgcagttcaagatgagccacaagagaatcatgctgttcaccaacgaggacaacccccacggcaacgacagcgccaaggccagcagagccagaaccaaggccggcgacctgagagacaccggcatcttcctggacctgatgcacctgaagaagcccggcggcttcgacatcagcctgttctacagagacatcatcagcatcgccgaggacgaggacctgagagtgcacttcgaggagagcagcaagctggaggacctgctgagaaaggtgagagccaaggagaccagaaagagagccctgagcagactgaagctgaagctgaacaaggacatcgtgatcagcgtgggcatctacaacctggtgcagaaggccctgaagcccccccccatcaagctgtacagagagaccaacgagcccgtgaagaccaagaccagaaccttcaacaccagcaccggcggcctgctgctgcccagcgacaccaagagaagccagatctacggcagcagacagatcatcctggagaaggaggagaccgaggagctgaagagattcgacgaccccggcctgatgctgatgggcttcaagcccctggtgctgctgaagaagcaccactacctgagacccagcctgttcgtgtaccccgaggagagcctggtgatcggcagcagcaccctgttcagcgccctgctgatcaagtgcctggagaaggaggtggccgccctgtgcagatacacccccagaagaaacatccccccctacttcgtggccctggtgccccaggaggaggagctggacgaccagaagatccaggtgaccccccccggcttccagctggtgttcctgcccttcgccgacgacaagagaaagatgcccttcaccgagaagatcatggccacccccgagcaggtgggcaagatgaaggccatcgtggagaagctgagattcacctacagaagcgacagcttcgagaaccccgtgctgcagcagcacttcagaaacctggaggccctggccctggacctgatggagcccgagcaggccgtggacctgaccctgcccaaggtggaggccatgaacaagagactgggcagcctggtggacgagttcaaggagctggtgtacccccccgactacaaccccgagggcaaggtgaccaagagaaagcacgacaacgagggcagcggcagcaagagacccaaggtggagtacagcgaggaggagctgaagacccacatcagcaagggcaccctgggcaagttcaccgtgcccatgctgaaggaggcctgcagagcctacggcctgaagagcggcctgaagaagcaggagctgctggaggccctgaccaagcacttccaggactag

SEQ ID NO: 13634 - DNA, 1830 bp, Artificial Sequence; identical to SEQ ID NO: 13633
  Description of Artificial Sequence: Synthetic coding sequence

SEQ ID NO: 13635 - DNA, 1674 bp, Artificial Sequence
  Description of Artificial Sequence: Synthetic coding sequence
atgagcggctgggagagctactacaagaccgagggcgacgaggaggccgaggaggagcaggaggagaacctggaggccagcggcgactacaagtacagcggcagagacagcctgatcttcctggtggacgccagcaaggccatgttcgagagccagagcgaggacgagctgacccccttcgacatgagcatccagtgcatccagagcgtgtacatcagcaagatcatcagcagcgacagagacctgctggccgtggtgttctacggcaccgagaaggacaagaacagcgtgaacttcaagaacatctacgtgctgcaggagctggacaaccccggcgccaagagaatcctggagctggaccagttcaagggccagcagggccagaagagattccaggacatgatgggccacggcagcgactacagcctgagcgaggtgctgtgggtgtgcgccaacctgttcagcgacgtgcagttcaagatgagccacaagagaatcatgctgttcaccaacgaggacaacccccacggcaacgacagcgccaaggccagcagagccagaaccaaggccggcgacctgagagacaccggcatcttcctggacctgatgcacctgaagaagcccggcggcttcgacatcagcctgttctacagagacatcatcagcatcgccgaggacgaggacctgagagtgcacttcgaggagagcagcaagctggaggacctgctgagaaaggtgagagccaaggagaccagaaagagagccctgagcagactgaagctgaagctgaacaaggacatcgtgatcagcgtgggcatctacaacctggtgcagaaggccctgaagcccccccccatcaagctgtacagagagaccaacgagcccgtgaagaccaagaccagaaccttcaacaccagcaccggcggcctgctgctgcccagcgacaccaagagaagccagatctacggcagcagacagatcatcctggagaaggaggagaccgaggagctgaagagattcgacgaccccggcctgatgctgatgggcttcaagcccctggtgctgctgaagaagcaccactacctgagacccagcctgttcgtgtaccccgaggagagcctggtgatcggcagcagcaccctgttcagcgccctgctgatcaagtgcctggagaaggaggtggccgccctgtgcagatacacccccagaagaaacatccccccctacttcgtggccctggtgccccaggaggaggagctggacgaccagaagatccaggtgaccccccccggcttccagctggtgttcctgcccttcgccgacgacaagagaaagatgcccttcaccgagaagatcatggccacccccgagcaggtgggcaagatgaaggccatcgtggagaagctgagattcacctacagaagcgacagcttcgagaaccccgtgctgcagcagcacttcagaaacctggaggccctggccctggacctgatggagcccgagcaggccgtggacctgaccctgcccaaggtggaggccatgaacaagagactgggcagcctggtggacgagttcaaggagctggtgtacccccccgactacaaccccgagggcaaggtgaccaagagaaagcacgccaagggccccagatggagcatccagaagagaagctag

SEQ ID NO: 13636 - DNA, 1707 bp, Artificial Sequence
  Description of Artificial Sequence: Synthetic coding sequence
atgagcggctgggagagctactacaagaccgagggcgacgaggaggccgaggaggagcaggaggagaacctggaggccagcggcgactacaagtacagcggcagagacagcctgatcttcctggtggacgccagcaaggccatgttcgagagccagagcgaggacgagctgacccccttcgacatgagcatccaggagctggacaaccccggcgccaagagaatcctggagctggaccagttcaagggccagcagggccagaagagattccaggacatgatgggccacggcagcgactacagcctgagcgaggtgctgtgggtgtgcgccaacctgttcagcgacgtgcagttcaagatgagccacaagagaatcatgctgttcaccaacgaggacaacccccacggcaacgacagcgccaaggccagcagagccagaaccaaggccggcgacctgagagacaccggcatcttcctggacctgatgcacctgaagaagcccggcggcttcgacatcagcctgttctacagagacatcatcagcatcgccgaggacgaggacctgagagtgcacttcgaggagagcagcaagctggaggacctgctgagaaaggtgagagccaaggagaccagaaagagagccctgagcagactgaagctgaagctgaacaaggacatcgtgatcagcgtgggcatctacaacctggtgcagaaggccctgaagcccccccccatcaagctgtacagagagaccaacgagcccgtgaagaccaagaccagaaccttcaacaccagcaccggcggcctgctgctgcccagcgacaccaagagaagccagatctacggcagcagacagatcatcctggagaaggaggagaccgaggagctgaagagattcgacgaccccggcctgatgctgatgggcttcaagcccctggtgctgctgaagaagcaccactacctgagacccagcctgttcgtgtaccccgaggagagcctggtgatcggcagcagcaccctgttcagcgccctgctgatcaagtgcctggagaaggaggtggccgccctgtgcagatacacccccagaagaaacatccccccctacttcgtggccctggtgccccaggaggaggagctggacgaccagaagatccaggtgaccccccccggcttccagctggtgttcctgcccttcgccgacgacaagagaaagatgcccttcaccgagaagatcatggccacccccgagcaggtgggcaagatgaaggccatcgtggagaagctgagattcacctacagaagcgacagcttcgagaaccccgtgctgcagcagcacttcagaaacctggaggccctggccctggacctgatggagcccgagcaggccgtggacctgaccctgcccaaggtggaggccatgaacaagagactgggcagcctggtggacgagttcaaggagctggtgtacccccccgactacaaccccgagggcaaggtgaccaagagaaagcacgacaacgagggcagcggcagcaagagacccaaggtggagtacagcgaggaggagctgaagacccacatcagcaagggcaccctgggcaagttcaccgtgcccatgctgaaggaggcctgcagagcctacggcctgaagagcggcctgaagaagcaggagctgctggaggccctgaccaagcacttccaggactag

SEQ ID NO: 13637 - DNA, 1680 bp, Artificial Sequence
  Description of Artificial Sequence: Synthetic coding sequence
atgaagaagcagagaaagaacaagaagagaaccctgaagcaggtgtgcatccagagcgtgtacatcagcaagatcatcagcagcgacagagacctgctggccgtggtgttctacggcaccgagaaggacaagaacagcgtgaacttcaagaacatctacgtgctgcaggagctggacaaccccggcgccaagagaatcctggagctggaccagttcaagggccagcagggccagaagagattccaggacatgatgggccacggcagcgactacagcctgagcgaggtgctgtgggtgtgcgccaacctgttcagcgacgtgcagttcaagatgagccacaagagaatcatgctgttcaccaacgaggacaacccccacggcaacgacagcgccaaggccagcagagccagaaccaaggccggcgacctgagagacaccggcatcttcctggacctgatgcacctgaagaagcccggcggcttcgacatcagcctgttctacagagacatcatcagcatcgccgaggacgaggacctgagagtgcacttcgaggagagcagcaagctggaggacctgctgagaaaggtgagagccaaggagaccagaaagagagccctgagcagactgaagctgaagctgaacaaggacatcgtgatcagcgtgggcatctacaacctggtgcagaaggccctgaagcccccccccatcaagctgtacagagagaccaacgagcccgtgaagaccaagaccagaaccttcaacaccagcaccggcggcctgctgctgcccagcgacaccaagagaagccagatctacggcagcagacagatcatcctggagaaggaggagaccgaggagctgaagagattcgacgaccccggcctgatgctgatgggcttcaagcccctggtgctgctgaagaagcaccactacctgagacccagcctgttcgtgtaccccgaggagagcctggtgatcggcagcagcaccctgttcagcgccctgctgatcaagtgcctggagaaggaggtggccgccctgtgcagatacacccccagaagaaacatccccccctacttcgtggccctggtgccccaggaggaggagctggacgaccagaagatccaggtgaccccccccggcttccagctggtgttcctgcccttcgccgacgacaagagaaagatgcccttcaccgagaagatcatggccacccccgagcaggtgggcaagatgaaggccatcgtggagaagctgagattcacctacagaagcgacagcttcgagaaccccgtgctgcagcagcacttcagaaacctggaggccctggccctggacctgatggagcccgagcaggccgtggacctgaccctgcccaaggtggaggccatgaacaagagactgggcagcctggtggacgagttcaaggagctggtgtacccccccgactacaaccccgagggcaaggtgaccaagagaaagcacgacaacgagggcagcggcagcaagagacccaaggtggagtacagcgaggaggagctgaagacccacatcagcaagggcaccctgggcaagttcaccgtgcccatgctgaaggaggcctgcagagcctacggcctgaagagcggcctgaagaagcaggagctgctggaggccctgaccaagcacttccaggactag

SEQ ID NO: 13638 - DNA, 1830 bp, Artificial Sequence; identical to SEQ ID NO: 13633
  Description of Artificial Sequence: Synthetic coding sequence

SEQ ID NO: 13639 - DNA, 1431 bp, Artificial Sequence
  Description of Artificial Sequence: Synthetic coding sequence
atgatgggccacggcagcgactacagcctgagcgaggtgctgtgggtgtgcgccaacctgttcagcgacgtgcagttcaagatgagccacaagagaatcatgctgttcaccaacgaggacaacccccacggcaacgacagcgccaaggccagcagagccagaaccaaggccggcgacctgagagacaccggcatcttcctggacctgatgcacctgaagaagcccggcggcttcgacatcagcctgttctacagagacatcatcagcatcgccgaggacgaggacctgagagtgcacttcgaggagagcagcaagctggaggacctgctgagaaaggtgagagccaaggagaccagaaagagagccctgagcagactgaagctgaagctgaacaaggacatcgtgatcagcgtgggcatctacaacctggtgcagaaggccctgaagcccccccccatcaagctgtacagagagaccaacgagcccgtgaagaccaagaccagaaccttcaacaccagcaccggcggcctgctgctgcccagcgacaccaagagaagccagatctacggcagcagacagatcatcctggagaaggaggagaccgaggagctgaagagattcgacgaccccggcctgatgctgatgggcttcaagcccctggtgctgctgaagaagcaccactacctgagacccagcctgttcgtgtaccccgaggagagcctggtgatcggcagcagcaccctgttcagcgccctgctgatcaagtgcctggagaaggaggtggccgccctgtgcagatacacccccagaagaaacatccccccctacttcgtggccctggtgccccaggaggaggagctggacgaccagaagatccaggtgaccccccccggcttccagctggtgttcctgcccttcgccgacgacaagagaaagatgcccttcaccgagaagatcatggccacccccgagcaggtgggcaagatgaaggccatcgtggagaagctgagattcacctacagaagcgacagcttcgagaaccccgtgctgcagcagcacttcagaaacctggaggccctggccctggacctgatggagcccgagcaggccgtggacctgaccctgcccaaggtggaggccatgaacaagagactgggcagcctggtggacgagttcaaggagctggtgtacccccccgactacaaccccgagggcaaggtgaccaagagaaagcacgacaacgagggcagcggcagcaagagacccaaggtggagtacagcgaggaggagctgaagacccacatcagcaagggcaccctgggcaagttcaccgtgcccatgctgaaggaggcctgcagagcctacggcctgaagagcggcctgaagaagcaggagctgctggaggccctgaccaagcacttccaggactag

SEQ ID NO: 13640 - DNA, 741 bp, Artificial Sequence
  Description of Artificial Sequence: Synthetic coding sequence
atggccggcgcccccgacgagagaagaagaggccccgccgccggcgagcagctgcagcagcagcacgtgagctgccaggtgttccccgagagactggcccagggcaacccccagcagggcttcttcagcagcttcttcaccagcaaccagaagtgccagctgagactgctgaagaccctggagaccaacccctacgtgaagctgctgctggacgccatgaagcacagcggctgcgccgtgaacaaggacagacacttcagctgcgaggactgcaacggcaacgtgagcggcggcttcgacgccagcaccagccagatcgtgctgtgccagaacaacatccacaaccaggcccacatgaacagagtggtgacccacgagctgatccacgccttcgaccactgcagagcccacgtggactggttcaccaacatcagacacctggcctgcagcgaggtgagagccgccaacctgagcggcgactgcagcctggtgaacgagatcttcagactgcacttcggcctgaagcagcaccaccagacctgcgtgagagacagagccaccctgagcatcctggccgtgagaaacatcagcaaggaggtggccaagaaggccgtggacgaggtgttcgagagctgcttcaacgaccacgagcccttcggcagaatcccccacaacaagacctacgccagatacgcccacagagacttcgagaacagagacagatactacagcaacatctag

SEQ ID NO: 13641 - DNA, 1515 bp, Artificial Sequence
  Description of Artificial Sequence: Synthetic coding sequence
atggaccccggccagcagccccccccccagcccgccccccagggccagggccagccccccagccagcccccccagggccagggcccccccagcggccccggccagcccgcccccgccgccacccaggccgccccccaggccccccccgccggccaccagatcgtgcacgtgagaggcgacagcgagaccgacctggaggccctgttcaacgccgtgatgaaccccaagaccgccaacgtgccccagaccgtgcccatgagactgagaaagctgcccgacagcttcttcaagccccccgagcccaagagccacagcagacaggccagcaccgacgccggcaccgccggcgccctgaccccccagcacgtgagagcccacagcagccccgccagcctgcagctgggcgccgtgagccccggcaccctgacccccaccggcgtggtgagcggccccgccgccacccccaccgcccagcacctgagacagagcagcttcgagatccccgacgacgtgcccctgcccgccggctgggagatggccaagaccagcagcggccagagatacttcctgaaccacatcgaccagaccaccacctggcaggaccccagaaaggccatgctgagccagatgaacgtgaccgcccccaccagcccccccgtgcagcagaacatgatgaacagcgccagcggccccctgcccgacggctgggagcaggccatgacccaggacggcgagatctactacatcaaccacaagaacaagaccaccagctggctggaccccagactggaccccagattcgccatgaaccagagaatcagccagagcgcccccgtgaagcagcccccccccctggccccccagagcccccagggcggcgtgatgggcggcagcaacagcaaccagcagcagcagatgagactgcagcagctgcagatggagaaggagagactgagactgaagcagcaggagctgctgagacaggccatgagaaacatcaaccccagcaccgccaacagccccaagtgccaggagctggccctgagaagccagctgcccaccctggagcaggacggcggcacccagaaccccgtgagcagccccggcatgagccaggagctgagaaccatgaccaccaacagcagcgaccccttcctgaacagcggcacctaccacagcagagacgagagcaccgacagcggcctgagcatgagcagctacagcgtgcccagaacccccgacgacttcctgaacagcgtggacgagatggacaccggcgacaccatcaaccagagcaccctgcccagccagcagaacagattccccgactacctggaggccatccccggcaccaacgtggacctgggcaccctggagggcgacggcatgaacatcgagggcgaggagctgatgcccagcctgcaggaggccctgagcagcgacatcctgaacgacatggagagcgtgctggccgccaccaagctggacaaggagagcttcctgacctggctgtag

SEQ ID NO: 13642 - DNA, 1365 bp, Artificial Sequence
  Description of Artificial Sequence: Synthetic coding sequence
atggaccccggccagcagccccccccccagcccgccccccagggccagggccagccccccagccagcccccccagggccagggcccccccagcggccccggccagcccgcccccgccgccacccaggccgccccccaggccccccccgccggccaccagatcgtgcacgtgagaggcgacagcgagaccgacctggaggccctgttcaacgccgtgatgaaccccaagaccgccaacgtgccccagaccgtgcccatgagactgagaaagctgcccgacagcttcttcaagccccccgagcccaagagccacagcagacaggccagcaccgacgccggcaccgccggcgccctgaccccccagcacgtgagagcccacagcagccccgccagcctgcagctgggcgccgtgagccccggcaccctgacccccaccggcgtggtgagcggccccgccgccacccccaccgcccagcacctgagacagagcagcttcgagatccccgacgacgtgcccctgcccgccggctgggagatggccaagaccagcagcggccagagatacttcctgaaccacatcgaccagaccaccacctggcaggaccccagaaaggccatgctgagccagatgaacgtgaccgcccccaccagcccccccgtgcagcagaacatgatgaacagcgccagcgccatgaaccagagaatcagccagagcgcccccgtgaagcagcccccccccctggccccccagagcccccagggcggcgtgatgggcggcagcaacagcaaccagcagcagcagatgagactgcagcagctgcagatggagaaggagagactgagactgaagcagcaggagctgctgagacaggtgagaccccaggagctggccctgagaagccagctgcccaccctggagcaggacggcggcacccagaaccccgtgagcagccccggcatgagccaggagctgagaaccatgaccaccaacagcagcgaccccttcctgaacagcggcacctaccacagcagagacgagagcaccgacagcggcctgagcatgagcagctacagcgtgcccagaacccccgacgacttcctgaacagcgtggacgagatggacaccggcgacaccatcaaccagagcaccctgcccagccagcagaacagattccccgactacctggaggccatccccggcaccaacgtggacctgggcaccctggagggcgacggcatgaacatcgagggcgaggagctgatgcccagcctgcaggaggccctgagcagcgacatcctgaacgacatggagagcgtgctggccgccaccaagctggacaaggagagcttcctgacctggctgtag

SEQ ID NO: 13643 - DNA, 1266 bp, Artificial Sequence
  Description of Artificial Sequence: Synthetic coding sequence
atgagactgagaaagctgcccgacagcttcttcaagccccccgagcccaagagccacagcagacaggccagcaccgacgccggcaccgccggcgccctgaccccccagcacgtgagagcccacagcagccccgccagcctgcagctgggcgccgtgagccccggcaccctgacccccaccggcgtggtgagcggccccgccgccacccccaccgcccagcacctgagacagagcagcttcgagatccccgacgacgtgcccctgcccgccggctgggagatggccaagaccagcagcggccagagatacttcctgaaccacatcgaccagaccaccacctggcaggaccccagaaaggccatgctgagccagatgaacgtgaccgcccccaccagcccccccgtgcagcagaacatgatgaacagcgccagcggccccctgcccgacggctgggagcaggccatgacccaggacggcgagatctactacatcaaccacaagaacaagaccaccagctggctggaccccagactggaccccagattcggcaaggccatgaaccagagaatcagccagagcgcccccgtgaagcagcccccccccctggccccccagagcccccagggcggcgtgatgggcggcagcaacagcaaccagcagcagcagatgagactgcagcagctgcagatggagaaggagagactgagactgaagcagcaggagctgctgagacaggccatgagaaacatcaaccccagcaccgccaacagccccaagtgccaggagctggccctgagaagccagctgcccaccctggagcaggacggcggcacccagaaccccgtgagcagccccggcatgagccaggagctgagaaccatgaccaccaacagcagcgaccccttcctgaacagcggcacctaccacagcagagacgagagcaccgacagcggcctgagcatgagcagctacagcgtgcccagaacccccgacgacttcctgaacagcgtggacgagatggacaccggcgacaccatcaaccagagcaccctgcccagccagcagaacagattccccgactacctggaggccatccccggcaccaacgtggacctgggcaccctggagggcgacggcatgaacatcgagggcgaggagctgatgcccagcctgcaggaggccctgagcagcgacatcctgaacgacatggagagcgtgctggccgccaccaagctggacaaggagagcttcctgacctggctgtag

SEQ ID NO: 13644 - DNA, 981 bp, Artificial Sequence
  Description of Artificial Sequence: Synthetic coding sequence
atggccaagaccagcagcggccagagatacttcctgaaccacatcgaccagaccaccacctggcaggaccccagaaaggccatgctgagccagatgaacgtgaccgcccccaccagcccccccgtgcagcagaacatgatgaacagcgccagcggccccctgcccgacggctgggagcaggccatgacccaggacggcgagatctactacatcaaccacaagaacaagaccaccagctggctggaccccagactggaccccagattcgccatgaaccagagaatcagccagagcgcccccgtgaagcagcccccccccctggccccccagagcccccagggcggcgtgatgggcggcagcaacagcaaccagcagcagcagatgagactgcagcagctgcagatggagaaggagagactgagactgaagcagcaggagctgctgagacaggccatgagaaacatcaaccccagcaccgccaacagccccaagtgccaggagctggccctgagaagccagctgcccaccctggagcaggacggcggcacccagaaccccgtgagcagccccggcatgagccaggagctgagaaccatgaccaccaacagcagcgaccccttcctgaacagcggcacctaccacagcagagacgagagcaccgacagcggcctgagcatgagcagctacagcgtgcccagaacccccgacgacttcctgaacagcgtggacgagatggacaccggcgacaccatcaaccagagcaccctgcccagccagcagaacagattccccgactacctggaggccatccccggcaccaacgtggacctgggcaccctggagggcgacggcatgaacatcgagggcgaggagctgatgcccagcctgcaggaggccctgagcagcgacatcctgaacgacatggagagcgtgctggccgccaccaagctggacaaggagagcttcctgacctggctgtag

SEQ ID NO: 13645 - DNA, 1467 bp, Artificial Sequence
  Description of Artificial Sequence: Synthetic coding sequence
atggaccccggccagcagccccccccccagcccgccccccagggccagggccagccccccagccagcccccccagggccagggcccccccagcggccccggccagcccgcccccgccgccacccaggccgccccccaggccccccccgccggccaccagatcgtgcacgtgagaggcgacagcgagaccgacctggaggccctgttcaacgccgtgatgaaccccaagaccgccaacgtgccccagaccgtgcccatgagactgagaaagctgcccgacagcttcttcaagccccccgagcccaagagccacagcagacaggccagcaccgacgccggcaccgccggcgccctgaccccccagcacgtgagagcccacagcagccccgccagcctgcagctgggcgccgtgagccccggcaccctgacccccaccggcgtggtgagcggccccgccgccacccccaccgcccagcacctgagacagagcagcttcgagatccccgacgacgtgcccctgcccgccggctgggagatggccaagaccagcagcggccagagatacttcctgaaccacatcgaccagaccaccacctggcaggaccccagaaaggccatgctgagccagatgaacgtgaccgcccccaccagcccccccgtgcagcagaacatgatgaacagcgccagcggccccctgcccgacggctgggagcaggccatgacccaggacggcgagatctactacatcaaccacaagaacaagaccaccagctggctggaccccagactggaccccagattcgccatgaaccagagaatcagccagagcgcccccgtgaagcagcccccccccctggccccccagagcccccagggcggcgtgatgggcggcagcaacagcaaccagcagcagcagatgagactgcagcagctgcagatggagaaggagagactgagactgaagcagcaggagctgctgagacaggagctggccctgagaagccagctgcccaccctggagcaggacggcggcacccagaaccccgtgagcagccccggcatgagccaggagctgagaaccatgaccaccaacagcagcgaccccttcctgaacagcggcacctaccacagcagagacgagagcaccgacagcggcctgagcatgagcagctacagcgtgcccagaacccccgacgacttcctgaacagcgtggacgagatggacaccggcgacaccatcaaccagagcaccctgcccagccagcagaacagattccccgactacctggaggccatccccggcaccaacgtggacctgggcaccctggagggcgacggcatgaacatcgagggcgaggagctgatgcccagcctgcaggaggccctgagcagcgacatcctgaacgacatggagagcgtgctggccgccaccaagctggacaaggagagcttcctgacctggctgtag

SEQ ID NO: 13646 - DNA, 1479 bp, Artificial Sequence
  Description of Artificial Sequence: Synthetic coding sequence
atggaccccggccagcagccccccccccagcccgccccccagggccagggccagccccccagccagcccccccagggccagggcccccccagcggccccggccagcccgcccccgccgccacccaggccgccccccaggccccccccgccggccaccagatcgtgcacgtgagaggcgacagcgagaccgacctggaggccctgttcaacgccgtgatgaaccccaagaccgccaacgtgccccagaccgtgcccatgagactgagaaagctgcccgacagcttcttcaagccccccgagcccaagagccacagcagacaggccagcaccgacgccggcaccgccggcgccctgaccccccagcacgtgagagcccacagcagccccgccagcctgcagctgggcgccgtgagccccggcaccctgacccccaccggcgtggtgagcggccccgccgccacccccaccgcccagcacctgagacagagcagcttcgagatccccgacgacgtgcccctgcccgccggctgggagatggccaagaccagcagcggccagagatacttcctgaaccacatcgaccagaccaccacctggcaggaccccagaaaggccatgctgagccagatgaacgtgaccgcccccaccagcccccccgtgcagcagaacatgatgaacagcgccagcggccccctgcccgacggctgggagcaggccatgacccaggacggcgagatctactacatcaaccacaagaacaagaccaccagctggctggaccccagactggaccccagattcgccatgaaccagagaatcagccagagcgcccccgtgaagcagcccccccccctggccccccagagcccccagggcggcgtgatgggcggcagcaacagcaaccagcagcagcagatgagactgcagcagctgcagatggagaaggagagactgagactgaagcagcaggagctgctgagacaggtgagaccccaggagctggccctgagaagccagctgcccaccctggagcaggacggcggcacccagaaccccgtgagcagccccggcatgagccaggagctgagaaccatgaccaccaacagcagcgaccccttcctgaacagcggcacctaccacagcagagacgagagcaccgacagcggcctgagcatgagcagctacagcgtgcccagaacccccgacgacttcctgaacagcgtggacgagatggacaccggcgacaccatcaaccagagcaccctgcccagccagcagaacagattccccgactacctggaggccatccccggcaccaacgtggacctgggcaccctggagggcgacggcatgaacatcgagggcgaggagctgatgcccagcctgcaggaggccctgagcagcgacatcctgaacgacatggagagcgtgctggccgccaccaagctggacaaggagagcttcctgacctggctgtag

SEQ ID NO: 13647 - DNA, 1353 bp, Artificial Sequence
  Description of Artificial Sequence: Synthetic coding sequence
atggaccccggccagcagccccccccccagcccgccccccagggccagggccagccccccagccagcccccccagggccagggcccccccagcggccccggccagcccgcccccgccgccacccaggccgccccccaggccccccccgccggccaccagatcgtgcacgtgagaggcgacagcgagaccgacctggaggccctgttcaacgccgtgatgaaccccaagaccgccaacgtgccccagaccgtgcccatgagactgagaaagctgcccgacagcttcttcaagccccccgagcccaagagccacagcagacaggccagcaccgacgccggcaccgccggcgccctgaccccccagcacgtgagagcccacagcagccccgccagcctgcagctgggcgccgtgagccccggcaccctgacccccaccggcgtggtgagcggccccgccgccacccccaccgcccagcacctgagacagagcagcttcgagatccccgacgacgtgcccctgcccgccggctgggagatggccaagaccagcagcggccagagatacttcctgaaccacatcgaccagaccaccacctggcaggaccccagaaaggccatgctgagccagatgaacgtgaccgcccccaccagcccccccgtgcagcagaacatgatgaacagcgccagcgccatgaaccagagaatcagccagagcgcccccgtgaagcagcccccccccctggccccccagagcccccagggcggcgtgatgggcggcagcaacagcaaccagcagcagcagatgagactgcagcagctgcagatggagaaggagagactgagactgaagcagcaggagctgctgagacaggagctggccctgagaagccagctgcccaccctggagcaggacggcggcacccagaaccccgtgagcagccccggcatgagccaggagctgagaaccatgaccaccaacagcagcgaccccttcctgaacagcggcacctaccacagcagagacgagagcaccgacagcggcctgagcatgagcagctacagcgtgcccagaacccccgacgacttcctgaacagcgtggacgagatggacaccggcgacaccatcaaccagagcaccctgcccagccagcagaacagattccccgactacctggaggccatccccggcaccaacgtggacctgggcaccctggagggcgacggcatgaacatcgagggcgaggagctgatgcccagcctgcaggaggccctgagcagcgacatcctgaacgacatggagagcgtgctggccgccaccaagctggacaaggagagcttcctgacctggctgtag

SEQ ID NO: 13648 - DNA, 1860 bp, Artificial Sequence
  Description of Artificial Sequence: Synthetic coding sequence
atggccaacgacatcgacgagctgatcggcatccccttccccaaccacagcagcgaggtgctgtgcagcctgaacgagcagagacacgacggcctgctgtgcgacgtgctgctggtggtgcaggagcaggagtacagaacccacagaagcgtgctggccgcctgcagcaagtacttcaagaagctgttcaccgccggcaccctggccagccagccctacgtgtacgagatcgacttcgtgcagcccgaggccctggccgccatcctggagttcgcctacaccagcaccctgaccatcaccgccggcaacgtgaagcacatcctgaacgccgccagaatgctggagatccagtgcatcgtgaacgtgtgcctggagatcatggagcccggcggcgacggcggcgaggaggacgacaaggaggacgacgacgacgacgaggacgacgacgacgaggaggacgaggaggaggaggaggaggaggaggaggacgacgacgacgacaccgaggacttcgccgaccaggagaacctgcccgacccccaggacatcagctgccaccagagccccagcaagaccgaccacctgaccgagaaggcctacagcgacacccccagagacttccccgacagcttccaggccggcagccccggccacctgggcgtgatcagagacttcagcatcgagagcctgctgagagagaacctgtaccccaaggccaacatccccgacagaagacccagcctgagccccttcgcccccgacttcttcccccacctgtggcccggcgacttcggcgccttcgcccagctgcccgagcagcccatggacagcggccccctggacctggtgatcaagaacagaaagatcaaggaggaggagaaggaggagctgcccccccccccccccccccccttccccaacgacttcttcaaggacatgttccccgacctgcccggcggccccctgggccccatcaaggccgagaacgactacggcgcctacctgaacttcctgagcgccacccacctgggcggcctgttccccccctggcccctggtggaggagagaaagctgaagcccaaggccagccagcagtgccccatctgccacaaggtgatcatgggcgccggcaagctgcccagacacatgagaacccacaccggcgagaagccctacatgtgcaccatctgcgaggtgagattcaccagacaggacaagctgaagatccacatgagaaagcacaccggcgagagaccctacctgtgcatccactgcaacgccaagttcgtgcacaactacgacctgaagaaccacatgagaatccacaccggcgtgagaccctaccagtgcgagttctgctacaagagcttcaccagaagcgaccacctgcacagacacatcaagagacagagctgcagaatggccagacccagaagaggcagaaagcccgccgcctggagagccgccagcctgctgttcggccccggcggccccgcccccgacaaggccgccttcgtgatgccccccgccctgggcgaggtgggcggccacctgggcggcgccgccgtgtgcctgcccggccccagccccgccaagcacttcctggccgcccccaagggcgccctgagcctgcaggagctggagagacagttcgaggagacccagatgaagctgttcggcagagcccagctggaggccgagagaaacgccggcggcctgctggccttcgccctggccgagaacgtggccgccgccagaccctacttccccctgcccgacccctgggccgccggcctggccggcctgcccggcctggccggcctgaaccacgtggccagcatgagcgaggccaacaactag

SEQ ID NO: 13649 - DNA, 1860 bp, Artificial Sequence; identical to SEQ ID NO: 13648
  Description of Artificial Sequence: Synthetic coding sequence

SEQ ID NO: 13650 - DNA, 78 bp, Artificial Sequence
  Description of Artificial Sequence: Synthetic coding sequence
atggccaacgacatcgacgagctgatcggcatccccttccccaaccacagcagcgaggtgctgtgcagcctgaactag

SEQ ID NO: 13651 - DNA, 57 bp, Artificial Sequence
  Description of Artificial Sequence: Synthetic coding sequence
atggccaacgacatcgacgagctgatcggcatccccttccccaaccacagcagctag

SEQ ID NO: 13652 - DNA, 3375 bp, Artificial Sequence
  Description of Artificial Sequence: Synthetic coding sequence
atggccgacggccccagatgcaagagaagaaagcaggccaaccccagaagaaacaacgtgaccaactacaacaccgtggtggagaccaacagcgacagcgacgacgaggacaagctgcacatcgtggaggaggagagcgtgaccgacgccgccgactgcgagggcgtgcccgaggacgacctgcccaccgaccagaccgtgctgcccggcagaagcagcgagagagagggcaacgccaagaactgctgggaggacgacagaaaggagggccaggagatcctgggccccgaggcccaggccgacgaggccggctgcaccgtgaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcaccatcaccagcgtgtaccagaacagcgtgtacagcgtgcaggaggagcccctgaacctgagctgcgccaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaaggagtgcgagaagccccagggcgacgaggaggaggaggaggaggaggaggaggtggaggaggaggaggtggaggaggccgagaacgagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13653 - DNA, 3378 bp, Artificial Sequence
  Description of Artificial Sequence: Synthetic coding sequence
atggccgacggccccagatgcaagagaagaaagcaggccaaccccagaagaaacaacgtgaccaactacaacaccgtggtggagaccaacagcgacagcgacgacgaggacaagctgcacatcgtggaggaggagagcgtgaccgacgccgccgactgcgagggcgtgcccgaggacgacctgcccaccgaccagaccgtgctgcccggcagaagcagcgagagagagggcaacgccaagaactgctgggaggacgacaccggcaaggagggccaggagatcctgggccccgaggcccaggccgacgaggccggctgcaccgtgaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcaccatcaccagcgtgtaccagaacagcgtgtacagcgtgcaggaggagcccctgaacctgagctgcgccaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaaggagtgcgagaagccccagggcgacgaggaggaggaggaggaggaggaggaggtggaggaggaggaggtggaggaggccgagaacgagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13654 - DNA, 870 bp, Artificial Sequence
  Description of Artificial Sequence: Synthetic coding sequence
atggccgacggccccagatgcaagagaagaaagcaggccaaccccagaagaaacaacgtgaccaactacaacaccgtggtggagaccaacagcgacagcgacgacgaggacaagctgcacatcgtggaggaggagagcgtgaccgacgccgccgactgcgagggcgtgcccgaggacgacctgcccaccgaccagaccgtgctgcccggcagaagcagcgagagagagggcaacgccaagaactgctgggaggacgacaccggcaaggagggccaggagatcctgggccccgaggcccaggccgacgaggccggctgcaccgtgaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagctag

SEQ ID NO: 13655 - DNA, 2721 bp, Artificial Sequence
  Description of Artificial Sequence: Synthetic coding sequence
atgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcaccatcaccagcgtgtaccagaacagcgtgtacagcgtgcaggaggagcccctgaacctgagctgcgccaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaaggagtgcgagaagccccagggcgacgaggaggaggaggaggaggaggaggaggtggaggaggaggaggtggaggaggccgagaacgagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13656 - DNA, 3327 bp, Artificial Sequence
  Description of Artificial Sequence: Synthetic coding sequence
atgaaggtgaccaactacaacaccgtggtggagaccaacagcgacagcgacgacgaggacaagctgcacatcgtggaggaggagagcgtgaccgacgccgccgactgcgagggcgtgcccgaggacgacctgcccaccgaccagaccgtgctgcccggcagaagcagcgagagagagggcaacgccaagaactgctgggaggacgacaccggcaaggagggccaggagatcctgggccccgaggcccaggccgacgaggccggctgcaccgtgaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcaccatcaccagcgtgtaccagaacagcgtgtacagcgtgcaggaggagcccctgaacctgagctgcgccaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaaggagtgcgagaagccccagggcgacgaggaggaggaggaggaggaggaggaggtggaggaggaggaggtggaggaggccgagaacgagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13657 - DNA, 3180 bp, Artificial Sequence
  Description of Artificial Sequence: Synthetic coding sequence
atggccgacggccccagatgcaagagaagaaagcaggccaaccccagaagaaacaacgtgaccaactacaacaccgtggtggagaccaacagcgacagcgacgacgaggacaagctgcacatcgtggaggaggagagcgtgaccgacgccgccgactgcgagggcgtgcccgaggacgacctgcccaccgaccagaccgtgctgcccggcagaagcagcgagagagagggcaacgccaagaactgctgggaggacgacagaaaggagggccaggagatcctgggccccgaggcccaggccgacgaggccggctgcaccgtgaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcaccatcaccagcgtgtaccagaacagcgtgtacagcgtgcaggaggagcccctgaacctgagctgcgccaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaagcacaagaagaagaagtag

SEQ ID NO: 13658 - DNA, 1932 bp, Artificial Sequence
  Description of Artificial Sequence: Synthetic coding sequence
atggccgacggccccagatgcaagagaagaaagcaggccaaccccagaagaaacaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13659 - DNA, 3174 bp, Artificial Sequence
  Description of Artificial Sequence: Synthetic coding sequence
atggccgacggccccagatgcaagagaagaaagcaggccaaccccagaagaaacaacggcaaggagggccaggagatcctgggccccgaggcccaggccgacgaggccggctgcaccgtgaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcaccatcaccagcgtgtaccagaacagcgtgtacagcgtgcaggaggagcccctgaacctgagctgcgccaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaaggagtgcgagaagccccagggcgacgaggaggaggaggaggaggaggaggaggtggaggaggaggaggtggaggaggccgagaacgagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13660 - DNA, 3048 bp, Artificial Sequence
  Description of Artificial Sequence: Synthetic coding sequence
atgatgaacgccagccagatgcagaagatgagcaagaccatgatcctgatgctgaagagcttctacaacaacaagaccctgctgagcttcttcctgagacacctgaagagaaccagaggcagagcccaccagaagcccgtggtgatgatgaagatggagcaccagatgcacttccacaactacagccccgtgcacatcgtgatcggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcaccatcaccagcgtgtaccagaacagcgtgtacagcgtgcaggaggagcccctgaacctgagctgcgccaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaaggagtgcgagaagccccagggcgacgaggaggaggaggaggaggaggaggaggtggaggaggaggaggtggaggaggccgagaacgagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13661 - DNA, 3360 bp, Artificial Sequence
  Description of Artificial Sequence: Synthetic coding sequence
atggccgacggccccagatgcaagagaagaaagcaggccaaccccagaagaaacaacgtgaccaactacaacaccgtggtggagaccaacagcgacagcgacgacgaggacaagctgcacatcgtggaggaggagagcgtgaccgacgccgccgactgcgagggcgtgcccgaggacgacctgcccaccgaccagaccgtgctgcccggcagaagcagcgagagagagggcaacgccaagaactgctgggaggacgacagaaaggagggccaggagatcctgggccccgaggcccaggccgacgaggccggctgcaccgtgaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcagcctgcccgagcagtgcctgttctgccccggcagaaccctggagctggtgctgaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaaggagtgcgagaagccccagggcgacgaggaggaggaggaggaggaggaggaggtggaggaggaggaggtggaggaggccgagaacgagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13662 - DNA, 834 bp, Artificial Sequence
  Description of Artificial Sequence: Synthetic coding sequence
atgaaggtgaccaactacaacaccgtggtggagaccaacagcgacagcgacgacgaggacaagctgcacatcgtggaggaggagagcgtgaccgacgccgccgactgcgagggcgtgcccgaggacgacctgcccaccgaccagaccgtgctgcccggcagaagcagcgagagagagggcaacgccaagaactgctgggaggacgacaccggcaaggagggccaggagatcctgggccccgaggcccaggccgacgaggccggctgcaccgtgaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatctag

SEQ ID NO: 13663 - DNA, 3315 bp, Artificial Sequence
  Description of Artificial Sequence: Synthetic coding sequence
atggccgacggccccagatgcaagagaagaaagcaggccaaccccagaagaaacaacgtgaccaactacaacaccgtggtggagaccaacagcgacagcgacgacgaggacaagctgcacatcgtggaggaggagagcgtgaccgacgccgccgactgcgagggcgtgcccgaggacgacctgcccaccgaccagaccgtgctgcccggcagaagcagcgagagagagggcaacgccaagaactgctgggaggacgacatcaaggacgacgagtgcgagagcgacgccgagaacgagcagaaccacgaccccaacgtggaggagttcctgcagcagcaggacaccgccgtgatcttccccgaggcccccgaggaggaccagagacagggcacccccgaggccagcggccacgacgagaacggcacccccgacgccttcagccagctgctgacctgcccctactgcgacagaggctacaagagattcaccagcctgaaggagcacatcaagtacagacacgagaagaacgaggacaacttcagctgcagcctgtgcagctacaccttcgcctacagaacccagctggagagacacatgaccagccacaagagcggcagagaccagagacacgtgacccagagcggctgcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcagcctgatccccgtgaacggcagacccagaaccggcctgaagaccagccagtgcagcagccccagcctgagcgccagccccggcagccccaccagaccccagatcagacagaagatcgagaacaagcccctgcaggagcagctgagcgtgaaccagatcaagaccgagcccgtggactacgagttcaagcccatcgtggtggccagcggcatcaactgcagcacccccctgcagaacggcgtgttcaccggcggcggccccctgcaggccaccagcagcccccagggcatggtgcaggccgtggtgctgcccaccgtgggcctggtgagccccatcagcatcaacctgagcgacatccagaacgtgctgaaggtggccgtggacggcaacgtgatcagacaggtgctggagaacaaccaggccaacctggccagcaaggagcaggagaccatcaacgccagccccatccagcagggcggccacagcgtgatcagcgccatcagcctgcccctggtggaccaggacggcaccaccaagatcatcatcaactacagcctggagcagcccagccagctgcaggtggtgccccagaacctgaagaaggagaaccccgtggccaccaacagctgcaagagcgagaagctgcccgaggacctgaccgtgaagagcgagaaggacaagagcttcgagggcggcgtgaacgacagcacctgcctgctgtgcgacgactgccccggcgacatcaacgccctgcccgagctgaagcactacgacctgaagcagcccacccagcccccccccctgcccgccgccgaggccgagaagcccgagagcagcgtgagcagcgccaccggcgacggcaacctgagccccagccagccccccctgaagaacctgctgagcctgctgaaggcctactacgccctgaacgcccagcccagcgccgaggagctgagcaagatcgccgacagcgtgaacctgcccctggacgtggtgaagaagtggttcgagaagatgcaggccggccagatcagcgtgcagagcagcgagcccagcagccccgagcccggcaaggtgaacatccccgccaagaacaacgaccagccccagagcgccaacgccaacgagccccaggacagcaccgtgaacctgcagagccccctgaagatgaccaacagccccgtgctgcccgtgggcagcaccaccaacggcagcagaagcagcacccccagccccagccccctgaacctgagcagcagcagaaacacccagggctacctgtacaccgccgagggcgcccaggaggagccccaggtggagcccctggacctgagcctgcccaagcagcagggcgagctgctggagagaagcaccatcaccagcgtgtaccagaacagcgtgtacagcgtgcaggaggagcccctgaacctgagctgcgccaagaaggagccccagaaggacagctgcgtgaccgacagcgagcccgtggtgaacgtgatcccccccagcgccaaccccatcaacatcgccatccccaccgtgaccgcccagctgcccaccatcgtggccatcgccgaccagaacagcgtgccctgcctgagagccctggccgccaacaagcagaccatcctgatcccccaggtggcctacacctacagcaccaccgtgagccccgccgtgcaggagccccccctgaaggtgatccagcccaacggcaaccaggacgagagacaggacaccagcagcgagggcgtgagcaacgtggaggaccagaacgacagcgacagcaccccccccaagaagaagatgagaaagaccgagaacggcatgtacgcctgcgacctgtgcgacaagatcttccagaagagcagcagcctgctgagacacaagtacgagcacaccggcaagagaccccacgagtgcggcatctgcaagaaggccttcaagcacaagcaccacctgatcgagcacatgagactgcacagcggcgagaagccctaccagtgcgacaagtgcggcaagagattcagccacagcggcagctacagccagcacatgaaccacagatacagctactgcaagagagaggccgaggagagagacagcaccgagcaggaggaggccggccccgagatcctgagcaacgagcacgtgggcgccagagccagccccagccagggcgacagcgacgagagagagagcctgaccagagaggaggacgaggacagcgagaaggaggaggaggaggaggacaaggagatggaggagctgcaggaggagaaggagtgcgagaagccccagggcgacgaggaggaggaggaggaggaggaggaggtggaggaggaggaggtggaggaggccgagaacgagggcgaggaggccaagaccgagggcctgatgaaggacgacagagccgagagccaggccagcagcctgggccagaaggtgggcgagagcagcgagcaggtgagcgaggagaagaccaacgaggcctag

SEQ ID NO: 13664 - DNA, 3645 bp, Artificial Sequence
  Description of Artificial Sequence: Synthetic coding sequence
atgaagcagcccatcatggccgacggccccagatgcaagagaagaaagcaggccaaccccagaagaaagaacgtggtgaactacgacaacgtggtggacaccggcagcgagaccgacgaggaggacaagctgcacatcgccgaggacgacggcatcgccaaccccctggaccaggagaccagccccgccagcgtgcccaaccacgagagcagcccccacgtgagccaggccctgctgcccagagaggaggaggaggacgagatcagagagggcggcgtggagcacccctggcacaacaacgagatcctgcaggccagcgtggacggccccgaggagatgaaggaggactacgacaccatgggccccgaggccaccatccagaccgccatcaacaacggcaccgtgaagaacgccaactgcaccagcgacttcgaggagtacttcgccaagagaaagctggaggagagagacggccacgccgtgagcatcgaggagtacctgcagagaagcgacaccgccatcatctaccccgaggcccccgaggagctgagcagactgggcacccccgaggccaacggccaggaggagaacgacctgccccccggcacccccgacgccttcgcccagctgctgacctgcccctactgcgacagaggctacaagagactgaccagcctgaaggagcacatcaagtacagacacgagaagaacgaggagaacttcagctgccccctgtgcagctacaccttcgcctacagaacccagctggagagacacatggtgacccacaagcccggcaccgaccagcaccagatgctgacccagggcgccggcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcggcctgatcagcgtgaacggcagaatgagaaacaacatcaagaccggcagcagccccaacagcgtgagcagcagccccaccaacagcgccatcacccagctgagaaacaagctggagaacggcaagcccctgagcatgagcgagcagaccggcctgctgaagatcaagaccgagcccctggacttcaacgactacaaggtgctgatggccacccacggcttcagcggcaccagccccttcatgaacggcggcctgggcgccaccagccccctgggcgtgcaccccagcgcccagagccccatgcagcacctgggcgtgggcatggaggcccccctgctgggcttccccaccatgaacagcaacctgagcgaggtgcagaaggtgctgcagatcgtggacaacaccgtgagcagacagaagatggactgcaaggccgaggagatcagcaagctgaagggctaccacatgaaggacccctgcagccagcccgaggagcagggcgtgaccagccccaacatcccccccgtgggcctgcccgtggtgagccacaacggcgccaccaagagcatcatcgactacaccctggagaaggtgaacgaggccaaggcctgcctgcagagcctgaccaccgacagcagaagacagatcagcaacatcaagaaggagaagctgagaaccctgatcgacctggtgaccgacgacaagatgatcgagaaccacaacatcagcacccccttcagctgccagttctgcaaggagagcttccccggccccatccccctgcaccagcacgagagatacctgtgcaagatgaacgaggagatcaaggccgtgctgcagccccacgagaacatcgtgcccaacaaggccggcgtgttcgtggacaacaaggccctgctgctgagcagcgtgctgagcgagaagggcatgaccagccccatcaacccctacaaggaccacatgagcgtgctgaaggcctactacgccatgaacatggagcccaacagcgacgagctgctgaagatcagcatcgccgtgggcctgccccaggagttcgtgaaggagtggttcgagcagagaaaggtgtaccagtacagcaacagcagaagccccagcctggagagaagcagcaagcccctggcccccaacagcaacccccccaccaaggacagcctgctgcccagaagccccgtgaagcccatggacagcatcaccagccccagcatcgccgagctgcacaacagcgtgaccaactgcgacccccccctgagactgaccaagcccagccacttcaccaacatcaagcccgtggagaagctggaccacagcagaagcaacacccccagccccctgaacctgagcagcaccagcagcaagaacagccacagcagcagctacacccccaacagcttcagcagcgaggagctgcaggccgagcccctggacctgagcctgcccaagcagatgaaggagcccaagagcatcatcgccaccaagaacaagaccaaggccagcagcatcagcctggaccacaacagcgtgagcagcagcagcgagaacagcgacgagcccctgaacctgaccttcatcaagaaggagttcagcaacagcaacaacctggacaacaagagcaccaaccccgtgttcagcatgaaccccttcagcgccaagcccctgtacaccgccctgcccccccagagcgccttcccccccgccaccttcatgccccccgtgcagaccagcatccccggcctgagaccctaccccggcctggaccagatgagcttcctgccccacatggcctacacctaccccaccggcgccgccaccttcgccgacatgcagcagagaagaaagtaccagagaaagcagggcttccagggcgagctgctggacggcgcccaggactacatgagcggcctggacgacatgaccgacagcgacagctgcctgagcagaaagaagatcaagaagaccgagagcggcatgtacgcctgcgacctgtgcgacaagaccttccagaagagcagcagcctgctgagacacaagtacgagcacaccggcaagagaccccaccagtgccagatctgcaagaaggccttcaagcacaagcaccacctgatcgagcacagcagactgcacagcggcgagaagccctaccagtgcgacaagtgcggcaagagattcagccacagcggcagctacagccagcacatgaaccacagatacagctactgcaagagagaggccgaggagagagaggccgccgagagagaggccagagagaagggccacctggagcccaccgagctgctgatgaacagagcctacctgcagagcatcaccccccagggctacagcgacagcgaggagagagagagcatgcccagagacggcgagagcgagaaggagcacgagaaggagggcgaggacggctacggcaagctgggcagacaggacggcgacgaggagttcgaggaggaggaggaggagagcgagaacaagagcatggacaccgaccccgagaccatcagagacgaggaggagaccggcgaccacagcatggacgacagcagcgaggacggcaagatggagaccaagagcgaccacgaggaggacaacatggaggacggcatgtag

SEQ ID NO: 13665 - DNA, 1275 bp, Artificial Sequence
  Description of Artificial Sequence: Synthetic coding sequence
atggccgacggccccagatgcaagagaagaaagcaggccaaccccagaagaaagaacgtggtgaactacgacaacgtggtggacaccggcagcgagaccgacgaggaggacaagctgcacatcgccgaggacgacggcatcgccaaccccctggaccaggagaccagccccgccagcgtgcccaaccacgagagcagcccccacgtgagccaggccctgctgcccagagaggaggaggaggacgagatcagagagggcggcgtggagcacccctggcacaacaacgagatcctgcaggccagcgtggacggccccgaggagatgaaggaggactacgacaccatgggccccgaggccaccatccagaccgccatcaacaacggcaccgtgaagaacgccaactgcaccagcgacttcgaggagtacttcgccaagagaaagctggaggagagagacggccacgccgtgagcatcgaggagtacctgcagagaagcgacaccgccatcatctaccccgaggcccccgaggagctgagcagactgggcacccccgaggccaacggccaggaggagaacgacctgccccccggcacccccgacgccttcgcccagctgctgacctgcccctactgcgacagaggctacaagagactgaccagcctgaaggagcacatcaagtacagacacgagaagaacgaggagaacttcagctgccccctgtgcagctacaccttcgcctacagaacccagctggagagacacatggtgacccacaagcccggcaccgaccagcaccagatgctgacccagggcgccggcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcggcctgatcagcgtgaacggcagaatgagaaacaacatcaagaccggcagcagccccaacagcgtgagcagcagccccaccaacagcgccatcacccagctgagaaacaagctggagaacggcaagcccctgagcatgagcgagcagaccggcctgctgaagagcggcagagcccagtggctgacccccctgatccccgccctgctggaggccgaggtgggcagaagcagaggccagaagatcgagaccctgctggccaacatggtggagcccagactgtactag

SEQ ID NO: 13666 - DNA, 1320 bp, Artificial Sequence
  Description of Artificial Sequence: Synthetic coding sequence
atgaagcagcccatcatggccgacggccccagatgcaagagaagaaagcaggccaaccccagaagaaagaacgtggtgaactacgacaacgtggtggacaccggcagcgagaccgacgaggaggacaagctgcacatcgccgaggacgacggcatcgccaaccccctggaccaggagaccagccccgccagcgtgcccaaccacgagagcagcccccacgtgagccaggccctgctgcccagagaggaggaggaggacgagatcagagagggcggcgtggagcacccctggcacaacaacgagatcctgcaggccagcgtggacggccccgaggagatgaaggaggactacgacaccatgggccccgaggccaccatccagaccgccatcaacaacggcaccgtgaagaacgccaactgcaccagcgacttcgaggagtacttcgccaagagaaagctggaggagagagacggccacgccgtgagcatcgaggagtacctgcagagaagcgacaccgccatcatctaccccgaggcccccgaggagctgagcagactgggcacccccgaggccaacggccaggaggagaacgacctgccccccggcacccccgacgccttcgcccagctgctgacctgcccctactgcgacagaggctacaagagactgaccagcctgaaggagcacatcaagtacagacacgagaagaacgaggagaacttcagctgccccctgtgcagctacaccttcgcctacagaacccagctggagagacacatggtgacccacaagcccggcaccgaccagcaccagatgctgacccagggcgccggcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcggcctgatcagcgtgaacggcagaatgagaaacaacatcaagaccggcagcagccccaacagcgtgagcagcagccccaccaacagcgccatcacccagctgagaaacaagctggagaacggcaagcccctgagcatgagcgagcagaccggcctgctgaagatcaagaccgagcccctggacttcaacgactacaaggtgctgatggccacccacggcttcagcggcaccagccccttcatgaacggcggcctgggcgccaccagccccctgggcgtgcaccccagcgcccagagccccatgcagcacctgtag

SEQ ID NO: 13667 - DNA, 408 bp, Artificial Sequence
  Description of Artificial Sequence: Synthetic coding sequence
atgaagcagcccatcatggccgacggccccagatgcaagagaagaaagcaggccaaccccagaagaaagaacgtggtgaactacgacaacgtggtggacaccggcagcgagaccgacgaggaggacaagctgcacatcgccgaggacgacggcatcgccaaccccctggaccaggagaccagccccgccagcgtgcccaaccacgagagcagcccccacgtgagccaggccctgctgcccagagaggaggaggaggacgagatcagagagggcggcgtggagcacccctggcacaacaacgagatcctgcaggccagcgtggacggccccgaggagatgaaggaggactacgacaccatgggccccgaggccaccatccagaccgccatcaacaacggcaccggctag

SEQ ID NO: 13668 - DNA, 3645 bp, Artificial Sequence; identical to SEQ ID NO: 13664
  Description of Artificial Sequence: Synthetic coding sequence

SEQ ID NO: 13669 - DNA, 2109 bp, Artificial Sequence
  Description of Artificial Sequence: Synthetic coding sequence
atgaagcagcccatcatggccgacggccccagatgcaagagaagaaagcaggccaaccccagaagaaagaacgtggtgaactacgacaacgtggtggacaccggcagcgagaccgacgaggaggacaagctgcacatcgccgaggacgacggcatcgccaaccccctggaccaggagaccagccccgccagcgtgcccaaccacgagagcagcccccacgtgagccaggccctgctgcccagagaggaggaggaggacgagatcagagagggcggcgtggagcacccctggcacaacaacgagatcctgcaggccagcgtggacggccccgaggagatgaaggaggactacgacaccatgggccccgaggccaccatccagaccgccatcaacaacggcaccgtgaagaacgccaactgcaccagcgacttcgaggagtacttcgccaagagaaagctggaggagagagacggccacgccgtgagcatcgaggagtacctgcagagaagcgacaccgccatcatctaccccgaggcccccgaggagctgagcagactgggcacccccgaggccaacggccaggaggagaacgacctgccccccggcacccccgacgccttcgcccagctgctgacctgcccctactgcgacagaggctacaagagactgaccagcctgaaggagcacatcaagtacagacacgagaagaacgaggagaacttcagctgccccctgtgcagctacaccttcgcctacagaacccagctggagagacacatggtgacccacaagcccggcaccgaccagcaccagatgctgacccagggcgccggcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcggcctgatcagcgtgaacggcagaatgagaaacaacatcaagaccggcagcagccccaacagcgtgagcagcagccccaccaacagcgccatcacccagctgagaaacaagctggagaacggcaagcccctgagcatgagcgagcagaccggcctgctgaagatcaagaccgagcccctggacttcaacgactacaaggtgctgatggccacccacggcttcagcggcaccagccccttcatgaacggcggcctgggcgccaccagccccctgggcgtgcaccccagcgcccagagccccatgcagcacctgggcgtgggcatggaggcccccctgctgggcttccccaccatgaacagcaacctgagcgaggtgcagaaggtgctgcagatcgtggacaacaccgtgagcagacagaagatggactgcaaggccgaggagatcagcaagctgaagggctaccacatgaaggacccctgcagccagcccgaggagcagggcgtgaccagccccaacatcccccccgtgggcctgcccgtggtgagccacaacggcgccaccaagagcatcatcgactacaccctggagaaggtgaacgaggccaaggcctgcctgcagagcctgaccaccgacagcagaagacagatcagcaacatcaagaaggagaagctgagaaccctgatcgacctggtgaccgacgacaagatgatcgagaaccacaacatcagcacccccttcagctgccagttctgcaaggagagcttccccggccccatccccctgcaccagcacgagagatacctgtgcaagatgaacgaggagatcaaggccgtgctgcagccccacgagaacatcgtgcccaacaaggccggcgtgttcgtggacaacaaggccctgctgctgagcagcgtgctgagcgagaagggcatgaccagccccatcaacccctacaaggaccacatgagcgtgctgaaggcctactacgccatgaacatggagcccaacagcgacgagctgctgaagatcagcatcgccgtgggcctgccccaggagttcgtgaaggagtggttcgagcagagaaaggtgtaccagtacagcaactag

SEQ ID NO: 13670 - DNA, 276 bp, Artificial Sequence
  Description of Artificial Sequence: Synthetic coding sequence
atgaagcagcccatcatggccgacggccccagatgcaagagaagaaagcaggccaaccccagaagaaagaacgtggtgaactacgacaacgtggtggacaccggcagcgagaccgacgaggaggacaagctgcacatcgccgaggacgacggcatcgccaaccccctggaccaggagaccagccccgccagcgtgcccaaccacgagagcagcccccacgtgagccaggccctgctgcccagagaggaggaggaggacgagatcagagagggctag

SEQ ID NO: 13671 - DNA, 192 bp, Artificial Sequence
  Description of Artificial Sequence: Synthetic coding sequence
atgaagcagcccatcatggccgacggccccagatgcaagagaagaaagcaggccaaccccagaagaaagaacgtggtgaactacgacaacgtggtggacaccggcagcgagaccgacgaggaggacaagctgcacatcgccgaggacgacggcatcgccaaccccctggaccaggagaccagccccgcctag

SEQ ID NO: 13672 - DNA, 3573 bp, Artificial Sequence
  Description of Artificial Sequence: Synthetic coding sequence
atgaagcagcccatcatggccgacggccccagatgcaagagaagaaagcaggccaaccccagaagaaagaacgtggtgaactacgacaacgtggtggacaccggcagcgagaccgacgaggaggacaagctgcacatcgccgaggacgacggcatcgccaaccccctggaccaggagaccagccccgccagcgtgcccaaccacgagagcagcccccacgtgagccaggccctgctgcccagagaggaggaggaggacgagatcagagagggcggcgtggagcacccctggcacaacaacgagatcctgcaggccagcgtggacggccccgtgaagaacgccaactgcaccagcgacttcgaggagtacttcgccaagagaaagctggaggagagagacggccacgccgtgagcatcgaggagtacctgcagagaagcgacaccgccatcatctaccccgaggcccccgaggagctgagcagactgggcacccccgaggccaacggccaggaggagaacgacctgccccccggcacccccgacgccttcgcccagctgctgacctgcccctactgcgacagaggctacaagagactgaccagcctgaaggagcacatcaagtacagacacgagaagaacgaggagaacttcagctgccccctgtgcagctacaccttcgcctacagaacccagctggagagacacatggtgacccacaagcccggcaccgaccagcaccagatgctgacccagggcgccggcaacagaaagttcaagtgcaccgagtgcggcaaggccttcaagtacaagcaccacctgaaggagcacctgagaatccacagcggcgagaagccctacgagtgccccaactgcaagaagagattcagccacagcggcagctacagcagccacatcagcagcaagaagtgcatcggcctgatcagcgtgaacggcagaatgagaaacaacatcaagaccggcagcagccccaacagcgtgagcagcagccccaccaacagcgccatcacccagctgagaaacaagctggagaacggcaagcccctgagcatgagcgagcagaccggcctgctgaagatcaagaccgagcccctggacttcaacgactacaaggtgctgatggccacccacggcttcagcggcaccagccccttcatgaacggcggcctgggcgccaccagccccctgggcgtgcaccccagcgcccagagccccatgcagcacctgggcgtgggcatggaggcccccctgctgggcttccccaccatgaacagcaacctgagcgaggtgcagaaggtgctgcagatcgtggacaacaccgtgagcagacagaagatggactgcaaggccgaggagatcagcaagctgaagggctaccacatgaaggacccctgcagccagcccgaggagcagggcgtgaccagccccaacatcccccccgtgggcctgcccgtggtgagccacaacggcgccaccaagagcatcatcgactacaccctggagaaggtgaacgaggccaaggcctgcctgcagagcctgaccaccgacagcagaagacagatcagcaacatcaagaaggagaagctgagaaccctgatcgacctggtgaccgacgacaagatgatcgagaaccacaacatcagcacccccttcagctgccagttctgcaaggagagcttccccggccccatccccctgcaccagcacgagagatacctgtgcaagatgaacgaggagatcaaggccgtgctgcagccccacgagaacatcgtgcccaacaaggccggcgtgttcgtggacaacaaggccctgctgctgagcagcgtgctgagcgagaagggcatgaccagccccatcaacccctacaaggaccacatgagcgtgctgaaggcctactacgccatgaacatggagcccaacagcgacgagctgctgaagatcagcatcgccgtgggcctgccccaggagttcgtgaaggagtggttcgagcagagaaaggtgtaccagtacagcaacagcagaagccccagcctggagagaagcagcaagcccctggcccccaacagcaacccccccaccaaggacagcctgctgcccagaagccccgtgaagcccatggacagcatcaccagccccagcatcgccgagctgcacaacagcgtgaccaactgcgacccccccctgagactgaccaagcccagccacttcaccaacatcaagcccgtggagaagctggaccacagcagaagcaacacccccagccccctgaacctgagcagcaccagcagcaagaacagccacagcagcagctacacccccaacagcttcagcagcgaggagctgcaggccgagcccctggacctgagcctgcccaagcagatgaaggagcccaagagcatcatcgccaccaagaacaagaccaaggccagcagcatcagcctggaccacaacagcgtgagcagcagcagcgagaacagcgacgagcccctgaacctgaccttcatcaagaaggagttcagcaacagcaacaacctggacaacaagagcaccaaccccgtgttcagcatgaaccccttcagcgccaagcccctgtacaccgccctgcccccccagagcgccttcccccccgccaccttcatgccccccgtgcagaccagcatccccggcctgagaccctaccccggcctggaccagatgagcttcctgccccacatggcctacacctaccccaccggcgccgccaccttcgccgacatgcagcagagaagaaagtaccagagaaagcagggcttccagggcgagctgctggacggcgcccaggactacatgagcggcctggacgacatgaccgacagcgacagctgcctgagcagaaagaagatcaagaagaccgagagcggcatgtacgcctgcgacctgtgcgacaagaccttccagaagagcagcagcctgctgagacacaagtacgagcacaccggcaagagaccccaccagtgccagatctgcaagaaggccttcaagcacaagcaccacctgatcgagcacagcagactgcacagcggcgagaagccctaccagtgcgacaagtgcggcaagagattcagccacagcggcagctacagccagcacatgaaccacagatacagctactgcaagagagaggccgaggagagagaggccgccgagagagaggccagagagaagggccacctggagcccaccgagctgctgatgaacagagcctacctgcagagcatcaccccccagggctacagcgacagcgaggagagagagagcatgcccagagacggcgagagcgagaaggagcacgagaaggagggcgaggacggctacggcaagctgggcagacaggacggcgacgaggagttcgaggaggaggaggaggagagcgagaacaagagcatggacaccgaccccgagaccatcagagacgaggaggagaccggcgaccacagcatggacgacagcagcgaggacggcaagatggagaccaagagcgaccacgaggaggacaacatggaggacggcatgtag

SEQ ID NO: 13673 - DNA, 3645 bp, Artificial Sequence; identical to SEQ ID NO: 13664
  Description of Artificial Sequence: Synthetic coding sequence

SEQ ID NO: 13674 - DNA, 1893 bp, Artificial Sequence
  Description of Artificial Sequence: Synthetic coding sequence
atgagcatcagcgccctgggcggcagaaccaagggcaagcccctgccccccggcgaggaggagagaaacaacgtgctgaagcagatgaaggtgagaaccaccctgaagggcgacaagagctggatcaccaagcaggacgagagcgagggcagaaccatcgagctgcccagcggcagaagcagagccaccagcttcagcagcgccggcgaggtgcccaagcccagaccccccagcaccagagcccccaccggctacatcatcagaggcgtgttcaccaagcccatcgacagcagcagccagccccagcagcagttccccaaggccaacggcacccccaagagcgccgccagcctggtgagaaccgccaacgccggcccccccagacccagcagcagcggctacaagatgaccaccgaggactacaagaagctggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggccccacccaggagacccaggcccccttcatcgccaagagagtggaggtggtggaggaggacggccccagcgagaagagccaggacccccccgccctggccagaagcacccccggcagcaacagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13675 - DNA, 1407 bp, Artificial Sequence
  Description of Artificial Sequence: Synthetic coding sequence
atgaccaccgaggactacaagaagctggccccctacaacatcagaagaagcagcaccagcggcgacaccgaggaggaggaggaggaggaggtggtgcccttcagcagcgacgagcagaagagaagcagccccacccaggagacccaggcccccttcatcgccaagagagtggaggtggtggaggaggacggccccagcgagaagagccaggacccccccgccctggccagaagcacccccggcagcaacagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13676 - DNA, 1374 bp, Artificial Sequence
  Description of Artificial Sequence: Synthetic coding sequence
atgaccaccgaggactacaagaagctggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggcagccccacccaggagacccaggcccccttcatcgccaagagagtggaggtggtggaggaggacggccccagcgagaagagccaggacccccccgccctggccagaagcacccccggcagcaacagcagcagaggcgaggagatcgtgagactgcagatcctgacccccagagccggcctgagactggtggcccccgacgtggagggcatgagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13677 - DNA, 2070 bp, Artificial Sequence
  Description of Artificial Sequence: Synthetic coding sequence
atgagcatcagcgccctgggcggcagaaccaagggcaagcccctgccccccggcgaggaggagagaaacaacgtgctgaagcagatgaaggtgagaaccaccctgaagggcgacaagagctggatcaccaagcaggacgagagcgagggcagaaccatcgagctgcccagcggcagaagcagagccaccagcttcagcagcgccggcgaggtgcccaagcccagaccccccagcaccagagcccccaccggctacatcatcagaggcgtgttcaccaagcccatcgacagcagcagccagccccagcagcagttccccaaggccaacggcacccccaagagcgccgccagcctggtgagaaccgccaacgccggcccccccagacccagcagcagcggctacaagatgaccaccgaggactacaagaagctggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggccccacccaggagacccaggcccccttcatcgccaagagagtggaggtggtggaggaggacggccccagcgagaagagccaggacccccccgccctggccagaagcacccccggcagcaacagcgccgacggcggcagaaccaaggccagcagagccatctggatcgagtgcctgcccagcatgcccagccccgccggcagccaggagctgagcagcagaggcgaggagatcgtgagactgcagatcctgacccccagagccggcctgagactggtggcccccgacgtggagggcatgagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13678 - DNA, 1359 bp, Artificial Sequence
  Description of Artificial Sequence: Synthetic coding sequence
atgcagagacaggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggcagccccacccaggagacccaggcccccttcatcgccaagagagtggaggtggtggaggaggacggccccagcgagaagagccaggacccccccgccctggccagaagcacccccggcagcaacagcagcagaggcgaggagatcgtgagactgcagatcctgacccccagagccggcctgagactggtggcccccgacgtggagggcatgagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13679 - DNA, 1428 bp, Artificial Sequence
  Description of Artificial Sequence: Synthetic coding sequence
tgaagaagcagcaccagcggcgacaccgaggaggaggaggaggaggaggtggtgcccttcagcagcgacgagcagaagagaagcctgagaagaaccgcccccagagagcacagctacgtgctgagcgccgccaagaagagcaccggcagccccacccaggagacccaggcccccttcatcgccaagagagtggaggtggtggaggaggacggccccagcgagaagagccaggacccccccgccctggccagaagcacccccggcagcaacagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13680 - DNA, 1146 bp, Artificial Sequence
  Description of Artificial Sequence: Synthetic coding sequence
atgaccaccgaggactacaagaagctggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggcagccccacccaggagacccaggcccccttcatcgccaagagagtggaggtggtggaggaggacggccccagcgagaagagccaggacccccccgccctggccagaagcacccccggcagcaacagcgccgacggcggcagaaccaaggccagcagagccatctggatcgagtgcctgcccagcatgcccagccccgccggcagccaggagctgagcagcagaggcgaggagatcgtgagactgcagatcctgacccccagagccggcctgagactggtggcccccgacgtggagggcatgagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggccccagctgcacccacagcgccacctgcagaagccagtaccccagaaccgccgagcagccccagagaatctag

SEQ ID NO: 13681 - DNA, 636 bp, Artificial Sequence
  Description of Artificial Sequence: Synthetic coding sequence
gaggaggccttcagagcccccaacaccgacgccgccagaagcagcgcccagctgagcgacggcaacgtgggcagcggcgccaccggcagcagacccgagggcctggccgccgtggacatcggcagcgagagaggcagactgtgcgccgccgccagcttcgccagcttcctggaggaccaggacggccacagcgccaacagccagagctgcaagcccagacccgccgccatcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagtag

SEQ ID NO: 13682 - DNA, 666 bp, Artificial Sequence
  Description of Artificial Sequence: Synthetic coding sequence
tgactgagaagaaccgcccccagagagcacagctacgtgctgagcgccgccaagaagagcaccggcagccccacccaggagacccaggcccccttcatcgccaagagagtggaggtggtggaggaggacggccccagcgagaagagccaggacccccccgccctggccagaagcacccccggcagcaacagcgccgacggcggcagaaccaaggccagcagagccatctggatcgagtgcctgcccagcatgcccagccccgccggcagccaggagctgagcagcagaggcgaggagatcgtgagactgcagatcctgacccccagagccggcctgagactggtggcccccgacgtggagggcatgagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagcagcagcgccaccagcgtgagcgccgtgcccgccgacagaaagagcaacagcaccgccgcccaggaggacgccaaggccgaccccaagggctag

SEQ ID NO: 13683 - DNA, 414 bp, Artificial Sequence
  Description of Artificial Sequence: Synthetic coding sequence
tgagtgctgcccagaagacacagacacagactgagcagaagaggctggagatggtggaagagaaccggcctgctgagaagagccagaacccacctgctgtggcaggaccccctgctggcccagaccgtgagaatggaggccggccccaagagactgggccagttcggcagcagcgcctgccaggtgtgcctggcccccctgggcgccagaagcagcggcctgccccaggccaccaagaccagaagaccccccgcccccgagagcagcagaggcacctggctggtgagaagactgagcggcccccccacccagatgctgcaggcccccgtgcccctgcagagcctgctgagcctgctgatcggcagagccaccgcccagcagcccagaagaatgcagagacagacccagagatag

SEQ ID NO: 13684 - DNA, 2073 bp, Artificial Sequence
  Description of Artificial Sequence: Synthetic coding sequence
atgagcatcagcgccctgggcggcagaaccaagggcaagcccctgccccccggcgaggaggagagaaacaacgtgctgaagcagatgaaggtgagaaccaccctgaagggcgacaagagctggatcaccaagcaggacgagagcgagggcagaaccatcgagctgcccagcggcagaagcagagccaccagcttcagcagcgccggcgaggtgcccaagcccagaccccccagcaccagagcccccaccggctacatcatcagaggcgtgttcaccaagcccatcgacagcagcagccagccccagcagcagttccccaaggccaacggcacccccaagagcgccgccagcctggtgagaaccgccaacgccggcccccccagacccagcagcagcggctacaagatgaccaccgaggactacaagaagctggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggcagccccacccaggagacccaggcccccttcatcgccaagagagtggaggtggtggaggaggacggccccagcgagaagagccaggacccccccgccctggccagaagcacccccggcagcaacagcgccgacggcggcagaaccaaggccagcagagccatctggatcgagtgcctgcccagcatgcccagccccgccggcagccaggagctgagcagcagaggcgaggagatcgtgagactgcagatcctgacccccagagccggcctgagactggtggcccccgacgtggagggcatgagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13685 - DNA, 993 bp, Artificial Sequence
  Description of Artificial Sequence: Synthetic coding sequence
tgaagcgagatggccgccagagacgagctgggcctgggcggcgacagcctggaggccatgcccgtgcccgccgccagaggcagacccagaatcaccaacggccccgaggagctggccgcccccagccccgccgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13686 - DNA, 1575 bp, Artificial Sequence
  Description of Artificial Sequence: Synthetic coding sequence
atgaccaccgaggactacaagaagctggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggccccacccaggagacccaggcccccttcatcgccaagagagtggaggtggtggaggaggacggccccagcgagaagagccaggacccccccgccctggccagaagcacccccggcagcaacagcagcagaggcgaggagatcgtgagactgcagatcctgacccccagagccggcctgagactggtggcccccgacgtggagggcatgagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13687 - DNA, 2166 bp, Artificial Sequence
  Description of Artificial Sequence: Synthetic coding sequence
atgagcatcagcgccctgggcggcagaaccaagggcaagcccctgccccccggcgaggaggagagaaacaacgtgctgaagcagatgaaggtgagaaccaccctgaagggcgacaagagctggatcaccaagcaggacgagagcgagggcagaaccatcgagctgcccagcggcagaagcagagccaccagcttcagcagcgccggcgaggtgcccaagcccagaccccccagcaccagagcccccaccggctacatcatcagaggcgtgttcaccaagcccatcgacagcagcagccagccccagcagcagttccccaaggccaacggcacccccaagagcgccgccagcctggtgagaaccgccaacgccggcccccccagacccagcagcagcggctacaagatgaccaccgaggactacaagaagctggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggccccacccaggagacccaggcccccttcatcgccaagagagtggaggtggtggaggaggacggccccagcgagaagagccaggacccccccgccctggccagaagcacccccggcagcaacagcgccgacggcggcagaaccaaggccagcagagccatctggatcgagtgcctgcccagcatgcccagccccgccggcagccaggagctgagcagcagaggcgaggagatcgtgagactgcagatcctgacccccagagccggcctgagactggtggcccccgacgtggagggcatgagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagactgtgcgccgccgccagcttcgccagcttcctggaggaccaggacggccacagcgccaacagccagagctgcaagcccagacccgccgccatcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13688 - DNA, 2079 bp, Artificial Sequence
  Description of Artificial Sequence: Synthetic coding sequence
atgagcatcagcgccctgggcggcagaaccaagggcaagcccctgccccccggcgaggaggagagaaacaacgtgctgaagcagatgaaggtgagaaccaccctgaagggcgacaagagctggatcaccaagcaggacgagagcgagggcagaaccatcgagctgcccagcggcagaagcagagccaccagcttcagcagcgccggcgaggtgcccaagcccagaccccccagcaccagagcccccaccggctacatcatcagaggcgtgttcaccaagcccatcgacagcagcagccagccccagcagcagttccccaaggccaacggcacccccaagagcgccgccagcctggtgagaaccgccaacgccggcccccccagacccagcagcagcggctacaagatgaccaccgaggactacaagaagctggccccctacaacatcagaagaagcagcaccagcggcgacaccgaggaggaggaggaggaggaggtggtgcccttcagcagcgacgagcagaagagaagaagcgaggccgccagcggcgtgctgagaagaaccgcccccagagagcacagctacgtgctgagcgccgccaagaagagcaccggccccacccaggagacccaggcccccttcatcgccaagagagtggaggtggtggaggaggacggccccagcgagaagagccaggacccccccgccctggccagaagcacccccggcagcaacagcgccgacggcggcagaaccaaggccagcagagccatctggatcgagtgcctgcccagcatgcccagccccgccggcagccaggagctgagaagcagccccggcaacaaggacaaggaggccccctgcagcagagagctgcagagagacctggccggcgaggaggccttcagagcccccaacaccgacgccgccagaagcagcgcccagctgagcgacggcaacgtgggcagcggcgccaccggcagcagacccgagggcctggccgccgtggacatcggcagcgagagaggcagactgtgcgccgccgccagcttcgccagcttcctggaggaccaggacggccacagcgccaacagccagagctgcaagcccagacccgccgccatcagcagcagcgccaccagcgtgagcgccgtgcccgccgacagaaagagcaacagcaccgccgcccaggaggacgccaaggccgaccccaagggcgccctggccgactacgagggcaaggacgtggccaccagagtgggcgaggcctggcaggagagacccggcgcccccagaggcggccagggcgaccccgccgtgcccgcccagcagcccgccgaccccagcacccccgagagacagagcagccccagcggcagcgagcagctggtgagaagagagagctgcggcagcagcgtgctgaccgacttcgagggcaaggacgtggccaccaaggtgggcgaggcctggcaggacagacccggcgcccccagaggcggccagggcgaccccgccgtgcccacccagcagcccgccgaccccagcacccccgagcagcagaacagccccagcggcagcgagcagttcgtgagaagagagagctgcaccagcagagtgagaagccccagcagctgcatggtgaccgtgaccgtgaccgccaccagcgagcagccccacatctacatccccgcccccgccagcgagctggacagcagcagcaccaccaagggcatcctgttcgtgaaggagtacgtgaacgccagcgaggtgagcagcggcaagcccgtgagcgccagatacagcaacgtgagcagcatcgaggacagcttcgccatggagaagaagcccccctgcggcagcaccccctacagcgagagaaccaccggcggcatctgcacctactgcaacagagagatcagagactgccccaagatcaccctggagcacctgggcatctgctgccacgagtactgcttcaagtgcggcatctgcagcaagcccatgggcgacctgctggaccagatcttcatccacagagacaccatccactgcggcaagtgctacgagaagctgttctag

SEQ ID NO: 13689 - DNA, 1899 bp, Artificial Sequence
  Description of Artificial Sequence: Synthetic coding sequence
atgcagagagaggagggcttcaacaccaagatggccgacggccccgacgagtacgacaccgaggccggctgcgtgcccctgctgcaccccgaggagatcaagccccagagccactacaaccacggctacggcgagcccctgggcagaaagacccacatcgacgactacagcacctgggacatcgtgaaggccacccagtacggcatctacgagagatgcagagagctggtggaggccggctacgacgtgagacagcccgacaaggagaacgtgaccctgctgcactgggccgccatcaacaacagaatcgacctggtgaagtactacatcagcaagggcgccatcgtggaccagctgggcggcgacctgaacagcacccccctgcactgggccaccagacagggccacctgagcatggtggtgcagctgatgaagtacggcgccgaccccagcctgatcgacggcgagggctgcagctgcatccacctggccgcccagttcggccacaccagcatcgtggcctacctgatcgccaagggccaggacgtggacatgatggaccagaacggcatgacccccctgatgtgggccgcctacagaacccacagcgtggaccccaccagactgctgctgaccttcaacgtgagcgtgaacctgggcgacaagtaccacaagaacaccgccctgcactgggccgtgctggccggcaacaccaccgtgatcagcctgctgctggaggccggcgccaacgtggacgcccagaacatcaagggcgagagcgccctggacctggccaagcagagaaagaacgtgtggatgatcaaccacctgcaggaggccagacaggccaagggctacgacaaccccagcttcctgagaaagctgaaggccgacaaggagttcagacagaaggtgatgctgggcacccccttcctggtgatctggctggtgggcttcatcgccgacctgaacatcgacagctggctgatcaagggcctgatgtacggcggcgtgtgggccaccgtgcagttcctgagcaagagcttcttcgaccacagcatgcacagcgccctgcccctgggcatctacctggccaccaagttctggatgtacgtgacctggttcttctggttctggaacgacctgaacttcctgttcatccacctgcccttcctggccaacagcgtggccctgttctacaacttcggcaagagctggaagagcgaccccggcatcatcaaggccaccgaggagcagaagaagaagaccatcgtggagctggccgagaccggcagcctggacctgagcatcttctgcagcacctgcctgatcagaaagcccgtgagaagcaagcactgcggcgtgtgcaacagatgcatcgccaagttcgaccaccactgcccctgggtgggcaactgcgtgggcgccggcaaccacagatacttcatgggctacctgttcttcctgctgttcatgatctgctggatgatctacggctgcatcagctactggggcctgcactgcgagaccacctacaccaaggacggcttctggacctacatcacccagatcgccacctgcagcccctggatgttctggatgttcctgaacagcgtgttccacttcatgtgggtggccgtgctgctgatgtgccagatgtaccagatcagctgcctgggcatcaccaccaacgagagaatgaacgccagaagatacaagcacttcaaggtgaccaccaccagcatcgagagccccttcaaccacggctgcgtgagaaacatcatcgacttcttcgagttcagatgctgcggcctgttcagacccgtgatcgtggactggaccagacagtacaccatcgagtacgaccagatcagcggcagcggctaccagctggtgtag

SEQ ID NO: 13690 - DNA, 651 bp, Artificial Sequence
  Description of Artificial Sequence: Synthetic coding sequence
atgagcaccatccccaagagagccgtgtgccccttcagcacccagagatacggcatctacgagagatgcagagagctggtggaggccggctacgacgtgagacagcccgacaaggagaacgtgaccctgctgcactgggccgccatcaacaacagaatcgacctggtgaagtactacatcagcaagggcgccatcgtggaccagctgggcggcgacctgaacagcacccccctgcactgggccaccagacagggccacctgagcatggtggtgcagctgatgaagtacggcgccgaccccagcctgatcgacggcgagggctgcagctgcatccacctggccgcccagttcggccacaccagcatcgtggcctacctgatcgccaagggccaggacgtggacatgatggaccagaacggcatgacccccctgatgtgggccgcctacagaacccacagcgtggaccccaccagactgctgctgaccttcaacgtgagcgtgaacctgggcgacaagtaccacaagaacaccgccctgcactgggccgtgctggccggcaacaccaccgtgatcagcctgctgctggaggccggcgccaacgtggacgcccagaacatcaaggccatcctgagatgccacatggccctgtag

SEQ ID NO: 13691 - DNA, 1899 bp, Artificial Sequence; identical to SEQ ID NO: 13689
  Description of Artificial Sequence: Synthetic coding sequence

SEQ ID NO: 13692 - DNA, 2667 bp, Artificial Sequence
  Description of Artificial Sequence: Synthetic coding sequence
atgcttagtcggctgttcagaatgcacggactattcgtcgcctcacacccatgggaagtgatcgtgggcaccgtcacattgacaatttgcatgatgagcatgaacatgtttactggtaataataagatatgtgggtggaattatgagtgtccaaaattcgaagaggacgtcctgagctcagacattattatacttaccattacaaggtgcattgcgattttgtacatttactttcagttccagaatctacgacagcttggttcaaagtatatactggggattgccgggctcttcactatcttcagttccttcgtcttcagtaccgttgtgattcattttctggacaaggaactcactggcctgaatgaggctctgcctttcttcctgctgctgatcgatctgagtcgagcatccaccctagcgaaatttgcgctgagtagcaattcccaggacgaagtgcgcgagaacattgcaaggggaatggccattctgggcccaactttcactttagatgcattggttgagtgcctggtgatcggagtgggaacaatgtcgggggtgaggcaacttgaaattatgtgttgtttcggctgcatgagcgtgctggccaactacttcgtgttcatgacattctttcccgcctgcgtgagtttggtcctggagctgtccagggagagcagggagggcagacccatctggcagctgagccatttcgcccgtgtcctcgaggaggaagagaacaaacccaaccctgtcacccaacgggtgaagatgattatgtcccttgggctggttctcgttcacgctcatagccgttggatcgccgatccttcgccacaaaatagtacggccgatacaagcaaggtgagcctgggtctcgatgaaaacgttagtaagagaatcgagccatctgtctcattgtggcagttctatctttcaaagatgatcagtatggacatcgagcaagtgatcaccctgagccttgctctcctgcttgccgtgaagtatatctttttcgaacagaccgaaacggaatccaccctctcccttaagaatcctataacttctccagttgtcacccaaaaaaaagtgcctgacaactgctgtcggagggaacctatgttagtccgaaacaatcagaagtgtgatagcgttgaggaggagaccggtatcaatagagaacggaaggttgaagtgattaaaccactggtggcggagactgatacacccaaccgcgccacatttgttgtcgggaactcttcactgctggatactagcagcgtactcgtgactcaggagccggaaatcgagcttcctcgcgaacctaggccaaatgaggaatgtctccagatcctgggcaacgctgagaagggagccaagtttctctccgacgctgagatcatccaattagtcaacgccaaacatattcccgcctataaactggagacccttatggaaactcatgagagaggggtgtcgatcagaaggcagctgctgagtaaaaaattgagtgaaccttcttccctccagtacctcccgtaccgcgactacaattacagtctcgtgatgggagcatgctgcgaaaatgtaatcgggtacatgccaattcctgttggcgtagcaggcccactctgtctggatgaaaaagagttccaagtgcccatggcaactaccgagggctgtctagtggcctcaacaaaccgtggctgtcgcgccattggattggggggcggtgcaagtagcagggtgctggcggatggcatgacacgcggccctgtggttaggctacccagagcctgcgatagcgccgaggtgaaagcatggctggagacctcagagggatttgcggtcatcaaagaggctttcgatagcactagccggttcgcgcgcctccagaagttacacaccagcattgcaggacggaatctatatatacgatttcagtctcggagcggtgatgcaatgggcatgaacatgatctccaaaggcacggagaaagcactctctaaacttcacgaatatttcccagagatgcagatccttgcagtgtccgggaactactgcacagataagaagccagctgccattaattggattgagggcagaggcaagtccgtggtatgtgaggccgtgataccagccaaagttgtgcgagaggtccttaaaacaaccacggaggccatgattgaagtgaatatcaataaaaatctcgtcggatcagctatggcggggtccattggaggttacaacgctcatgcagcaaacatagttactgcaatttacatagcatgcgggcaggacgctgcccagaacgtaggctcctctaattgtattacgctgatggaggcttctgggccaactaacgaagacctttatatatcttgtaccatgcccagcatcgaaattggaactgtcggcggtggaaccaatctcctgccccagcaggcctgcctccagatgctgggagtccagggggcctgtaaggataaccctggggaaaacgcgcgccagttggcaagaattgtttgtggcactgtcatggccggcgaactgtcccttatggccgccctcgcggctgggcacttggtcaagtcacacatgattcacaatcggtccaaaatcaatctgcaagatctccagggagcatgtacaaaaaagacagcctag

SEQ ID NO: 13693 - DNA, 2508 bp, Artificial Sequence
  Description of Artificial Sequence: Synthetic coding sequence
atgctgagtaggctctttaggatgcatggcctgttcgtggcttctcacccttgggaggtgatcgttggaactgtcacactaaccatatgcatgatgagcatgaacatgttcacaggaaacaataagatttgtggctggaattatgagtgccccaaattcgaggaagacgtactttcctccgatataataattctgactattacacgctgcatcgccatcctgtatatctacttccagtttcagaacttgcggcagttgggctcaaagtacatcctcggcattgctgggctttttacgatcttttcctcctttgttttctccacggtggttattcacttcctagacaaagagctcaccggactcaatgaggccttgccattttttctactgttaatcgatctgagccgcgcttccactctcgctaaattcgctctgtccagcaacagccaggacgaagtgagggaaaatatagcccgtgggatggcaattctgggaccaacgtttacgttggacgcgctggtcgagtgtctggtgatcggcgtcgggacgatgtctggcgtgaggcaactagaaatcatgtgctgtttcggctgcatgtcagtgctcgcaaattactttgtcttcatgacctttttccccgcctgcgtctctctggttttggagcttagccgcgagtcgagggaaggtcggcctatttggcagctctcccattttgccagagtactggaagaggaggagaacaagccaaatcctgttactcaacgagtgaagatgataatgtcattgggcctggtcctggtccacgcacattctagatggatcgccgatcccagccctcagaatagcacggccgatacaagcaaggtctcattgggcctggatgagaacgtttccaagaggatcgagccttccgtgagtctgtggcagttttatctgtccaagatgattagcatggacatcgagcaagtgatcactctcagcctggcactgctgctcgctgttaagtacatttttttcgagcagacagagacagagagtactctgtccttgaagaatccaattacctctcccgtggtcacccaaaaaaaggtgccagataactgttgcaggcgggaaccgatgctagtccggaacaaccaaaaatgcgacagcgttgaggaagagacaggcattaatagggagcgcaaggtagaagtgatcaagccgctggttgccgagacagatacccctaaccgggcaacttttgtggttggaaattcctcactcttagatacctcctcagtactcgtgactcaggaaccggagatcgaactgccacgcgagcctcgcccgaacgaggaatgtttgcagatcttagggaatgcggagaagggggccaagttcctttccgacgccgagatcattcaactggtcaacgccaagcacatccccgcttacaagctcgagacactgatggagacacacgaaagaggtgtgtccatccgccgacaactactgtctaagaaactgagcgagccatcatctctgcagtacctcccctatcgcgactacaattatagcctgcttggtggtggagcgagctctcgcgtgctggcagacggtatgaccaggggccctgtggtgaggcttcctcgtgcatgcgattctgcggaggtaaaggcatggctcgagactagtgaagggttcgcagttatcaaggaggcgtttgactctacctctaggttcgcacggctgcagaagcttcacacgagcatcgccggcagaaacctctacatccgctttcagtcccggtcgggcgacgctatggggatgaacatgatcagcaaaggtaccgagaaggccctgagcaaactgcacgagtactttccagagatgcaaattctcgcagtctcgggcaactactgtacagacaagaaaccagctgcaatcaattggatcgaggggcgcggaaagtcagtggtatgtgaagcggtgatcccagccaaagtcgtccgcgaagtgctcaagactacaaccgaggccatgattgaggtgaacatcaataagaatctggtcgggagtgccatggccggctcgatagggggatacaacgctcacgcagctaacattgtgactgcgatttacatcgcctgcggacaggacgccgcccaaaacgtcgggagttcaaactgcattactctcatggaagcatcaggaccaacgaacgaggacctttatatctcttgtaccatgccgagtatagaaatcgggaccgtgggcggggggactaatctgctgcctcaacaggcatgcctgcagatgcttggggttcaaggggcttgtaaggataaccccggcgagaacgcccgacaactggcccgaatagtttgcggtaccgtcatggccggcgagctgtccctgatggccgccctggcggccggccacttagtgaagagccacatgattcataatagaagcaagataaacttacaggacctccagggcgcatgcaccaagaaaactgcatag

SEQ ID NO: 13694 - DNA, 798 bp, Artificial Sequence
  Description of Artificial Sequence: Synthetic coding sequence
atgttatccaggctcttccgaatgcacggcttgtttgttgcatcacacccttgggaggtgatagtgggcactgttacactcacaatctgtatgatgtcaatgaatatgttcaccgagggcaccgaaaaagccttaagtaaactgcacgagtattttccggagatgcagattcttgcggtgagtggaaattattgcacagacaagaaacctgccgccatcaattggattgaggggagagggaagtccgtcgtatgtgaagcagttattcccgctaaggtggtcagggaagtgctgaagacaacaaccgaggcgatgatcgaggtcaacatcaataagaacctggtcggctctgccatggccggatcaatcggaggctacaacgcccacgccgctaatatcgtgacagccatttatatcgcatgcgggcaggatgcagcacagaacgtgggatcgtcgaactgcatcactctgatggaggcgtccggccctactaatgaggacctgtacatatcctgcactatgccatcaattgagatcgggacagttggcggggggactaacctgttaccacagcaggcctgtctccaaatgttgggggtacagggcgcctgcaaagataatcctggggagaacgctcggcaactcgctcgcatagtgtgtggaaccgtgatggctggcgagctcagcctcatggctgcactagcagcagggcatctcgtcaaatctcatatgatccacaacagatctaagataaacctccaggacctccagggtgcatgtaccaagaagaccgcttag

SEQ ID NO: 13695 - DNA, 57 bp, Artificial Sequence
  Description of Artificial Sequence: Synthetic coding sequence
atgctgtcccgccttttccgaatgcatgggctgtttgtggcgtctcatccatggtag

SEQ ID NO: 13696 - DNA, 336 bp, Artificial Sequence
  Description of Artificial Sequence: Synthetic coding sequence
atgctgtcccgactgtttcgcatgcacgggctgtttgtcgccagtcatccctgggaggtgatcgtgggtaccgtaactttaactatttgtatgatgtccatgaacatgttcaccggaaacaacaagatttgcggatggaactatgagtgtccgaaatttgaggaggatgtcctgtccagcgacatcattatacttacgataactcggtgtattgctatcctgtatatctatttccagtttcaaaatctgcgccagctcggctccaagtatattctcggcattgccggcttgtttaccatctttagcagtttcgtattcagcacagtcgtgatttag

SEQ ID NO: 13697 - DNA, 2667 bp, Artificial Sequence
  Description of Artificial Sequence: Synthetic coding sequence
atgctgtcacgcctgttccggatgcacggactctttgtcgcctcccatccttgggaggttatagtcggcaccgttacactgactatctgtatgatgagtatgaacatgtttacagggaacaacaagatatgcggctggaattacgagtgtcctaagtttgaggaagacgttctctcgagtgatatcattatcctgacaattacccgttgcatcgccatcctctatatctatttccagttccagaacctacggcagctcggtagcaagtacattcttggcattgccggactcttcacgatcttctcttccttcgtcttctctacggtcgtgattcattttttagacaaagagttgacaggcttgaatgaagcgcttcccttcttcttactcctcatagacttatcccgggcgagcaccctggcgaagttcgccctcagttcgaacagtcaagacgaagtgagggaaaatatcgccagggggatggccatcctcggccctaccttcacactcgacgccttggtagagtgtctggttatcggagtcggcaccatgtctggagtacgtcagctggaaatcatgtgttgctttgggtgcatgtctgtgctcgctaactactttgtctttatgactttctttccagcatgtgtcagtctggtgctggagctaagtcgggagtctagggagggcaggcccatctggcaactgtcccacttcgcccgcgtgctcgaagaggaggaaaacaagcccaacccagtaacgcagagggtcaagatgattatgtcccttggactggtgctcgtgcatgcccattctcggtggattgctgaccccagccctcagaacagtacagcagacacgtctaaggtgtctctgggcctggacgaaaatgtttcgaaacggatagagccttcagtgtcgttatggcagttctacctcagtaaaatgattagcatggacatcgaacaggtgatcaccctctcattggctctgctgctggcagtgaagtacattttcttcgaacagaccgagacagaatcaactttgtctctgaagaacccaatcactagtccagtcgtgacccagaagaaggtccccgataattgctgtcgtagggaacctatgctggtcaggaacaaccagaaatgtgattctgtagaagaagagacaggcatcaatagagagaggaaagtggaggtcataaaacctctcgtggccgagactgacacccccaatcgggccaccttcgtggtcgggaattcctctttgcttgataccagttccgttctggtcacccaagagccagagatcgagcttccaagggaacctcgcccaaacgaggaatgtttgcaaatcctgggaaacgcagaaaagggggctaaattcctctctgatgctgaaattattcagctggtcaatgcgaagcacattcccgcctataaactggagacccttatggaaacacatgagaggggtgtgtcaatccggagacaactgctcagtaagaaactttccgaaccctcttccctgcaatacctgccctaccgtgactataactactcactcgtcatgggtgcttgctgtgagaatgtgatcggatacatgccaatccccgttggagtagcaggcccgctgtgtctagacgaaaaagaatttcaggtgcctatggcgacaactgaaggctgcctagtggcctccaccaatagaggctgccgagccataggtctaggagggggagcaagttctcgggtcctcgctgacggcatgaccagaggacccgtagtccgcctccccagggcctgcgacagtgcagaagttaaagcttggcttgaaacatccgagggatttgctgtcatcaaagaggcattcgattcaaccagcaggttcgcacggttgcaaaaacttcacaccagcatagctggacgaaacctttatatccgcttccagagccgtagcggggatgcaatgggtatgaatatgatctctaagggtaccgaaaaagctctgtctaagctccatgagtattttcccgaaatgcagatcttggctgtgtccggcaattattgtacagataagaagccagcagcaattaattggatcgaggggcgcgggaagagcgttgtctgcgaagctgtgatccccgcgaaagtggtgagagaagtgctgaaaactacaacggaggccatgattgaggttaacattaacaaaaatcttgtaggaagcgccatggcgggaagtatagggggttataatgctcatgcagctaatattgtaacagcaatttacatcgcttgcggccaagatgccgcccagaacgttggatctagcaattgcattacactaatggaggcctcaggcccaacgaacgaggatctgtacatctcatgtactatgccctctattgaaattggaaccgtgggtggcggcacaaacctgctgcctcaacaggcctgtttgcagatgttaggagtgcagggtgcttgcaaagacaacccaggcgaaaatgcccgccagctcgctcgaatcgtatgcgggactgtgatggcgggagagctctctctcatggcagccctggcagccggacatctggttaagtcccatatgatccacaatcggagtaaaataaacctccaggatttgcagggtgcatgtaccaagaagactgcctag

SEQ ID NO: 13698 - DNA, 2460 bp, Artificial Sequence
  Description of Artificial Sequence: Synthetic coding sequence
atgcatagccatccggtctacctcctacctgtgcctgaatttacaagcacatggatcaagatatatttcggctactgttggccctttcacaactttctgaagttctgcatccaatattcatgtcactctctcctgagacagaggatagataggttggaagaagctctgcccttctttctgctattaatcgacttgtcacgggctagtaccttagccaagtttgcactcagctcgaactcacaggatgaagtcagggagaatatcgcccgggggatggccatcttgggtcctacctttactcttgatgccctggtcgagtgcctggttatcggagtaggtactatgtctggggtgcgacagctcgagattatgtgctgcttcgggtgtatgagcgttctcgccaactactttgtgttcatgaccttttttcccgcctgtgtctcattggtgctggaactgtcacgggaaagccgggagggacggcctatctggcaattgagccacttcgctagggtcctggaagaagaggagaacaagcctaatccggtcacacagagagtgaagatgattatgagcctcggtctggtactggtgcacgctcatagtagatggatcgccgacccgtctccccagaacagtactgcggacacctctaaagtcagcctggggctggatgaaaatgtgtcaaaaaggatcgagcctagtgtgtctctctggcagttttatctctctaaaatgattagtatggatattgagcaggtaatcacactaagtttggcattacttctcgctgtgaagtacatctttttcgaacagaccgagactgagtcaacgctatctctcaagaatccgatcactagccccgtagtgacccagaaaaaagtgcccgacaactgttgtagaagggagccaatgttagtgagaaacaaccaaaagtgtgacagtgttgaagaagagactggaatcaatcgggagagaaaggtggaggtgattaaaccattagtagcagaaacggatacgcctaaccgggccacgttcgtcgtcggaaactctagccttctggacacatcctccgtcctagtaacccaggagcctgaaatcgagctgccccgggagccacgccccaacgaggagtgtctgcaaattttgggaaatgcagaaaagggggcaaagtttctctccgatgcagagataatccagcttgtcaacgcgaagcatatccccgcttacaaactggagacactcatggagacacatgagagaggagtatccatcaggcgtcagctcctgtccaagaaactgagcgaaccctcgagcttgcagtaccttccctaccgtgactataactacagcctggtgatgggggcgtgttgcgaaaacgtgattgggtacatgccaattcccgtgggcgtagccggacccctctgtttggatgagaaggaatttcaggtccccatggctaccactgaagggtgtctggtggcatccacaaaccggggctgccgtgcaataggacttgggggtggggcaagtagccgagtgctggccgacgggatgacccgaggcccggtggtgcggctgcctcgcgcctgcgatagtgcagaagtaaaagcatggctcgaaacaagtgagggattcgccgtgatcaaggaagccttcgacagtacttctcggtttgctagacttcagaaactccacactagcattgcaggcagaaatctgtacatccggttccagtcccggagcggagatgcaatgggcatgaatatgatttctaaagggaccgagaaagccctgtccaagcttcatgagtacttcccagaaatgcagattctggccgtgtctggcaactactgcacagataaaaagcccgcggccataaactggattgagggaagagggaaaagcgtggtgtgcgaagccgttataccagccaaagttgtgagggaagtgctaaaaaccaccacggaagctatgattgaggtgaacataaataagaatctggtggggtctgctatggctggttcaataggaggctacaacgcccacgcagccaacatcgtgacggcgatatacatagcttgtggtcaggacgccgctcagaacgttggatccagtaattgtatcacattaatggaggcttcaggccctacaaacgaggacctctacatttcgtgtacaatgccctctattgagattggaacagttggaggggggactaacttacttccccagcaggcgtgcctgcagatgcttggggttcagggggcctgtaaggataaccccggcgaaaacgcacggcagcttgccaggattgtgtgcggcacagtcatggctggcgagctgagtctgatggctgctctggcagcaggccatctcgtgaagtcacatatgattcacaaccggagcaaaatcaacctccaggatcttcagggagcatgcacaaagaaaacggcctag

SEQ ID NO: 13699 - DNA, 1671 bp, Artificial Sequence
  Description of Artificial Sequence: Synthetic coding sequence
atggcccgcaccacctctcagctgtacgatgcggtgcccattcagagctccgtggtactttgtagttgtccaagcccatctatggtgagaactcagactgagtcttccactcctccagggattcctggtgggtctcgtcaaggccctgccatggacggcacggccgcagagcctaggcctggcgctggaagtctgcaacatgcccagcctccacctcaaccaagaaagaaacgacccgaggatttcaaatttggtaagatactcggtgagggctcgttcagcactgtcgttctcgctcgcgagcttgccacatcccgagaatacgccatcaagatactggaaaagaggcacatcataaaagagaataaagtaccttacgtaacacgcgaaagggacgtcatgtccagactggaccaccccttcttcgtgaaactgtatttcaccttccaagatgacgagaagttatactttggcctgtcctatgctaagaacggcgaacttctcaaatatatccgcaaaatcgggagctttgatgaaacttgcacccgattctataccgccgaaatagtgagtgcgctggagtacctccatggaaaggggatcattcaccgtgatttgaaaccggagaacattctgctcaacgaagacatgcatatccagatcacagactttggcaccgccaaggtgctcagtccggaaagtaagcaggcgcgggctaatagttttgtggggacagcacagtacgtgtctcctgaactattgactgagaagtcggcctgtaaaagcagcgatttgtgggccctcggttgcattatttaccaactggtggctggcctgccaccctttagggccgggaatgaataccttatattccagaagatcattaagctggaatacgatttcccagagaagttctttcctaaggctagagatctcgtggagaagctcctcgtgttagacgccactaagagattgggatgtgaggagatggaagggtacggccccttgaaggcacacccctttttcgaaagtgtaacgtgggaaaacctgcatcagcagacacctcccaagctgactgcctatctgcccgcaatgtcagaggatgacgaggattgttacggcaactacgacaatctgctcagccagtttgggtgtatgcaggtgagtagctccagctcctcccactccctgagtgccagtgacaccgggctgccccagcgatcaggctcgaacatcgagcaatacatccacgacctggactcgaactcttttgagctcgacttgcagttcagtgaggatgagaaacggttgctgctggagaaacaggcaggaggaaacccttggcatcagtttgttgaaaacaatcttatactgaaaatgggaccagtcgacaagcgtaagggcttatttgcccggcgcaggcagctcttactgacggaaggtccccacttgtactacgtggatcctgtgaataaagtcttgaagggtgaaattccatggtcacaagaactgcgcccagaagcaaagaacttcaaaacatttttcgtgcatacccccaaccggacatactatctgatggaccctagtggcaacgcacataagtggtgcagaaagattcaggaagtatggcggcagagatatcagagccatcctgatgccgcggtgcagtag

SEQ ID NO: 13700 - DNA, 1599 bp, Artificial Sequence
  Description of Artificial Sequence: Synthetic coding sequence
atggcccggacgaccagccagttgtatgacgccgtccccatccaaagtagcgtggtgctttgctcttgccccagtccctcaatggtgcgaactcagaccgagtcatccacccctcctggcatcccaggcggatcccgccaagggcccgctatggacggaaccgccgctgagccacgcccaggggctgggtcgctccagcatgcccagccccctccccagccaagaaagaagaggccagaagatttcaaatttgggaaaatcctaggtgaagggagtttttctaccgtggtgctggcaagggagctcgctacttcaagggaatacgctatcaagatactggagaagaggcacatcatcaaagagaacaaagtcccatacgtcacaagggagcgagacgtgatgagcaggctggaccacccgttcttcgtgaaactgtacttcactttccaggacgacgagaagctgtacttcgggttgagctatgccaaaaatggggagctcttaaagtatatccgtaagatcggatcgtttgacgagacctgtacgcgcttttacaccgcagagatcgtgagcgcccttgagtacttgcacgggaagggcattattcatcgagacttaaaacccgaaaatatcctgttgaatgaggatatgcacatccaaattaccgattttgggacagcaaaagtgctgtctcccgaatcaaaacagggggtctctgatctatgggcacttgggtgcataatctatcagctcgtcgcgggccttccaccatttagagcagggaacgaatacttgatttttcaaaaaatcatcaagctcgaatacgatttcccggagaagtttttccccaaggctagagacctggtagaaaaactcttggtgctcgacgccaccaaacggctgggctgtgaggagatggagggttacggacccctcaaagcgcacccattctttgagtcagtgacatgggagaatcttcaccagcagacgccgccgaagcttacagcttacctgccagcaatgagtgaagacgatgaggattgttatggaaattacgataatctgctgagccagttcgggtgcatgcaggtgtcgagttcatccagctcacattctctcagcgctagcgataccggcctaccacagcggtcaggttctaacatcgagcaatacattcatgatttagactcaaactcatttgagttggacctgcagttctctgaggacgaaaaacgacttctactggagaagcaagccggtggaaatccctggcatcaattcgtagagaacaatctgatccttaagatggggcctgtggataagcggaaaggcttattcgccagaaggagacaactattgctgactgagggtccccacttgtattacgtggacccagttaacaaagtgctcaagggggagatcccatggtctcaagaacttcggcccgaggcaaagaactttaaaacttttttcgttcacacgcctaataggacatactaccttatggatccatcgggcaacgctcataaatggtgtcgcaagatacaggaagtgtggcgtcagcgttaccagagccatcctgacgccgccgttcagtag

SEQ ID NO: 13701 - DNA, 1479 bp, Artificial Sequence
  Description of Artificial Sequence: Synthetic coding sequence
cgtgcgcaggacgagggcggccactgctggggctccgcctccggccgacgaacactgcgcagacgtcgcgccgcacagaggtgcggtggaggggcaagggccgacgccggaccaatggcgaggaccaccagtcaactgtacgacgcggttcccatacagagtagcgtggttctgtgctcctgcccttcacctagcatggttcggacacaaacagagagctcaacgcctccagggatccccggcggtagtcgccagggaccagccatggacgggacagccgcagaaccacggcccggcgctggcagcctgcagcatgcgcagcctccccctcaacctcgcaagaaaaggccagaggacttcaagtttggcaaaatcttgggagagggctccttttctacagttgttctcgctcgggagctggccacctcaagggagtatgcgattaaaattttagaaaaacgacatattattaaggagaacaaggtgccctatgtcacaagagagcgcgatgtcatgtctcggttggaccatcctttcttcgttaaactctactttacctttcaagatgatgaaaaactgtacttcggtctgtcctatgccaagaacggtgagctcctgaaatatatacgcaagatcggaagtttcgatgagacctgtacaaggttttacactgccgagatcgtgtcagcgctggagtacttgcatggaaaggggatcattcatcgggacctgaagccagagaatatcctccttaatgaggacatgcatatacagatcacggacttcgggactgcaaaagtcctgtcgcctgaaagcaagcaggcacgcgccaatagcttcgttggtacagctcaatacgttagcccagagcttttaactgaaaaatctgcatgcaaatcgtccgacttatgggctctgggatgcattatctatcagctggtggctggattaccacctttcagagcaggcaacgagtatctcattttccagaagattataaaactggaatacgactttcccgaaaagttctttccaaaagctcgtgatcttgttgagaaattactcgtgctggacgcgaccaagagactcggttgcgaggaaatggaagggtacggccccctgaaagctcaccccttcttcgagtcggtgacctgggagaacctgcaccagcagacacctcccaagttgaccgcctatctaccagccatgtctgaggatgatgaggactgttatggtaactacgacaacctgcttagtcagttcggttgtatgcaggtgtcttcttcatcaagctcccactccctttccgcctccgacactggactcccccaaagatcgggaagcaacattgaacagtatatccacgacttggacagcaacagcttcgaactcgacttgcaattctccgaggacgaaaagcggctcctgctagagaaacaggcgggagggaacccttgtctgacggggcgcattatttag

SEQ ID NO: 13702 - DNA, 1290 bp, Artificial Sequence
  Description of Artificial Sequence: Synthetic coding sequence
atggccagaaccacatcccagctgtatgatgccgttcctatccagtcaagcgtggtgttgtgctcctgcccaagtccatcaatggtgagaactcagacagagagtagcacgccccccgggatacccggcggctccagacagggacccgcaatggacggcaccgccgccgagcccaggccgggagccggctctctgcaacacgcacagccccctccccagcctcgtaagaagcgccctgaggacttcaaatttggtaagatcctgggcgagggatccttttctaccgtagtcctcgcgcgtgagcttgccacaagccgcgaatacgcaactagggctaattccttcgtaggtaccgcgcagtacgtgtcacctgaactgctgaccgaaaagtctgcttgtaaaagttccgatctgtgggcattaggctgcataatttatcagctagttgctggcctgccccccttcagggccgggaacgagtatctgattttccaaaaaatcatcaagctagaatacgacttccctgaaaaattttttccgaaggctagagatctggtagagaaactcctggtactagacgctaccaagagattggggtgcgaggagatggagggctatggtcccttgaaggcacaccctttcttcgagagtgttacatgggagaacctgcatcagcaaacaccacccaagttgaccgcctatttgccagccatgagcgaggacgatgaagattgttatggcaattacgataatttattgtctcaattcggatgcatgcaggtgtcttcgtcatcttctagccattcactgagtgctagcgacaccgggctgccccagcggagtggctccaacatcgagcagtatatccacgacttagattctaattcttttgaactggaccttcagtttagcgaagacgaaaagcgcttgctgcttgagaagcaagccgggggcaacccatggcaccagttcgtcgaaaacaacctgatcctgaagatgggccctgtcgacaagcgcaagggcctttttgctagacgccgccagctgctgttgacagagggtcctcatctttactatgtggatcccgtaaataaggtgcttaaaggggagattccttggtcgcaggagctgcggcctgaagccaagaatttcaagacatttttcgtgcatacacccaatagaacctactatctgatggatccaagcgggaacgctcataagtggtgtcgtaagatccaggaagtctggcgccagaggtaccagtcccacccagatgctgccgtgcagtag

SEQ ID NO: 13703 - DNA, 5121 bp, Artificial Sequence
  Description of Artificial Sequence: Synthetic coding sequence
atgggcgtgccgaagttttatagatggatcagtgagcggtacccttgtctctctgaagtggtaaaggaacaccagattcccgaatttgataacctctatctggacatgaacggtataatccaccagtgttcccatccaaatgacgacgacgtgcattttcgcatctcagatgacaaaattttcaccgatattttccattacctagaagttttattccgaataataaaaccaaggaaagtgttctttatggcggtggacggagtggccccacgcgcaaagatgaaccaacaacggggccggaggtttagatctgccaaagaagctgaggacaagattaaaaaggccatcgagaagggggagaccctccccactgaagctcgttttgattcgaactgtattaccccgggcaccgaattcatggcaaggctgcacgagcacctcaagtatttcgtgaacatgaagatttctacagacaagtcttggcagggcgtgaccatctacttttccggccacgagacgccaggagagggtgagcacaaaatcatggaattcatccggtctgagaaagccaagcccgaccacgatcctaacacacggcactgcctatacggccttgatgctgacctgattatgctgggactgacttctcatgaggctcatttctctctcctgagagaggaggtaaggttcggcgggaagaagactcagagggtgtgtgcccctgaagagaccactttccatttactgcatctgtctctgatgagggaatacattgattacgaattctctgtgcttaaggagaagattaccttcaagtacgacatcgaacgtataatcgatgattggatcttgatggggttcctcgtcggaaatgactttatcccgcatcttccccatctccacataaaccatgacgcactgcctctactttacggtacttacgtgactatactacccgagttggggggatatattaatgaatcagggcatcttaatctgccccggtttgagaaatacctcgtaaaactgagcgattttgacagggagcacttcagtgaagtttttgtcgatcttaaatggttcgagtctaaggtgggaaacaagtatcttaacgaggctgcaggcgtggctgccgaagaagctcgtaactataaggagaagaagaaactcaagggccaggagaattcattatgctggactgcgttagataaaaacgagggcgaaatgatcactagtaaagacaatctggaggatgagaccgaggacgatgatctttttgaaactgagtttcggcaatataaaaggacttactatatgacaaaaatgggagtggacgtggtaagcgatgactttttggctgaccaggccgcatgctacgtacaagcaatccagtggatcctgcactattattatcacggcgttcaatcctggtcttggtattacccctaccattacgcaccatttctctccgacatacataatatctctaccttgaagattcatttcgagctaggaaagccgtttaaaccattcgagcagttactagcagtcctgccagcagcaagcaaaaatcttctgcccgcttgttaccagcaccttatgacaaacgaggacagccctatcatagagtactacccgcctgacttcaagaccgatctcaatggaaagcagcaggaatgggaggctgtcgttctgataccctttattgatgagaaacggttgctggaagccatggagacttgcaaccactccctaaagaaagaggagcgcaaacgaaatcagcactccgagtgcctgatgtgctggtacgatcgagacactgagttcatctatccaagcccatggcctgagaaattcccagctattgaacgctgttgtacaaggtataagatcatcagtctggacgcttggcgggtcgacataaacaagaacaagatcacaagaatcgaccagaaggccctgtatttttgtggattcccaacgctcaaacacatcaggcacaagttctttctgaagaagagcggtgtgcaggttttccagcagagtagcagaggcgagaacatgatgctcgagatccttgtcgatgcggagtcagacgagttaacagtcgaaaatgttgctagttctgtgttaggtaagtctgtgtttgttaactggccccacctggaagaagcccgtgtcgtcgccgttagtgatggtgagacgaaattctacttggaagagccaccggggacccaaaaattgtactcggggaggacagcccctcctagtaaggtcgttcacttgggtgataaggagcagagtaactgggcaaaggaagtccaggggatatcagagcactatttgcgacgcaagggaataataatcaatgaaacgtcagcagttgtgtacgcacagcttttaactggcagaaagtaccagatcaatcaaaatggagaggtccggttagaaaaacagtggtccaagcaagtagtgccattcgtgtatcaaacgatcgtcaaggacatccgagccttcgatagtaggtttagcaacataaagacattggacgatcttttcccccttcgctcaatggtctttatgctggggactccttattacggctgcacgggggaggtgcaagactctggggatgtcatcacagaagggcgtatcagagtcattttttcaattccttgtgagcctaacctcgacgctctgattcagaatcagcataagtactctattaaatacaatccaggatacgtacttgcatccaggctgggggtctcgggctatctggtttctaggtttacaggttctattttcattggccgaggatccaggcggaatccccatggggatcacaaagcaaatgtaggcctgaatttaaagttcaacaaaaaaaatgaggaagtgcctgggtacacgaagaaagtgggcagcgaatggatgtatagcagtgccgcagaacagctgctcgcagagtatctggaacgggcccccgaattgttcagttacatagcaaaaaactcacaggaagatgtcttttatgaggacgacatctggccgggcgagaacgagaatggcgccgaaaaggtgcaggaaatcataacatggttgaaagggcacccggtgtcgacactgagccgatcctcttgcgatctgcagatcctggatgccgccatcgtggagaaaatagaggaagaagtggaaaagtgtaaacagcgcaaaaataacaaaaaggttcgagtcactgttaagccccatctgctctaccggccccttgagcaacaacacggagttatccccgatagagatgcagaattctgcttgtttgatcgggtggttaatgtgcgggagaatttcagtgtgccagtgggtctgcgaggaaccattattgggattaagggcgcaaatcgggaagcagacgtgctgttcgaagtgctattcgacgaagagtttcccggaggcctgacaatcagatgtagtcccgggaggggctataggttacccaccagcgcgctcgtaaacctatctcacgggagccggagtgagaccggcaaccagaaactcaccgccattgttaagccacagcctgcggtgcaccagcacagttcaagtagctctgtctcctcaggccatttaggcgccctaaatcactccccccagtccctctttgtaccaacacaggtccctacaaaggatgacgatgaattttgtaatatatggcagtcattacagggctcaggaaaaatgcagtatttccagcccaccatccaggaaaaaggagctgtcttgccccaggagatttcccaggtgaatcagcatcacaaatcaggctttaacgacaatagtgttaaataccaacaaaggaaacacgacccccatcgaaaatttaaagaagaatgtaaatctcctaaggcagaatgttggagccaaaagatgtctaataagcagcctaacagcgggattgaaaatttcctcgcctctctcaacatttctaaagaaaacgaggtgcagtcctctcatcatggggaaccccctagcgaagaacatctgtcccctcagagcttcgcgatgggtacccggatgctcaaggagatattaaaaatcgatggttctaacaccgtcgaccacaagaatgagattaaacagatcgccaacgagatcccagtcagctccaatcgacgggatgagtatggcctgccctctcagccaaaacagaacaaaaagctggcctcctacatgaacaaacctcactccgcgaatgaatatcataacgttcaatctatggacaatatgtgttggcccgcacctagccaaatccctcccgtgagcaccccggtgacggagctctccaggatctgctccctggtggggatgccgcagccagatttctcattccttcgaatgcctcagaccatgaccgtgtgccaggtcaaacttagcaacgggctcctcgtccacggcccccagtgccacagtgagaacgaagccaaagaaaaagctgccttattcgcacttcagcaacttgggagcctgggcatgaatttccctcttccgtcacaagttttcgccaattacccaagtgcagtgcctcctggcacaatcccaccggcttttcctcctccgaccggatgggatcactacggcagcaactatgccctcggggccgccaacattatgccctctagtagccacctgttcggctccatgccatggggaccaagtgtgccagtaccaggcaagcccttccatcacacattgtattctggtaccatgcccatggccgggggtattcccgggggggtgcataatcagtttatcccgttgcaagtgacaaaaaagcgcgtcgcgaacaagaaaaattttgagaacaaggaagcacaatcctctcaggcaacacccgtccagacctcacagcctgattcctcgaacatcgtgaaggtgagtccccgcgagtcaagcagcgcttcgcttaagtcctcgcccattgcccaacctgcatctagtttccaagtggaaaccgccagccaaggtcatagcatcagccaccataagagcactcccatcagctcgtctcgaagaaagtctcggaaactggctgtcaatttcggtgtgtctaaaccgagcgaatag

SEQ ID NO: 13704 - DNA, 5085 bp, Artificial Sequence
  Description of Artificial Sequence: Synthetic coding sequence
atgggcgtccctaagttttatcgatggatctccgaaagatatccatgtctcagtgaggtggtgaaggagcatcagattcccgagttcgataacctgtatttagatatgaacgggataatacaccagtgttcccacccaaacgatgatgatgtccactttcggattagtgatgacaaaatcttcacagacatttttcattatctcgaagtgctctttcggattatcaaaccaagaaaagtgttctttatggccgttgatggagtagccccccgagccaagatgaatcagcagcgcggaagacgctttagatccgctaaagaagctgaagataaaataaaaaaggccatcgagaaaggtgagacgctgcccaccgaggccaggtttgacagcaactgtattacgccgggcaccgaattcatggccaggctgcacgaacacctcaagtacttcgtaaacatgaaaatctctacagacaagtcgtggcagggcgtgaccatctatttctcgggacatgagactcccggagaaggtgaacataagattatggaatttataagatccgaaaaagccaagcctgatcatgatcctaacacaaggcactgtctgtacggccttgatgctgacttgatcatgctgggcttgacaagtcatgaagcccacttctctcttcttcgtgaagaggtgagattcggaggcaagaaaacacagcgggtgtgcgcccccgaggaaacgacattccacctgctccacctgagcctcatgagagagtacatcgattacgagttttctgtgcttaaagaaaagattacatttaagtacgatattgaaaggatcatcgacgactggattctgatgggcttccttgtgggcaacgacttcatcccccatcttcctcatttgcatattaaccatgacgccttgccgctgctatacggaacgtacgttacaatcctgcctgaattaggcgggtatatcaacgaaagcggccaccttaatctgccccggttcgagaaatatttggtcaagctgtctgacttcgaccgcgaacacttctcggaagtcttcgttgatctaaaatggttcgagtccaaagtgggcaataagtacctcaacgaggccgcgggggtggccgcagaggaagcaaggaactataaggagaagaagaagctgaaaggccaggaaaactctctttgttggacagcattggacaaaaacgagggggaaatgattacctctaaggacaacttggaggacgagaccgaagacgacgacctgttcgagacggaattccgccagtacaagcgcacctattacatgactaagatgggggtagatgttgtgtcggatgacttcctggcggatcaagcagcctgttatgtccaagccatacagtggatcctccattactattatcatggagtacagtcttggtcctggtattatccataccactacgccccgtttctgtccgatattcacaacattagtacactgaagatccacttcgagctgggcaagccatttaaaccatttgaacagcttctggctgtattacctgcggctagcaagaacctcctgccagcctgctaccagcacctgatgacaaatgaggactctcctattattgagtattacccgccagattttaagacagacttaaatggtaagcaacaggagtgggaggctgtagttctcattccgttcatcgacgagaaacggcttcttgaggcaatggagacctgcaatcattccctgaagaaagaagagcgtaaacgcaatcagcattctgagtgcttgatgtgctggtatgaccgggacactgaatttatctaccccagtccctggcctgagaagttccctgcaattgagcgatgctgcacacgatataagatcatcagcttggacgcatggcgcgtggacatcaacaagaataagattacacggatcgatcagaaagcgctgtacttttgcggctttcccacacttaaacacattagacataaattttttcttaaaaagagcggggtgcaggtattccagcagtcttcacgtggcgaaaacatgatgcttgagattctagttgacgccgagtcagatgagctgaccgttgagaacgtagccagtagcgtcctagggaagagcgtgttcgtgaattggccgcacctggaggaggcccgcgtggtagcagtgtccgacggagaaactaagttctatctggaggagccacctgggacacagaaactctattcaggacggacagcaccgcccagcaaagtagtgcaccttggcgataaagagcagtcgaactgggccaaggaagtccagggtatttctgaacactacctacgtagaaaaggaattatcatcaatgaaaccagtgctgtcgtgtatgcccagttgcttacgggccgcaaatatcagatcaaccagaacggcgaagttcgcttagagaaacagtggagcaagcaggtggtgccattcgtctaccagaccatcgtgaaggatatccgcgccttcgacagccgcttcagcaatattaaaactctggatgacctttttccgttgagatcgatggtgtttatgttaggcacaccttactacggctgtactggcgaggttcaggactctggcgatgtcatcactgaggggagaattcgagtgatatttagcatcccgtgcgaacctaaccttgacgccctcatccaaaatcaacataagtatagcattaaatataacccaggctatgtactagcctcaagattaggggtgtccggctacctggtatcccggttcacaggatctatcttcataggcaggggtagtcggaggaatcctcacggggaccacaaagccaatgtgggcctgaaccttaaattcaataagaaaaacgaagaggtgcccggttacacaaagaaggtgggcagcgaatggatgtactcaagtgccgccgaacaattgctggccgagtaccttgaacgagcccccgagctcttcagttatattgcgaagaattctcaggaagatgtgttttatgaagatgatatttggcctggagagaacgagaatggcgccgagaaggttcaggagatcattacatggcttaaaggacaccccgtctccacactgtcgagatcatcctgtgacctccagatcctggatgctgcgattgtagaaaaaatagaagaagaagtcgagaagtgtaagcagcgcaaaaataacaaaaaagtcagagttaccgttaagccccacttattgtatcgacctctggagcaacagcatggtgtgatcccggatagagacgccgagttctgtcttttcgatcgagtcgtgaacgtgcgggaaaacttctccgtgcccgtaggcctacggggaaccatcataggaatcaaaggagccaaccgcgaggccgacgtcctgtttgaggtgttatttgacgaggagtttccgggaggtctgacgatacgctgctcacccgggaggggttacagactgccaacatcagccctggtgaaccttagccatggcagtcggagtgagactgggaaccagaagctgacagccattgttaaacctcaacctgctgttcaccagcacagtagttcttcatctgttagttctggtcatctgggcgctttgaaccactccccccaaagtctcttcgtgcctacccaggtgcctacaaaggatgatgacgaattctgcaatatttggcagtcattgcagggatcagggaaaatgcagtacttccagccaacaatccaagagaagggtgccgttctcccacaggagatttcgcaggtcaatcaacaccacaaatcaggcttcaacgataattctgtcaaatatcagcagagaaagcacgatccacaccgcaagtttaaggaagagtgcaagagccctaaggccgagtgttggagccaaaagatgagcaacaagcaacctaattctgggatcgaaaatttcctcgcctccttgaatatatcaaaggagaacgaagtgcagtcatcccatcacggagagccccccagtgaggaacatcttagcccgcagagcttcgctatgaagggtactcgcatgctgaaggagattctgaaaattgatggatccaatactgttgatcacaagaatgagattaagcagattgcgaatgagattccagtcagttcgaatagacgggacgaatatggtctgccttctcagcctaagcaaaataagaagctggcgtcttatatgaataagcctcactctgccaacgaatatcataacgtgcagagcatggataatatgtgctggcccgcccccagccaaatccctcccgtatccacacccgtcacagagctcagcagaatatgtagcctcgtggggatgccccagccggatttttcattcctgcgcatgccacagaccatgaccgtgtgccaggttaaactgtcgaatggcctgttggtgcatggaccccagtgtcactccgaaaatgaggccaaagaaaaagccgcgctttttgccctgcaacaattgggatcattaggaatgaattttccacttccctctcaggtgttcgccaactatccttccgctgtgcctcccggcactatccctcctgcgttccctccgcccacagccaatatcatgccatcttcttcacatctctttggctctatgccctggggcccatctgtacctgtgcctgggaagccattccaccacacactgtattcaggtactatgcctatggctggtggcattcctggtggagtgcacaaccagttcatcccattgcaggtcacaaagaaacgggtggcaaataaaaagaacttcgaaaataaagaggcccagagcagtcaagccactcctgtgcagacatcacaaccagacagtagcaacatcgtcaaagtgtcaccccgcgagtcctctagtgcaagcctgaagtcctccccaattgctcagccggctagctcatttcaagttgaaaccgcgtctcagggacattcaatctcccatcacaagtctactccgatttcaagcagtcggcggaagagtaggaagctggcagtgaacttcggcgtgtcaaagcctagtgaatag

SEQ ID NO: 13705 - DNA, 1380 bp, Artificial Sequence
  Description of Artificial Sequence: Synthetic coding sequence
atgggcgtaccaaagttttacagatggatcagtgaaaggtacccttgtctgtccgaggtggtgaaagaacaccaaatacccgaattcgataacctttatttagatatgaacggtatcatccatcagtgcagtcaccccaacgacgacgacgtgcactttagaatctctgacgacaaaatcttcactgatatcttccactacctggaagtactgtttcgcattataaagcctagaaaggtgttctttatggcggttgacggggttgctccccgagcgaaaatgaaccagcagagaggtcggcgattccgttccgccaaggaagcagaagataaaataaaaaaggccattgaaaaaggtgagaccctgcccaccgaggctagatttgattctaattgtatcaccccagggacggagttcatggctcgactgcatgaacaccttaagtattttgtcaatatgaagatcagcacagacaagtcttggcaaggggttaccatatatttcagcggccacgagacaccaggagagggagaacacaagattatggagtttatcagatcagaaaaagcgaaacccgatcacgatccgaacacaaggcactgcctgtacgggctggatgccgacctgattatgctgggactaacctctcacgaggcacacttcagccttctgcgcgaggaagtgcgctttgggggaaagaagacccagcgagtatgcgcaccagaagaaacaacctttcaccttctgcatctcagccttatgcgcgaatacatagactacgagttctctgtcctgaaggagaaaatcacatttaagtatgatattgaacgcattatcgacgactggattttgatgggctttctggtgggcaatgactttatccctcatctccctcatctgcatattaatcacgatgcgctgccgcttctgtacggcacctatgtgacaattttgccagagcttggaggctatatcaatgagagcggacaccttaaccttccacgctttgaaaagtacctcgtgaagttgagcgattttgaccgagagcattttagcgaggtatttgtcgatctgaagtggttcgaaagcaaagtggggaacaagtatctgaacgaggccgcgggcgtggccgctgaagaggctagaaattacaaggagaagaaaaagcttaaaggccaggaaaactccctgtgctggacggcactggacaaaaatgagggcgagatgataacaagtaaggataacctggaagacgaaacagaagacgacgatctgttcgaaacagagtttcgacagtataagagaacgtattatatgaccaaaatgggcgtagatgtggtcagcgagtatgtatttgcaaatgcgttcatcctaaagtag

SEQ ID NO: 13706 - DNA, 750 bp, Artificial Sequence
  Description of Artificial Sequence: Synthetic coding sequence
atgctcggcttgacatcccatgaagctcacttctctttactccgcgaggaggttaggttcggagggaaaaaaacacagagagtttgtgcacccgaggagacaaccttccacttgttgcatctcagcttgatgagagagtatatcgattacgaatttagcgtgctgaaggagaagatcacatttaagtatgacatagaacgtatcattgatgactggatcttaatgggctttttggtcggaaatgatttcatcccccacctcccgcatcttcacatcaatcacgatgctttacctttgctgtacgggacatacgtgactattttgcccgagctcggcgggtatattaatgagagcggtcacttgaaccttccccgcttcgaaaaatatctggtcaaactatccgactttgaccgcgagcacttcagtgaggtctttgttgacttaaagtggtttgaatccaaagtgggcaataaatatctgaacgaggctgctggcgtggccgctgaggaggctaggaattacaaggagaagaagaagctgaaagggcaggagaattccctgtgttggaccgcccttgacaaaaatgaaggcgaaatgatcacgtctaaagataatttggaggatgaaacagaggacgatgatctattcgagactgaatttagacagtacaaacggacttattacatgaccaagatgggcgtagacgtggtatccgaatacgtctttgcaaacgctttcatcctgaaatag

SEQ ID NO: 13707 - DNA, 3483 bp, Artificial Sequence
  Description of Artificial Sequence: Synthetic coding sequence
tagacaaatgaggactcccccataattgagtactacccccccgacttcaagacagacctcaacggcaagcagcaggagtgggaagccgtcgtgctgattcctttcatcgacgaaaggttactggaggctatggagacctgtaatcactcactaaagaaagaagagagaaaaaggaaccagcatagtgaatgcttgatgtgttggtacgacagggacaccgagtttatataccctagtccatggccagaaaagtttccagcgatcgagagatgctgcactaggtataagatcatctccctggacgcctggcgggtcgatattaataagaacaaaatcaccagaattgaccagaaagcactctatttctgcggattcccaacactgaaacatatcagacacaaatttttcttgaagaaatctggcgtgcaagttttccagcagtcctcccgcggagagaatatgatgctggaaatcctggtcgacgcagagtcagatgagctcacggtcgaaaatgtggcatctagtgtgctcgggaaaagtgtctttgtgaactggccgcatcttgaggaggcaagagtagtcgccgtcagcgatggggagaccaaattttatctggaggagcctcccgggactcagaaactttattccggtcggactgcacccccttctaaggtggtgcacctgggcgataaagagcaatcaaactgggccaaagaggtgcaaggaatctctgagcattacctgcgccggaaggggatcattatcaatgagacctcagccgtcgtctacgctcagttgctgacgggtcgaaagtaccaaatcaatcagaacggggaagtccgactggagaaacaatggtcaaaacaagtggtccccttcgtatatcagacaattgtgaaggatatccgtgcttttgactcccgcttctctaatattaagaccctggacgacttattcccccttagatccatggtgttcatgctcggcaccccgtattacggctgcaccggagaagtccaggattcaggcgacgtgatcaccgaggggaggatccgtgtgatcttcagcatcccatgcgaacctaacctggatgctctaattcagaatcaacacaaatactcgattaaatacaaccctggatacgtgttagcatcacgcttgggtgtgtcagggtatttagtgtcgagattcactggctccatctttatcggccgtggatccaggaggaatccccatggcgaccataaagcaaacgttggtctgaatcttaagtttaataagaaaaatgaagaagtcccaggttatacaaagaaggttggttctgaatggatgtactcatccgccgctgagcagctgttagcggaatacttggagagagctccggaactgttttcatacatagcaaagaattctcaggaagacgtgttttacgaggatgatatctggcctggagagaacgagaatggggctgaaaaggtgcaagagatcattacctggctaaaggggcatcccgttagcacgctgtctagaagcagctgcgacctccagatactggatgccgcgatcgtggagaaaattgaggaagaagtcgagaagtgtaagcaaaggaaaaacaataagaaggtcagggtgaccgtcaagccccatctgttgtatcgtcccctggagcagcagcacggtgttattcccgaccgggacgctgagttttgccttttcgatagagtcgtgaatgtgcgcgaaaatttttcagttcccgtggggctacgtggaacaattatcggcattaagggggctaaccgagaagccgacgtcctttttgaagtgctattcgacgaagagttccccggaggcctcaccattcggtgttcccccggcaggggttaccggctcccaacctctgctctggttaacctctctcacggatctaggtctgagaccgggaatcaaaagctgaccgcgattgtgaaacctcaaccggctgtacaccagcactcttcaagtagctcggtgtcatctggccatttgggtgccctgaaccatagcccccagagtctgttcgtaccaactcaagtgcctactaaagacgacgacgagttctgtaatatctggcaatccctgcagggctcgggaaagatgcagtatttccagccaaccattcaagaaaaaggagcggttttgcctcaagaaatatcccaggtcaaccaacatcacaagtctggatttaatgataatagcgttaaatatcagcagcggaagcacgacccacataggaaatttaaggaggagtgcaagtccccaaaagctgagtgctggtcccagaagatgtccaacaaacagcctaatagcgggatcgagaactttcttgcctctctcaatatctctaaggaaaatgaagttcaatcgtcacatcatggcgagcccccctccgaagagcacctgagccctcagtcctttgccatgaagggtactagaatgctcaaggagattctgaagattgatgggagcaacacagtcgaccataaaaacgaaataaaacagatagctaatgagattccggtgagcagcaaccggagagatgaatatggtctgccatcccagccaaagcagaataaaaaattggcctcgtacatgaacaaaccccattctgccaacgaatatcataacgtgcaatccatggacaacatgtgttggcctgcgccttcccagatcccccccgtaagtaccccagttacggagcttagcagaatctgctccctcgtgggcatgccccaaccagacttctcgttcctcagaatgccacagaccatgaccgtgtgtcaagtcaagttgagtaacgggttgctcgttcatggtccccagtgccattcagaaaacgaagcaaaggaaaaggcagctctttttgccttgcaacagctcgggtcgcttggtatgaacttccctcttccatcccaagttttcgcaaactatcctagtgccgtcccaccagggacaattccccccgcctttcccccccccaccgccaatatcatgccctcttctagccatctctttgggagcatgccctggggcccctcagtgcccgtgcccggtaagccattccaccacactctgtattcaggcaccatgccaatggccgggggcatccctggaggagttcacaatcaattcatcccactgcaggtaactaaaaagagggtggcaaacaagaaaaactttgagaacaaggaagcgcagtcctcccaagcgaccccagtgcaaactagtcagcctgacagttctaatatcgtgaaagtaagtccgcgggaaagttcctcggcaagcctgaagagctcccctatcgcccagccagcctcatcttttcaggtggagacggcctcccagggtcacagtatatcccaccacaagtctactcccattagtagctcgaggcgcaaaagtagaaaactggcggtcaacttcggtgtttccaaaccatctgaatag

SEQ ID NO: 13708 - DNA, 1233 bp, Artificial Sequence
  Description of Artificial Sequence: Synthetic coding sequence
atgccagcacgcgcacttctaccccgcaggatggggcatcgcacgctcgcaagcacgcccgccttatgggccagcatcccatgcccgagatccgagctaaggctggatttagtgctcccaagtggacagtctttccgttggcgcgaacaaagccccgcgcattggtctggtgtcttggccgatcaggtctggactctcactcagacagaggagcagctgcattgtactgtgtacagaggagataaatcccaggccagccggcccacccccgacgagctggaagccgtgcgcaagtacttccagctcgatgtcactcttgctcagttgtatcaccattggggctctgttgatagccacttccaggaggtggcccaaaagttccagggggtaagattactgcgacaggaccctatcgaatgcctgtttagctttatctgctcttcaaacaacaacatagcaagaattactgggatggtcgaacgcttgtgccaggcttttgggcctcggcttatacaattggatgatgtgacttatcacggattcccatccctgcaggcattagctggccccgaggttgaggctcatctgcggaagttaggcctcggataccgcgctcggtatgtctctgcctctgcgagggccatcttggaagagcagggggggctcgcttggctgcagcagctgcgagaaagctcctacgaggaagctcacaaagcactttgtattttgcctggggtgggtaccaaagtagctgactgtatttgccttatggcgctggataagcctcaagccgtgcccgtggatgtacatatgtggcacatcgcccagcgtgattactcttggcatcccaccacatcccaagccaaaggcccctcaccacagacaaataaggaactggggaactttttcagatcgctctggggcccttacgccggatgggctcaggctactcccccatcctacaggtgttgtagcgtccccacctgcgctaacccagcgatgctcagaagtcaccagcagagcgcagagcgggtgccaaaagggcgcaaggccagatggggcaccctggacaaagagattccccaggcccctagtccacccttccctacctccctctcgccttctccaccatccctgatgctgggtcggggactccccgtgacgaccagcaaagccagacatccacaaataaaacagagcgtgtgcacaacacgatggggaggcggttactag

SEQ ID NO: 13709 - DNA, 1071 bp, Artificial Sequence
  Description of Artificial Sequence: Synthetic coding sequence
atgcccgccagagccctgctgcccaggaggatggggcataggaccttggctagtacccctgccctgtgggctagtatcccctgcccgaggagcgaactcaggctcgatctggtcctcccgtccggacaatcttttagatggagagagcagagccctgcccactggtcaggagtcttagcagatcaggtttggaccttaacgcagacagaggagcagcttcactgcaccgtgtatagaggggataagagccaggcgtccaggccaactcctgacgagctcgaagccgtgcgtaaatacttccagcttgacgttactcttgcccaactgtatcatcactggggctctgtagatagccacttccaagaggtggcccaaaagttccagggagtacgcctgcttcgccaagatcccatcgaatgtctcttcagctttatctgctcctccaataacaacatcgcccggattacgggaatggtggaacgcctctgtcaggccttcgggcccagactaattcagcttgacgatgtcacataccacggatttccaagcctgcaagctctggctggcccggaggtggaggcccacctgcggaaactcggcctgggatatcgtgccagatatgtttcagcctccgctagagccattttggaagaacagggtggcttggcttggctccagcagctccgggaatctagttatgaagaagcacataaggcgctttgcattcttccaggagtaggcacgaaggtcgccgattgtatctgcctgatggccctcgataagccacaggcagtccccgtggacgtgcacatgtggcatattgcacaacgcgattattcatggcatccaaccacatcccaggccaaaggtcccagtcctcagaccaacaaggagctaggaaacttcttcagatccctgtggggcccatacgcgggttgggcccaggccctgtgtcaggtgatcacaactttcatgaccttcctggggccccatcggttggatcagatgccccccgaggagctccaaacctcgtcctcccgccttggcggccctccctggcaatgcatctag

SEQ ID NO: 13710 - DNA, 1275 bp, Artificial Sequence
  Description of Artificial Sequence: Synthetic coding sequence
atgcctgcaagagcacttctgcctagacgcatgggacatcggacactcgcgtccaccccagcattatgggcatctattccctgtccccgtagcgagctccgcctggatctggtgctcccttctggccagtccttccggtggagggaacagtcacctgcacattggtccggtgtccttgccgaccaagtttggactctgactcaaacagaagagcagctgcactgcaccgtttaccgcggtgacaagtcccaagcctcaagaccaactcctgatgagctggaggccgtcaggaagtacttccagctggatgtcaccttagcgcagctgtatcatcattggggaagcgtggatagccacttccaggaagttgcccagaagttccagggcgttaggttgcttcgacaggatccgattgaatgtcttttttcctttatatgcagtagcaataacaatatcgcccgcataacaggtatggtcgaacgcctgtgccaggccttcggtccacgactgattcagctggacgacgtgacttatcatggattcccctccctacaagcactggccggaccggaggtagaggcccacttaagaaaactcggactcggctaccgggcgcgctatgtgtcggctagtgcccgcgctatcctggaagaacaggggggcttagcttggctgcagcagctgagagagagttcctacgaagaagcgcacaaagctctatgcattttgccgggtgtggggacgaaagtggccgattgcatttgcctcatggcgcttgataagcctcaggccgtgcctgttgatgtgcatatgtggcacatcgctcagcgagattactcctggcaccctacaacgtcccaggcaaagggcccctctccacagaccaacaaagaactcggtaacttttttagatcactgtggggtccgtacgccggctgggctcaggctggtctgctggggaatgcctttgatggccaccaactcctgaggcccctcattttctgtcaggatcacctgcgggaaggcccgcccattggccgcggggatagccaaggcgaggagcttgagccccagttgccctcttctttgtcttctattccctatggattctgtgaccattgctggacaaaagatgttgacgacccacctctggttacccacccctccccggggtcccgcgacggacacatgacgcaagcttggcctgtgaaagtagtgtcccccctggcgactgtgatcggtcacgtcatgcaggccagtctgctcgcactgtag

SEQ ID NO: 13711 - DNA, 975 bp, Artificial Sequence
  Description of Artificial Sequence: Synthetic coding sequence
atgccggcaagggcgctgctgccacggagaatggggcaccggacattggcaagcacgcctgccctttgggcatctatcccctgtcctcggtcagagcttagactggatctggtgctacccagcggccaaagcttcaggtggcgggaacaatcccccgcccactggtcgggagttctggctgaccaagtttggactttaacgcagacggaagaacagctgcactgtacggtgtatagaggggacaaaagtcaggcttctcgcccaactccagatgaactggaagctgtgcgcaaatattttcagctggacgtgacccttgcccagctgtatcatcactggggctccgtggacagccactttcaggaggtggctcagaaatttcagggagttcgcctcctacgccaggatcccattgaatgtctcttctcatttatctgttcttctaataataacattgcccggatcacgggcatggtggagaggctgtgtcaggctttcggtcctcggctaattcagctggatgacgtaacataccacgggttcccctctctgcaagccctggccggacccgaagtggaggctcaccttcggaagctgggactgggttacagggcccgttacgtcagtgccagcgccagagctattctggaagagcaaggcggcctggcatggctgcagcaactgagagaaagctcctatgaagaggcccacaaagctctttgcatactgcccggagtcggaaccaaggttgccgactgcatctgtctcatggcgctggataagccccaggcggtaccagttgacgtacacatgtggcatatcgctcagagggactacagttggcatccaaccaccagccaggccaaaggaccctccccccagaccaataaagaactagggaatttttttaggtccctgtgggggccatatgctggctgggcccaagcagtctccgtacccagatgccctccatag

SEQ ID NO: 13712 - DNA, 594 bp, Artificial Sequence
  Description of Artificial Sequence: Synthetic coding sequence
atggtcgaacgcctctgccaggcgttcgggccaagactcattcagctggatgacgtcacataccatggcttcccttcacttcaggcgctggcagggcccgaagtagaagctcatctacggaaactgggattgggctatcgagccagatacgtcagtgcaagcgcacgggctattctcgaggagcagggaggactcgcatggcttcagcagctgcgagaatcatcgtacgaggaagcccacaaagccttatgcattttaccaggggtcggcaccaaagagacttttagcggtgcgtgcggggacctcatgctggccggccctaagcgctgttgttctgtccctacctgcgccaacccagcaatgctgcgctcccaccagcagtccgcggagcgggtgcccaaaggtcgaaaagccaggtggggcacccttgataaagagatccctcaggccccctccccccccttcccaacctccctctctccctctcctccaagtttaatgttagggaggggcctgcccgtcactacctccaaggcgcgccaccctcagattaagcagagcgtgtgcaccactcgttgggggggtggatactag

SEQ ID NO: 13713 - DNA, 1038 bp, Artificial Sequence
  Description of Artificial Sequence: Synthetic coding sequence
atgcctgcaagagcactgctcccccggcgaatgggacatcggacactggcctcaacgcctgccctgtgggcgtccatcccttgcccaagaagtgaactgagactggatctagttctaccttccggacagtccttccgttggagagaacagagcccagcgcactggtcaggcgtactagctgatcaagtatggacattgacccaaacagaagaacaactccactgtacggtctaccgcggagacaaatcacaagctagcagaccgacccctgacgagttagaggcagttcgaaagtatttccagcttgatgtcaccctggcacagttatatcatcattggggtagcgtggacagtcacttccaggaagttgctcaaaagttccagggggttcgcctccttaggcaggatcccattgaatgtctgttcagctttatttgcagttccaacaataatatcgcaaggattaccggtatggtagagaggctctgtcaggcctttggccctagacttatacagttggatgacgtcacataccacggctttcccagtctacaggccttggctgggccagaagtagaagctcacctgcgcaagctcgggcttgggtaccgggccagatacgtctccgcgagcgcacgtgcaatcctggaagagcagggaggcttggcctggttacagcaattgagggagtcctcgtacgaggaggcacataaggctctttgcatcctcccgggagtaggaacaaaagtggcagactgtatatgcttgatggccctggacaagccgcaagccgttccggtggacgtccatatgtggcacattgctcagagagactatagctggcaccctacaacatcacaggctaaaggccctagtccccagacaaacaaggaattgggtaatttcttccggagcctgtggggaccatacgcaggttgggcccaggccgtgctttttagcgccgacctccgacagagccgtcatgcacaggagccacccgccaaacgccgcaagggcagcaaaggacccgagggatag

SEQ ID NO: 13714 - DNA, 1074 bp, Artificial Sequence
  Description of Artificial Sequence: Synthetic coding sequence
atgcctgctcgggccctgctgccacgtcggatggggcatcggactctcgcctccaccccagcgttgtgggcaagtatcccttgcccacgcagtgaattgcgtctcgacttagtcttacctagtgggcaatcttttagatggcgggagcaaagtcccgcccattggtccggagtattggctgaccaggtctggactttgacacaaacagaggaacaacttcattgtaccgtgtatcgaggcgacaaatctcaggcttcccgcccaactccagatgagctcgaagctgtgcggaagtactttcagctggatgtgactttggctcagctttatcatcattgggggtcagtagactcacactttcaggaagtggcacagaagtttcagggcgtacgcctgctgagacaggatcctattgagtgcctattttccttcatctgctcatcaaacaacaatatcgccagaatcacagggatggtagagcgactgtgccaggctttcgggccccggctgattcaactagacgacgtgacataccatggtttccccagcctgcaggcactcgctgggcctgaagtggaggcccacctgcggaagttgggtctgggctatagggccagatatgtgtccgcaagcgctcgagcaatacttgaggagcagggcggactggcttggctgcagcagctgcgcgaatctagttacgaagaagcccacaaggctctatgtatcttacctggcgtcggcactaaaggcctgcttgggaacgcttttgacgggcatcagcttctgcgccctctcatcttctgtcaagatcacctgagagagggccctcctatagggcgcggcgactcccagggtgaggaattggaaccccagctgccatcatccctgtcctcaataccttatggcttttgcgaccactgctggacaaaagatgttgacgatccgcctcttgtgacccacccctcgcccggttcacgcgatggacacatgacccaagcctggccggtcaaggtcgtttctcctctcgccaccgtgataggccacgtgatgcaggctagcttgctggccctttag

SEQ ID NO: 13715 - DNA, 588 bp, Artificial Sequence
  Description of Artificial Sequence: Synthetic coding sequence
atgcccgcccgtgccttactccccaggcggatgggccaccggaccctggcatcgactcccgccctctgggcctctatcccttgtcccaggagtgagttgcgactggatttggtgttgccatcaggtcagagcttccgctggcgggaacagtcaccggcccattggtccggtgtcctggctgaccaggtgtggaccctgacccaaacagaggaacagttgcattgtaccgtgtatcgtggagacaagtcccaggcatcccgccccacgccggacgagctcgaggcagtcagaaagtacttccagctggacgtgaccttggcccagctctatcaccattggggtagcgtcgattcccacttccaagaagttgcacaaaagttccagggcgtaaggctgctgcgtcaggaccccatcgagtgcctgttttcctttatctgtagcagcaacaacaacattgcccgaatcacaggcatggtggagcggttgtgtcaggccttcggtccccgcctgatccagctggatgacgtgacctaccacgggtttccgagcctgcaagcgctggcaggaccaccgtggcagtgcatatag

SEQ ID NO: 13716 - DNA, 969 bp, Artificial Sequence
  Description of Artificial Sequence: Synthetic coding sequence
atgccagcccgcgcactgctaccaaggagaatgggccacaggactctagcctcaactcctgctctgtgggcctcgatcccttgccctaggtcagaacttcggcttgatctggttcttcccagcggtcaaagcttccgatggagagaacagtctccggcgcattggagcggggtcctggcagatcaggtgtggactttgacacagacagaagaacaactgcactgcaccgtgtaccgcggcgacaaatcccaggccagcagacctactcccgacgaactggaggccgtccgtaagtattttcagctggatgtgacactggcacagctgtaccaccactgggggtccgtggactcccatttccaagaggttgcacaaaagtttcaaggagtaagactccttagacaagacccaatcgagtgtctcttttcttttatttgttcgagtaacaataatatagctcgtatcaccggaatggtggaacgcctgtgccaggctttcggaccaaggctgatacagctcgatgacgtcacctaccacggcttcccaagccttcaggcgttagctggccccgaggtggaagcacatctgcggaagctggggctgggctacagagcaaggtacgtttcagcttcggctagagccatactcgaggagcagggaggcctcgcttggctgcagcagcttcgggagagttcctacgaagaggcacataaagccctctgtatattgcccggcgtgggaacaaaagtcgcagattgtatatgcctcatggcgctagataagccccaggctgtcccagtggacgtccacatgtggcacatagctcaacgcgattattcttggcaccccactacatcacaagctaagggtcccagtccccagaccaacaaggagttgggtaatttttttagaagcctgtggggcccatatgccggatgggcccaggcagcaggcagtgacgctagctag

SEQ ID NO: 13717 - DNA, 6807 bp, Artificial Sequence
  Description of Artificial Sequence: Synthetic coding sequence
atgagcggattacacctcgtcaagcaggggagggatcgcaagaagatcgactcacagagagatttcaccgtggcaagcccagccgaatttgtgactagattcggaggcaacaaggtcatcgagaaggtgttaatagctaacaacggaattgccgccgtgaagtgtatgaggagcattcgccgttggagctatgaaatgtttagaaatgagagggccattagattcgtagtgatggtgacaccagaggatctcaaggctaatgcagagtatatcaaaatggccgaccactatgtgcctgttcctgggggacctaataacaacaactacgccaacgttgagttgatcctggacattgctaaacgaatacctgtgcaggccgtgtgggcaggctggggtcatgccagcgagaatccgaaactgcccgaactcctgttgaagaacggcatcgctttcatgggccctccttcccaagccatgtgggcgctcggagacaaaatcgcctcctctatcgtggcacaaaccgcgggtatccccacacttccgtggagtgggagcggtctgagggtggattggcaggagaacgacttctcaaagcggattctgaatgtgccccaggagctttatgagaaaggctacgtaaaagacgtggatgacggcctccaggctgctgaggaagtaggctatccagtaatgatcaaggcctccgaaggggggggaggcaaggggattcggaaagtgaacaacgccgacgatttcccgaatttgtttagacaggtgcaggcagaagtgccaggcagtcccatatttgtcatgcggttagcaaagcagtccagacatctcgaggtccagattctcgctgatcaatacggcaacgccatctccctgttcgggcgggattgttccgtccagagacgtcatcagaaaatcatcgaagaggccccagctacaatcgctacaccggctgtgtttgagcacatggagcagtgtgcagttaaattggctaagatggtcggatatgtctctgccggaacagtggaatatctctattctcaggacgggtctttttacttcctcgaactgaatcctagactgcaagtagagcatccttgcaccgaaatggtggccgacgttaacctgccagccgcccagcttcaaatcgctatggggatcccattgtataggattaaagacatccgtatgatgtatggcgtgtctccgtggggagacagccctattgatttcgaagactccgcccatgtgccttgtcctaggggacatgttatcgcagccagaattacaagtgagaaccccgatgaaggctttaagccctctagtggtacagtgcaggagctaaatttccggagtaataagaatgtgtggggttacttttcagtggccgcggcaggcgggttgcacgagtttgcagattcccagttcggccattgtttttcatggggcgaaaatagggaggaagctattagtaatatggtggtggctttaaaggagctgtctatccggggcgatttcagaactaccgtggagtatcttattaagttgttggaaaccgagagctttcagatgaaccgcatcgacacaggttggctcgatcgtctgatagcagagaaagtccaagcagagcgacccgatacgatgttgggcgtagtgtgcggagctctgcatgtagcagacgtaagcttgcgtaacagtgtatcaaattttctgcattctctcgagcggggtcaggtactgcccgctcacactttattgaacacagtggatgttgaactgatttacgagggtgtcaaatacgtgctcaaagtcacaaggcaatcccctaactcatatgttgttattatgaatggttcttgtgtcgaagtcgatgttcatcgactctctgatggtggcctcctcctgtcgtacgacggctcgtcatacactacttatatgaaggaagaagtcgaccggtaccgtataaccattggcaataaaacctgcgttttcgagaaggaaaacgatccatccgtgatgcggtcaccaagcgctggcaagctgatccagtacattgtggaggacggtggacacgtcttcgcaggtcagtgctacgccgagattgaagtgatgaaaatggtgatgaccctcacagccgtagaatctggatgcatccactatgtgaaacgccctggtgcagccctcgatccaggctgtgtcttggctaagatgcaacttgacaatccgtctaaggtccaacaggcggagctccacacaggaagtctcccacgtatacagtccacagcgctgcggggagaaaaattacacagagtgtttcactatgtcctggataaccttgttaacgtgatgaacggatactgtctgcccgatccattctttagcagtaaggtcaaagattgggtggagcggttgatgaagactctgagggacccctctctacctctgctggagctgcaagacattatgacctccgtgtccggacggatccctccaaatgtggaaaaaagtatcaaaaaggagatggcccagtacgctagtaacatcactagcgtattgtgccagttcccctctcagcagattgcaaatattctggacagtcatgctgcaactctgaacagaaagtctgagagagaagtgtttttcatgaacactcagagcattgtccagctcgtacagcgctacaggagcggcatccggggtcatatgaaggccgtcgtgatggatttgctgaggcagtacttgcgcgtagaaacacagttccagaatggacattatgacaaatgtgtgttcgcactgcgggaggagaacaaatcagacatgaataccgtgttgaattacatctttagccacgcccaggtcacaaaaaagaatctgctagtgaccatgctcatagaccagttgtgtggtagggaccctaccttaacggatgagttgcttaatattcttaccgagctcactcagctgtccaagacaactaatgccaaggtagccctgcgcgctcgtcaggtgctcattgctagccacttgccttcctatgaactcagacataatcaggttgaaagcatttttctgtccgccatcgacatgtacggacaccagttttgtatcgagaacctgcagaagcttatcctttccgagactagcattttcgatgtgctgccaaactttttttatcacagcaatcaggtcgttcggatggccgccctagaggtctatgtgaggcgtgcatacatcgcttatgagctaaattccgtccagcaccgccagctgaaggacaacacctgtgtagtggagttccaattcatgctgccaacttcccatcccaatcgcgggaacattcctactctgaataggatgtctttttcctcaaatctcaaccattacgggatgacacatgtcgcctcagtgagtgatgtgttgttggacaactcttttaccccgccctgtcagcggatgggcggcatggtgtccttccggacttttgaggatttcgttcgcatttttgatgaggttatgggatgctttagcgactctcctccgcagagtccaacctttcccgaagccggccataccagcctgtatgacgaggacaaagtacctcgggacgagcctatccatattctgaatgttgctattaaaacagactgcgatatcgaggacgatagactggctgcaatgttccgcgaattcactcagcagaataaggctactcttgtagatcatggcattagaagactaacatttcttgtggcacagaaagatttccgcaagcaggtgaattatgaggtcgacaggagattccatagggagtttcccaagttttttaccttccgggcacgggataagtttgaagaggaccggatctatcgtcacttggaacctgcactagccttccagctggaactcaatcggatgagaaacttcgacttgaccgccatcccatgcgccaatcacaagatgcatttgtacctaggagctgccaaagtcgaggttggaacagaagtaacggactatcgtttcttcgtgcgggcaattatccgacattccgacctagtcacaaaagaagcttcatttgaatacctgcagaacgagggtgagcggctgctgctggaagctatggacgagctcgaggtcgcttttaataataccaatgtgaggactgactgtaatcacattttcctgaacttcgtgcccactgttatcatggaccctagcaaaatcgaagagagcgtgcgatccatggtgatgagatatgggagtcgcctctggaagctacgcgtgctgcaggcggaactgaagatcaacatacgactgactccaacaggcaaggcaataccgatacggcttttcctgactaatgagtcaggatactatctggatattagcctgtacaaagaggtgacagattcacgtactgctcaaattatgttccaggcatatggagacaaacagggtcctctgcacggtatgctcatcaatacaccttacgtgactaaggacctgcttcagtcgaagcgcttccaagctcaatccctgggcactacctatatttacgacatccccgaaatgtttcgtcaatctctcattaaactgtgggaatcgatgagcacacaggcattccttccaagcccgccccttcccagtgacatgttgacctacacggagctcgtgctcgacgaccagggacagctcgtgcacatgaatcgcctccctggtggtaacgaaataggtatggttgcctggaaaatgacttttaaaagtccagaataccctgagggcagagatataattgtgatcggaaatgatattacatacaggatcgggagtttcggtccccaagaggacctcttgttcctgagggccagtgagctggcacgggccgaaggaattccccgtatctacgtgtctgcaaactccggagccaggattggcttggccgaggagatccgccacatgtttcatgtcgcctgggtcgatccggaagatccctacaaaggataccgctacctgtaccttacccctcaggactacaaacgggtgtcagccctgaatagtgttcattgtgaacacgtggaggacgagggggagagccgatacaagattacggatatcataggcaaagaggaggggattgggcccgaaaacctccgaggcagcggtatgattgctggcgaatcaagtcttgcctacaatgagatcattactatctcactggtcacatgtagagcaatcggcataggcgcctatctggttcgattggggcagaggaccattcaggtagaaaactcccacctcatcctgaccggggccggggccctgaataaggtattagggagagaggtgtacacaagtaataatcaactcggtggtatccagataatgcataacaatggcgtgactcattgtaccgtgtgtgacgattttgagggggtgttcaccgtgctgcattggctgtcatacatgcccaaatccgtgcactcttccgtgccactactgaacagcaaggatcccatagatcggatcatcgaatttgttccaaccaaaactccgtatgatccaagatggatgctcgccggcagaccacaccctactcagaaagggcaatggcttagtggctttttcgattacggcagctttagcgagataatgcaaccctgggctcagacagtagtggttgggcgcgccaggctcggggggattcctgtgggcgtggtggccgtcgaaaccaggacggttgagctaagtatccctgcagaccccgccaatctcgacagcgaagctaaaataattcagcaagctggccaggtgtggtttcccgatagcgcttttaagacttatcaggcaattaaggatttcaaccgggagggcttacctcttatggtattcgcaaattggaggggtttctcgggggggatgaaagacatgtacgatcaagtgctgaagttcggagcatatattgtcgacggcctgcgggagtgttgccagcctgtgctcgtgtatattcctcctcaggccgagctgaggggcggctcctgggttgttatagattcatccattaatccccgacacatggagatgtacgctgatagggagagcagaggaagcgtccttgagcccgaaggcacggtcgagatcaaatttaggcgcaaagaccttgtgaagaccatgcggagggtggatcccgtctacatccacctggctgaacgtttggggacgccagaactgagtactgcagaacggaaagagttggaaaataaattaaaagagcgggaggagttccttattcccatctatcaccaggtggccgttcagtttgccgatctccacgacacaccagggcgcatgcaggagaagggggttattagcgacattctcgactggaagacatctcgtacatttttttactggcggctgcgccgccttctcctagaggatttagtgaagaaaaagattcacaatgcaaacccagagcttacggatggccagatacaggccatgctccgccggtggttcgtggaggttgaggggaccgtgaaggcctacgtctgggataataacaaggatttagccgagtggctggagaagcaactcaccgaggaagatggagtgcactccgtgattgaggagaatatcaaatgtatctccagagactacgttctgaaacaaattcgctctttggttcaagcgaatcctgaagtggcaatggatagcatcattcacatgacacagcatatctccccaactcagagggctgaagtcatccgaatcctgtccacgatggatagcccgagcacatag

SEQ ID NO: 13718 - DNA, 7152 bp, Artificial Sequence
  Description of Artificial Sequence: Synthetic coding sequence
atgtggtggtccacgctaatgtccatcctccgagcaaggtcattctggaaatggatctccacacagacggtcagaattatccgggcagtccgcgcacatttcggcggaattatggacgagccttcacctctcgcgcaacccctcgaattgaaccagcacagccgcttcattataggcagtgtcagcgaggataattctgaggatgagatctcgaatctggttaaactcgacttgctcgaagagaaagaggggtcactttccccagcaagtgttggatctgacactctgtctgacctgggtatctcatcactacaagatgggctggctctgcatatcaggtcctcaatgtccggacttcatctggtcaagcaagggcgagacaggaagaaaatcgactcccagagagactttactgttgccagcccagcagagttcgttacaaggttcggtgggaacaaagtgatcgaaaaggtacttatcgccaacaatggcattgccgctgtcaagtgcatgcggagtatcagaaggtggagctatgagatgttccggaatgaaagagcgatacgattcgtggttatggtgactccggaggacctgaaagctaacgccgagtatatcaaaatggccgaccactatgtccccgtgcccgggggacccaataacaataactacgcaaacgtggagctcattctggatatcgcaaagcggattcccgtacaggcagtttgggccggctgggggcacgcatccgaaaaccccaaacttcctgaactactgctgaaaaacggcattgcttttatggggcctccatcacaggccatgtgggccctgggagacaaaattgcctcatctatcgtggctcagactgctggtataccaacattgccctggagcggctccgggctgcgagttgactggcaggaaaacgacttttcgaagcggatacttaacgttccccaagagctgtatgagaaagggtatgtgaaggatgtggacgatgggctgcaggccgccgaagaggtgggttaccccgtgatgatcaaggcgtctgaaggcggaggcgggaaagggattaggaaagtgaataacgccgatgatttcccgaacctgttcagacaggtgcaggccgaagttcctggctcccctatcttcgtcatgaggctggccaagcaaagtcgtcacctggaggtgcagatcctggccgatcagtacggcaatgctataagcctttttggcagggactgctctgtacagcgccgacatcagaagataatcgaggaggccccggctacaatagcaactcctgccgtgttcgagcacatggaacagtgtgccgtgaaacttgccaagatggtgggatatgtaagtgccggaaccgtggaatacctttacagccaggacgggtctttctattttctggaactgaatcctcgcctgcaggttgaacacccttgcaccgagatggtggctgatgtgaatctgcctgcagctcagctacagattgccatgggcatccccttgtaccgaattaaggacatacgaatgatgtacggcgtcagtccctggggcgactctccaatcgacttcgaagactcagcacacgtcccctgtccacggggccatgtgattgccgccagaattacgtctgagaacccagacgaggggttcaaaccaagctccggtaccgtgcaggagttgaactttcgctccaataagaatgtctgggggtatttttccgtcgccgcggcagggggcttgcacgaattcgcagattcacagtttggacactgctttagctggggggaaaaccgggaggaagccatatctaatatggtggttgccctgaaggaactcagcatccggggagattttaggaccactgttgagtatctgatcaagctcctcgaaacggagtccttccaaatgaatcgcatcgacacaggctggctggaccgtctgattgccgagaaggtgcaggccgaacggcctgatacaatgctgggggtcgtttgtggagcgctccacgtcgccgacgtgagtctcagaaatagtgtcagtaactttctacacagcttggaacgcggacaggttttacccgcacacactttattaaacacagtcgatgttgaactgatctatgagggtgtcaaatacgttctcaaggtgaccagacagagtcccaacagctacgtcgttatcatgaatggcagttgcgtggaggtagacgtacatagattgtctgatggaggcctgctgctaagctatgatggctcatcatacactacctacatgaaggaagaagtggacaggtaccgcattaccattggcaataagacttgtgtgttcgagaaggagaacgacccatctgtgatgaggtcaccttcggctggcaaattaatccagtatatcgttgaggacggcggacacgtgttcgccggccaatgctatgctgagatcgaggtcatgaaaatggtgatgaccctgacagccgtagaatccggatgtatccactatgtcaaaaggccaggggcagctcttgatcccgggtgcgtcctggccaagatgcagcttgataatccctcaaaggtgcaacaggcagagttacacaccggtagcttgccgcgaatacaaagcactgcgctaaggggtgagaagttgcatcgagtgttccactatgtgctggacaatctcgtaaatgtcatgaacggctattgtctgcccgaccccttcttctcctccaaggtgaaggattgggtcgagagacttatgaagacactgagagacccttctttgcccttgttggagctccaggacataatgaccagcgtctcagggagaattccgcccaatgtcgagaagtccataaagaaggagatggcacagtatgcctctaacatcacctccgtgctgtgccagtttccttcccagcagatcgcaaatatcctcgattcacatgcggctaccctgaaccgaaagtcagagagagaagtattttttatgaatacacagtcaattgttcagcttgtccagcgctatagatccgggataagagggcacatgaaggccgtcgtgatggatctgctgcgtcagtatctgcgcgtagagacacagttccagaacggccattacgataaatgcgtgtttgccctcagggaagagaacaagtctgacatgaacaccgttcttaactatatctttagtcatgcacaggtgacaaaaaagaacctgcttgtgaccatgctcattgaccagttatgcggacgcgatcccactttgacagatgaactgttgaacatcctcaccgagctgacacagttgagcaaaaccaccaacgctaaggttgccctgcgggcccgtcaggtcttgattgcaagccacctccccagttacgagttgagacataaccaggttgagtcaatctttttgtcagcaattgatatgtatggacaccagttttgtatagaaaacctgcagaaattgattctttccgaaacttcgatattcgacgtgttgcccaattttttctaccactccaaccaggtggtccggatggcagccctggaggtgtatgtgagacgggcctacattgcctacgagctgaactccgtccagcaccgccagttaaaggacaacacttgcgtggtggagtttcagttcatgttgccaacttcacaccccaacaggggtaacatcccaactctgaatagaatgtcattttccagcaaccttaatcactatgggatgacacacgtagcctccgtgtccgacgtgctgttggacaattccttcacgccaccctgccagcgaatggggggaatggtgagcttccgaacttttgaagatttcgtgcggatttttgatgaagtcatggggtgtttctccgattctcctcctcagagtccgacatttccagaagccgggcacaccagcttgtacgatgaggacaaggtgccacgcgatgaaccgatccacattctcaatgtggctattaagacagactgtgacattgaagacgataggcttgcggccatgttcagagagtttacgcagcagaataaggctactctggtcgatcatggcataaggcgcctgacttttttagtggcacaaaaggatttccggaaacaagtcaactacgaggtggaccgaagatttcaccgtgaatttcccaagttttttaccttcagagcccgggataaatttgaagaagacagaatttaccggcatctagagcccgccctggcatttcagctggaattaaatagaatgcgaaatttcgatcttacggctataccctgcgccaatcacaaaatgcatctctatttgggtgctgctaaggtcgaggtgggtacggaggtcaccgactatcgatttttcgtcagggccatcatacggcactcggatctggtgacaaaggaagcttcgttcgaatacctgcagaatgaaggcgaacgtcttctgctcgaggctatggacgaattagaagtcgcttttaataacactaatgtgagaactgattgcaaccacatatttttgaatttcgtaccgaccgtaattatggaccccagtaagatcgaagaatcagtgcgctccatggtgatgaggtacggatctcggttgtggaaactgagggtgttacaggctgagttgaagattaacatccggctgacgccaacaggaaaggccatcccaatcagactcttcttaacgaatgagtccgggtactaccttgatatatcactgtataaagaggtaactgattcccggactgcccagattatgtttcaggcttacggggacaaacagggtcctctgcatgggatgctgattaacacaccttacgtgactaaggacctgctccaaagtaaacgattccaggcgcagtccctgggcactacgtatatttacgatatcccggaaatgtttcgacagtctcttatcaaactttgggagtcgatgagcacccaggcatttctgccttctccacctctcccttctgacatgctcacctacaccgagctggtgttagatgaccaaggccagttggtacacatgaaccgccttccagggggcaacgagattggaatggttgcatggaagatgaccttcaagagccctgaatacccagaggggagagatattatagttataggcaatgatatcacataccgcatcggatcatttggccctcaggaagaccttcttttcttgcgggccagcgagcttgcgcgcgccgaagggataccacgaatctacgtctccgccaatagcggagcacgcattggactggccgaggagatacgccatatgttccatgtggcctgggtggaccccgaagatccctacaaagggtacagatacctgtacctaactcctcaggattacaagcgggtaagcgcactcaacagtgttcactgcgagcacgtcgaggatgaaggtgaaagccggtacaagatcactgatattatcggcaaggaagagggcatcgggcccgaaaatctccggggaagcgggatgattgctggagagagctccctggcatataacgagattatcacaattagcctggtgacgtgtagggcaattggcataggagcctatctcgtccgtcttggtcagcgcaccattcaggtcgaaaactcccatctgatcctgaccggcgccggggccttaaataaagtgctgggcagggaggtgtatacatccaacaatcaactgggggggatccagattatgcacaacaacggggttacacattgcaccgtctgcgatgacttcgagggcgtgttcacggtgctgcactggctaagttacatgccaaagagcgttcatagcagcgtcccacttctaaactcaaaggatcccattgatcgcatcatcgaatttgtgcctactaagactccatatgacccacgctggatgctggcgggcagacctcaccctactcagaaaggacagtggctcagcggctttttcgactatggatccttctctgagataatgcagccatgggcccaaaccgtcgtcgtcggaagggcaaggctggggggcattcccgtaggggttgtcgccgtagaaacacgcaccgtggaactgtctatcccggctgaccctgccaacctggatagtgaagctaaaataatccagcaggccgggcaggtgtggttcccggattccgccttcaaaacttatcaggccattaaggacttcaatagggagggactgccgctgatggtgtttgcaaattggcggggttttagtggcggcatgaaagacatgtatgaccaggtactgaaattcggtgcctacattgttgatgggcttagagagtgttgccagccagtgttagtgtacattccacctcaggctgagctccgtggcgggtcatgggtggtcatcgattcctccatcaacccgagacatatggagatgtacgccgacagagagtcaagaggttccgtgttggagcccgaaggtaccgtggaaattaagttcagacggaaagacctagtgaaaacaatgagacgcgtcgaccccgtgtacattcaccttgcagaacgattaggcacaccagagctgagcaccgctgagagaaaggaacttgagaacaagctcaaggagagggaggagttcttgatccccatttaccaccaggtggctgtgcaattcgcggacctccacgatacacctggaaggatgcaggaaaagggagtgatctcggacatcctggattggaagaccagtcgcaccttcttctattggagactccggagactccttttggaggatttggtaaagaagaaaatacataatgcaaaccccgagctgaccgatggccaaatccaggccatgctaaggcgctggttcgtcgaggtagaagggacagtgaaggcatatgtttgggacaacaacaaggatctagccgaatggctggagaagcagctcactgaggaggatggtgtccacagcgtgattgaggaaaatatcaagtgtatttccagggactatgttctcaaacagatccgctctctggtgcaggcgaaccccgaggtagccatggatagtatcatccatatgacacagcacatatctccaacccagagagcagaagtaatacgcattctgtctacgatggactctccctctacctag

SEQ ID NO: 13719 - DNA, 6867 bp, Artificial Sequence
  Description of Artificial Sequence: Synthetic coding sequence
atggagggctcacccgaagagaacaaggagatgaggtactacatgctacagaggtcttccatgagcggattgcacctcgttaagcaggggcgtgaccgcaagaaaattgatagtcagcgcgacttcaccgtggccagccctgcagagtttgtaacccgctttgggggaaataaggtgatcgagaaagttctcatcgcaaacaacggcatagccgctgtcaaatgcatgcgtagcattcggcgctggtcttacgagatgttccgcaacgagcgagctattcgttttgtagttatggtgacaccagaggatctgaaggcaaacgcagagtatatcaaaatggccgaccactatgttcctgtgccaggggggcccaacaacaacaactacgctaacgtggaactgatcctggacatcgctaaacgaattcctgtccaagccgtttgggcaggctggggccacgcatccgagaatcctaagctgccagagctgcttcttaaaaatggaatagccttcatggggccgccctcacaggccatgtgggccctgggggataagatcgcttcttcaattgtggcgcagaccgcagggattccaacgctgccttggtcaggaagtggactccgagttgattggcaggagaatgacttcagtaagcgaatacttaatgtgccccaagaattgtatgaaaaggggtacgtgaaagatgtcgacgacggactgcaggccgccgaggaagtcggataccctgtcatgattaaagcttctgaaggtggcgggggaaagggcatccgcaaagttaataacgccgatgacttccctaaccttttccgccaggtccaagccgaggtccctggttctcccatcttcgttatgcggctcgccaagcagtctcgacacctcgaagttcaaatcttagctgatcagtatggtaacgctatctccttattcggacgagattgctcagttcagagaaggcatcagaaaatcattgaggaagcaccggcgacaatagccactccggccgtattcgaacatatggagcagtgcgccgtgaagctggcaaagatggtcggctacgtctcagcaggcacagtagagtacctctacagccaagatggtagtttttacttcctcgagttaaacccacggctccaggtggaacacccatgcaccgaaatggttgccgacgtgaatcttccagccgcccaactccagattgccatggggattccactttacagaataaaggatatccgcatgatgtacggtgtctccccctggggggatagcccaatcgatttcgaggatagtgcccatgtgccctgcccgcgcggccacgtgatcgccgcacgcatcaccagcgaaaaccctgatgaagggtttaaacccagttccggcaccgtgcaagagcttaacttccgatcgaataagaacgtgtggggttatttctccgtggccgcagcaggtggcctgcacgagttcgccgatagtcaatttggccactgtttttcctggggggagaacagggaggaagcaatctcaaacatggtcgtggctttaaaagaactaagtattcgaggggattttcggacaactgtggagtacctgattaagcttctggaaaccgaaagtttccagatgaatcggattgacacaggctggctggacagactaatcgccgagaaggtgcaagccgaacggccagacactatgctcggtgtcgtctgcggtgcccttcacgtcgcggatgtcagtttgaggaattcagtatctaactttcttcacagccttgagcgaggtcaggtcttgcccgcgcatactctgctcaacaccgttgatgtggaactgatctacgaaggtgtcaaatacgtgctgaaagttactcgacaaagtccgaactcctatgttgtaattatgaacggctcttgtgtggaagtcgacgtccatcgactttcagatgggggcttactgctttcctacgacggtagcagctatacgacatacatgaaggaagaggttgaccggtatcggatcactatcgggaacaaaacatgcgtgttcgagaaggagaacgacccttcagtgatgcgcagtccaagcgccgggaaactaatccagtatattgtggaagatggtggccatgtgtttgccggtcagtgttatgctgagattgaagtcatgaagatggtgatgaccctgacggccgtggaaagcggatgtattcactatgttaagcgtcctggggcagctctggatccaggttgtgtactcgcgaagatgcagttggataacccctcgaaggtccagcaagctgaacttcacaccgggagtctacctcgcatacagtctaccgctttacgcggcgagaaattgcatagggtgttccactacgtgttggataatctggtcaacgtaatgaatggctactgcctgccagaccccttcttttcttctaaggtgaaggactgggtcgaacgtctgatgaaaaccctccgagatccttccttgccactgctggagcttcaggacataatgactagtgtatctgggcggatccctcccaacgtggagaagtcaattaagaaagagatggcgcagtacgcctccaatattacctccgttctatgtcaatttccaagtcagcaaatagcgaatattttggattcccacgccgcaacgcttaaccgcaaatctgaacgggaagtgtttttcatgaacacccagagcattgtgcagttggtccaacgatatcgcagtggcataagaggacacatgaaggccgttgtcatggatttgctgaggcagtaccttagggtcgaaacccagttccagaacgggcactatgacaagtgcgtgttcgccctgcgcgaagaaaataagtctgacatgaacaccgtgttaaactatatattcagccatgcccaagtgactaaaaaaaacctgctggtgacaatgttgattgaccagctgtgtggtcgtgatcccaccttaacggacgaactgctcaacatcttgacggaactgacccaactctccaagacaaccaacgccaaggtcgccttgagggcacgacaggtgttaatcgcatcacaccttccgagctacgaactgaggcacaatcaagtcgagtccatctttctgtctgccatcgacatgtacggccaccagttctgtattgagaaccttcagaagttaatcctatctgagacatctatttttgatgtgttaccaaacttcttttatcacagcaaccaggttgtgcgcatggccgccctggaggtctatgtccggagggcctacattgcctacgaactaaatagtgtccagcacaggcagctgaaggacaatacttgcgtcgttgagtttcagttcatgctgcccacgtcacatcctaatagagggaatatacctacattgaatcggatgagctttagctctaaccttaaccattacgggatgacacatgtggcttctgtatccgacgtgctcttggataatagttttacaccgccttgtcagagaatgggcgggatggtcagcttcagaaccttcgaggattttgtgaggatcttcgacgaagtaatgggatgcttctcagatagtcctccgcagtctcccacctttccagaggctgggcatacctctctttacgatgaggacaaagttcccagagatgagcccatccatatcctcaatgtggccatcaaaactgattgcgacattgaggatgacagactagccgcaatgttcagagagttcacacaacagaataaggccaccttggtcgaccacggcattcgacgactgacattcctcgtggcacagaaagacttccggaaacaggtcaattatgaggtggatagacgtttccatcgagagttcccgaaattttttacattcagggccagggacaaatttgaggaagataggatataccgccaccttgagcccgccctggcatttcaactagagctgaatagaatgcgcaactttgacctcaccgctattccctgtgctaaccacaagatgcatttgtacttaggagcagccaaggtcgaggtgggcacagaggtaacggactaccgtttcttcgtaagagctattataagacactccgacctcgtgacaaaggaagcttcctttgaatatctgcaaaatgagggagagagactgttgctggaagccatggatgaactggaagtcgcctttaataataccaacgtccgcaccgattgcaaccacatattcctcaattttgtgcctaccgtgattatggatccctctaaaattgaggaatctgtgcgatcaatggtaatgagatacgggtcccgcctgtggaaattgcgtgtgctgcaggcagagctcaaaatcaacattcgtctgacacccacaggcaaagcgatccccatcaggctgttcctcacaaatgagagcggatattacctagatattagcctctacaaggaggtgacagactccagaacggcccaaatcatgtttcaggcctacggcgacaaacagggtccactgcacggaatgctcattaacaccccttatgtcactaaggatctgctccagagcaagagatttcaggcccagtcgctcggcactacgtatatctatgacatccccgagatgttccgccagtccctgatcaaactgtgggagagtatgagcactcaggcctttttaccctccccgcccctgccaagcgatatgctcacgtacaccgagctggtgctcgatgatcaggggcagctggttcacatgaacagactccccggtggcaacgagattgggatggtggcttggaagatgacctttaaaagtccagaatacccagaggggcgagatatcatcgtaattggaaatgatatcacttacaggatcggatcctttggcccgcaggaggacctgctgttcctgcgtgcctccgagttggcacgagcggaggggatccctaggatctacgtgtcggcaaactctggcgcccgtattggattggcagaggaaatccggcacatgttccatgtggcctgggttgacccagaggatccctacaagggctatagatatctctatctgactccacaagattacaagcgagtgtccgcacttaactcagtgcattgtgaacacgtggaggatgagggcgagagtcggtacaagattacagatattataggtaaggaggagggcatcggcccagagaatttgagaggttccggcatgattgcgggcgagtctagccttgcctacaatgaaatcatcactatttccctggtgacatgccgggccattggtatcggagcctacttggtgaggctgggccagagaacaatacaggtggagaattctcaccttatcttaaccggggctggggcattgaacaaggtcttggggcgtgaagtatacacaagcaataaccaactaggcgggatccagataatgcacaataacggagtcacccactgtaccgtatgcgacgattttgaaggagtgtttacagtccttcactggttaagttacatgcccaagtccgttcattcgtcagtacctctcctgaattcgaaggacccgatagatcggatcatcgagttcgtgccaacaaagaccccatatgacccgcgctggatgcttgccggtcgccctcaccctacccaaaaaggtcaatggttgtccggtttctttgactacgggagcttttccgaaataatgcagccgtgggctcagacggtcgtcgtggggcgtgcacggttaggggggatccccgtgggagtagtggcagtcgagactcgaaccgtggaactgagtattcccgctgaccccgcgaatctcgattctgaggctaaaattatccagcaagccggtcaggtttggttccctgacagtgcatttaagacctatcaggcaatcaaagattttaaccgggagggcctgcccctaatggtttttgcgaattggcgggggttcagtggtgggatgaaggacatgtacgaccaggttttgaagttcggagcttatattgtcgacggtctcagagagtgttgtcagccggtcctggtatatatccctcctcaggccgagctgcggggtggcagttgggtagtcatcgattcctccatcaaccctcggcacatggaaatgtatgcagaccgcgagagtcggggttccgttctcgaacccgaaggaacagtggaaataaaattccggagaaaggaccttgtgaaaaccatgcgccgggtggatcctgtgtatatacatctagccgaaaggttgggcacgccggagctgagcactgcggagcgcaaggagctggagaataaactgaaggagcgagaggagtttttaattcccatctaccatcaggtcgctgtgcagtttgcagacctacacgatactccagggcggatgcaggagaagggagtgatcagcgatattctggactggaagacctcccgaaccttcttttattggagacttaggcgcctgttattagaggacctcgtcaagaaaaaaatccataatgctaatcccgagctgacagacggccagatccaagccatgctgagacgctggttcgtcgaggtggagggcacagtgaaagcctacgtgtgggataataataaagatcttgctgaatggcttgagaaacagctgacagaggaagacggggttcactctgtgattgaagaaaatatcaagtgcatttcccgggactacgtgctgaaacagattaggagcttagttcaagcaaatcccgaggtggcaatggactctataattcatatgacccagcatatctccccgacgcagagggcagaggtcatacggattctctcgaccatggacagtccttcgacatag

SEQ ID NO: 13720 - DNA, 1419 bp, Artificial Sequence
  Description of Artificial Sequence: Synthetic coding sequence
atgcacaataacggtgtcacccattgtacagtctgcgacgacttcgagggtgtcttcacagtccttcactggcttagctacatgcccaagtccgtgcattccagcgtgccactactgaactctaaggatccaatcgacaggataattgagttcgtccctaccaagaccccctacgatccccggtggatgctggccggccgcccccacccaactcaaaagggacagtggttatcgggattttttgattatggcagcttttcagagattatgcagccttgggcacaaacggtagtggtcggccgtgcccgtttaggggggatccccgttggcgtcgtggcagtcgagacacgcactgtcgagctgtccattcccgctgaccctgccaatctggacagcgaagctaagatcatccagcaggccggtcaagtatggttccctgactcagccttcaagacttatcaagcaataaaggactttaaccgggagggattgcctctgatggtgtttgccaattggagaggattttcaggtggtatgaaagatatgtacgatcaggtcttaaagtttggcgcatatatagtagacgggctgcgggagtgctgccagcccgtattggtatacattccaccacaggccgagctgcggggaggttcctgggtggtcattgacagtagcattaacccccgtcacatggagatgtatgccgatagagagtcccgcggatctgtcctggagccggagggtaccgtggagatcaagtttcgtagaaaggacttggttaagactatgcgacgggttgatcctgtgtacatccatttggctgaaagattgggcacgcccgaactcagcaccgccgaacgcaaagagttggagaataaattgaaggagagagaggaatttttgattccaatttatcaccaggtcgccgtacagttcgcggatcttcacgacacgcccggacgaatgcaggaaaagggcgttattagcgacattttggactggaaaacttcgaggacctttttctattggcggctacgccgacttttactggaggacctagtaaaaaagaagattcataatgccaaccccgaactcactgacggtcagatacaggcgatgcttcgccgatggttcgttgaggtggagggtacagttaaggcgtatgtgtgggataacaacaaggacctagcagagtggctggagaagcaactgactgaagaagatggggtgcacagtgtcattgaagaaaatatcaaatgtatttctcgagactacgtgctcaagcaaatcagatctctggtccaggcaaaccctgaggtggcaatggattccatcatacatatgacacaacatattagtcccacccagagagctgaggttatccgcatactgtccacaatggatagtccctcaacctag

SEQ ID NO: 13721 - DNA, 129 bp, Artificial Sequence
  Description of Artificial Sequence: Synthetic coding sequence
atgtccggactccacctggtgaaacagggacgcgataggaagaagatagatagccagcgagattttaccgtcgcgagtcccgccgaatttgtcaccagatttggcggtaacaaggtaatcgagaagtag

SEQ ID NO: 13722 - DNA, 7041 bp, Artificial Sequence
  Description of Artificial Sequence: Synthetic coding sequence
atggacgaaccctcaccattagcccagcctctcgagttgaaccaacactctcgcttcataattggatcggttagcgaggacaacagtgaagatgagatttccaaccttgtcaaattggatctgctggaggaaaaagagggatccctttccccagcatcggtgggctcagatacactgagcgacctggggataagtagcctgcaggacgggctcgcactgcacattagatccagcatgtccgggctgcatttggtgaaacaaggcagagaccggaaaaaaatcgactcccagcgggactttaccgtcgctagtccggcagagtttgtgacacgcttcggcgggaataaggtgatagaaaaggtgctcatagccaacaacggaattgcagccgtcaaatgcatgcggagtattcggcgttggagttacgagatgtttcgaaatgagcgggcaattcggttcgtggtcatggtcactcctgaagatctgaaagcaaatgctgaatacatcaagatggcagaccattatgtgcctgtgccgggtgggcctaacaacaacaactatgccaatgttgagctaattctggacatagccaagagaataccagttcaggccgtttgggctggttggggacacgcatccgagaaccccaagctccctgagcttttgctaaagaacggtattgcatttatgggccccccgtcacaagctatgtgggcattaggagataaaatcgcctccagcatagtggctcagacagccggcatccccaccctgccgtggtctggctctggccttcgggtggactggcaagagaacgacttttcgaagcgcattttgaatgtccctcaggaactgtacgagaagggatatgttaaggatgtagatgatggacttcaagcggctgaagaagtgggttatcccgtgatgataaaagccagcgaggggggtgggggcaaggggattcggaaggtgaacaacgccgacgatttcccaaatctgttccgtcaggtccaggctgaggtcccaggatcccccatctttgtaatgagactggctaagcagtctagacatttagaagttcagatcctcgccgaccaatacggcaatgcaatttcactgtttggtcgtgactgttcagtccagagacgccatcagaagattatcgaggaagcgcccgctaccatcgctacccctgccgtgtttgagcatatggagcagtgcgctgttaagttggccaaaatggtcggctatgttagcgccggaacggtggaatacctgtacagccaggatggatcattctattttctcgaactgaacccccgactgcaggtggagcatccctgtacagagatggttgctgatgtgaacctcccagcggctcagctgcaaatagcgatgggcattcccctgtatcgtattaaagatatcagaatgatgtatggggtctctccatggggtgatagcccaatcgattttgaggatagcgcccatgtgccatgtcctcgtggccacgtcattgctgcaaggattacctcagaaaatccagatgagggtttcaagccgtcctcaggcaccgttcaagagctgaattttcggtctaacaagaacgtatgggggtatttttcagtcgcagccgcgggcggactgcatgaattcgccgacagccagtttggacattgcttctcctggggtgaaaatagagaagaggcgattagcaatatggtagtggcattaaaagaactgtcgattagaggggacttccgcactacagtggaatatctcattaagctgctggaaactgagtcatttcagatgaataggattgataccgggtggcttgaccgcctgattgcagagaaggttcaggccgagagacccgatactatgctgggcgtggtgtgcggagcactgcacgttgcggatgtgagtttgcgtaatagtgtcagcaattttcttcattccttggagcgggggcaagtccttccagcccatacccttctgaacaccgttgatgttgagctgatctatgaaggtgtgaagtatgttctcaaagttacccgccagagcccaaattcctacgtcgtcataatgaatgggagttgcgtggaagtggacgtgcatcggctgtcggacggcgggttgcttctgtcatacgatggttctagctacacaacctacatgaaggaggaggtggataggtataggattactatcggaaataaaacatgcgtgttcgagaaggagaatgaccccagcgtgatgcgctctccatctgccgggaaacttatacaatatatcgtggaggacggcgggcacgtgttcgctggccagtgctacgccgaaatagaggtgatgaaaatggttatgactttgacagctgttgagagcggctgtatccactatgtgaaacggcccggcgcagccctcgatccgggctgtgtcctggctaaaatgcaactcgacaaccccagtaaagtgcagcaggcagaactgcacacgggctccctcccccgaatccagtctactgccctgcgaggagaaaagctgcatagagtctttcattatgtgctggataatctggttaatgttatgaacggttactgcttgcccgatccatttttcagttcaaaagtcaaggattgggtggagcgcctgatgaagacattgagggatccatccctccctttgttggaactacaagacataatgacttccgtgtcaggtaggatcccaccgaatgtcgaaaagagcatcaaaaaagagatggcacagtacgcttctaatatcacttctgtgctatgtcaatttcccagccagcagattgccaatatactggactcgcacgctgcgactctcaaccgcaagtccgagcgggaagtattcttcatgaacactcagagtatcgtgcagctggtccagcggtaccggagtggcatcagaggtcacatgaaggccgtcgtgatggatttactaagacagtatcttcgagttgagactcagttccaaaatggtcattacgacaagtgcgtgtttgccctgagggaggaaaataagagcgacatgaacactgtgctgaattacatcttcagccacgctcaggttacaaaaaaaaatttactggttacaatgctaattgaccagctgtgtgggagagatcccactttaacagatgagctgctgaatattctcactgaactgacccagctgagtaagacgacaaatgctaaagtagcgctgcgtgcacgacaagtccttattgctagtcacttgccttcttacgaattgaggcacaatcaagtcgagagcatttttctttcagcaatagatatgtacggtcatcagttctgcatagaaaaccttcagaaattaattctgagcgagacctcgatttttgacgtgttgccgaactttttttaccactcgaatcaggtcgtgcgaatggccgccctcgaggtgtatgtgcggcgagcctacattgcatacgaattaaattccgttcagcacagacagcttaaggataatacttgcgtcgtggagtttcagtttatgttacccacaagccatcccaatcgggggaatattccaaccttaaatcgcatgtcctttagctccaatctcaatcattacggcatgacacatgtggcatcagtgtctgatgtgctgcttgacaattcgttcacacccccatgtcagaggatgggcgggatggtctccttcaggacattcgaagactttgttcgcatatttgacgaggttatgggctgttttagtgactctcccccgcaatcccccaccttccccgaggcaggtcatacgtcactttacgacgaggacaaagtcccacgcgacgagcccatccatatactgaatgtggccatcaagacagattgtgatattgaagacgacaggctcgcagccatgtttcgggaattcacccagcagaataaggctaccctcgtggaccatggaattcgcaggctcacatttctcgtcgcccaaaaagatttcagaaaacaggtaaactatgaagtggatcgacgatttcacagagagttccctaaattcttcacgttcagggctcgagataagtttgaagaagacagaatatatcgccacctggagcccgcgcttgcctttcagctggagctgaatcgcatgcggaacttcgatttaaccgccataccatgcgccaaccataagatgcacctatacctgggcgccgcgaaggtggaagttggcaccgaggttacagactacagattttttgttcgagccattattagacattctgaccttgtgactaaggaagcgagctttgagtacctgcagaatgaaggggagagactgttactagaagccatggatgaacttgaagttgcttttaacaacactaacgtgagaacagactgtaatcacatttttctgaacttcgtccctaccgtcatcatggacccttccaagattgaagaaagtgtccgaagtatggtgatgcgctacgggagccgtctgtggaaacttagggttctgcaggccgaattaaaaataaacatcaggttgactcctaccggaaaggccatccctataagactctttctaactaacgagtcggggtactacctcgatatttcactttataaggaggtaaccgatagccgaacagctcagattatgtttcaagcctacggtgacaagcaggggcccctgcacggaatgttgataaacactccttacgtcactaaggatctgttgcaatctaagcggttccaggcccaatcccttggaaccacttacatttacgatatcccagagatgtttaggcagtccttgatcaaactctgggagagtatgagcactcaggcatttcttccttctcccccacttcccagcgatatgcttacctacactgagctcgtgcttgacgaccagggacagctcgtacatatgaatagactgcccggggggaatgaaatcggaatggtagcttggaagatgaccttcaagtctcccgaatacccagaggggagagacataattgttatcgggaacgacatcacatataggattggatctttcggcccacaagaagatctcctatttttacgggccagcgagttggctcgagctgaaggaattccacgcatatacgtgtctgctaattctggagctcgcattggtcttgcagaggagatccgtcacatgtttcacgtagcatgggtggatccggaggatccttacaaagggtaccgttacctctatctcacaccgcaggactacaaaagggtgtccgctttgaactcagtgcactgcgagcacgtcgaagatgaaggagaatccaggtacaagatcactgatataatcggtaaggaagagggtatcggccccgaaaaccttcgaggatccgggatgattgcgggagagtcaagcttggcttataatgagatcatcactatttctctcgtcacctgccgcgcgatcggaatcggcgcctatttggtgcgattggggcagagaacaatccaggtcgaaaattctcacttgatcctgactggtgcaggcgctctgaataaggttctaggccgcgaggtgtacactagcaacaatcagttgggaggtatccagattatgcataataatggtgtgacccactgcaccgtctgtgatgactttgagggcgtatttacggtactgcactggctgagttatatgccaaagagtgtccattccagcgtgcctctgctgaattctaaggacccgatcgatcgaataatcgaattcgtccccactaagaccccgtatgaccccaggtggatgctggcaggcaggccacatccaacacaaaaaggccaatggctatcaggatttttcgactacggctcatttagtgaaataatgcagccctgggcacagactgtggtggtggggagggctcggctgggcgggatccctgtgggtgtggtggccgtggagacccggaccgtggagctcagtatccccgccgaccccgctaacctggattcagaggctaaaatcatacagcaagcgggacaagtttggttccctgacagcgccttcaaaacctaccaggccataaaagactttaatcgtgagggactgccactcatggtgtttgctaattggcgcgggttttcagggggtatgaaggatatgtatgatcaagttcttaagtttggtgcttacatagtggatggcctacgagagtgctgccagccggtgctggtgtatatccccccacaggccgagctgcgaggggggtcctgggttgtcatcgatagctctattaacccaaggcacatggagatgtacgccgacagggagtcccgagggtctgttctcgagcctgaggggactgtcgagatcaaatttcgccggaaagatctggtgaagactatgaggagggtggatccggtgtatatacacctcgccgagcggctgggtacacctgaactgagtacagcggaacgcaaagagctagaaaataagctgaaggagagggaagaattcctcatccccatctaccaccaggtcgctgtccagttcgcagaccttcatgataccccaggtagaatgcaggaaaagggggtgatatcggatatcctagactggaaaacatctagaaccttcttctattggcgattacgacgtctactattggaagatttggtcaagaagaagatccataatgccaaccccgagttaacggacggacagattcaggcaatgctgcgacgttggttcgtggaagttgagggtacggtaaaagcgtacgtgtgggataataataaggatcttgccgagtggctggagaaacagctaaccgaggaagacggcgtccatagcgttatcgaggagaatattaagtgtatttccagagattacgtactgaagcagatccgctccctggtgcaggctaatccagaggtagctatggattctattatccacatgacgcagcatatcagccccacacaaagggcagaggtaatcaggattttaagtaccatggattctccatctacctag

SEQ ID NO: 13723 - DNA, 129 bp, Artificial Sequence
  Description of Artificial Sequence: Synthetic coding sequence
atgagtgggcttcatctcgtcaagcagggcagggataggaagaaaatagactctcagcgggacttcaccgtagcttcaccagcagagttcgttacaaggtttggggggaataaagtaatcgagaaatag

SEQ ID NO: 13724 - DNA, 234 bp, Artificial Sequence
  Description of Artificial Sequence: Synthetic coding sequence
atggatgaaccttctcctttggcgcaacccctggagctgaatcagcattccagattcatcattggaagcgtttccgaggacaatagcgaggatgagatctccaacctcgtgaaactcgatctgcttgaggagaaggagggctcgttaagcccggcttcagtcggatcagacacactcagcgacctcggaatctcctcactgcaggacggcctggccctgcacataagattatag

SEQ ID NO: 13725 - DNA, 3138 bp, Artificial Sequence
  Description of Artificial Sequence: Synthetic coding sequence
atgggatgcttttccgactcccccccacaaagcccaaccttccccgaggcaggtcatacatccctttacgacgaggataaggtcccccgggacgaacctattcatattcttaacgtcgcgattaagactgactgcgatattgaggatgataggctggcagcgatgtttagggaattcacacagcagaataaggccactctggtagatcacggtatccgccgactgaccttcctcgtggctcaaaaggattttcgcaaacaggttaactacgaagtggacagacgctttcacagggagtttcctaagttctttacgttccgagcccgggacaaattcgaggaggaccggatctaccggcatctggagcccgctttggcctttcagttagaactcaacaggatgaggaactttgatcttactgcgattccatgcgcgaaccataagatgcacctgtacttaggagctgccaaggtagaggtggggaccgaagtaactgattaccgcttcttcgtgagagctattatccgccatagcgaccttgttaccaaagaagcctctttcgagtacctccagaacgaaggagagcgtctcctgttagaagctatggacgagcttgaggttgcttttaataatacaaacgtgcggaccgattgcaaccacatttttctcaactttgtgccaaccgtcattatggatccttcaaagattgaggaatccgtccggtcaatggtaatgaggtatggaagcaggctatggaaattgagggtgctccaggcagagctcaaaattaatattcgacttactcctactggcaaggccattcccatcagactctttttgaccaatgagtccggatactatctggatatctctctatataaggaggttacagactccagaacagcacagattatgttccaagcttacggcgataagcagggaccgcttcacggtatgttgatcaatacaccctacgtgacgaaagatttactccagagcaaacggttccaggcacagagtctgggaaccacctacatttatgacattccagagatgttccgtcaaatcggcatggttgcttggaagatgactttcaagagccccgaataccctgagggaagagacataatcgtgattggaaacgacatcacctacaggattggatctttcggaccccaggaggacctcctgttccttagagcttccgagctggctagagccgaggggatacccagaatctatgtttccgccaattcaggcgctcgcattggtcttgcagaagaaattaggcatatgtttcatgtcgcttgggtggaccctgaggacccatataagggctaccgctatttgtacctgacgcctcaagactacaagcgcgtctccgcattgaattccgttcattgcgagcacgtggaggacgaaggggagtcacggtacaagatcacagatattataggaaaggaggaagggatcggccctgagaaccttagagggtctggcatgatagcaggcgaatcaagcctggcatataacgaaatcatcacgatcagtctcgttacttgccgcgctatcggcattggagcttatttggtaagacttgggcagagaacaatccaagtggaaaattcccatctcattctcacaggcgcaggggccctgaataaggtgctcgggcgggaagtgtacaccagcaacaaccagttgggcggaatccagattatgcacaataacggcgtgacacattgcacagtctgcgacgacttcgagggagttttcactgtgttacactggttgagctacatgcctaagtccgtgcactctagcgtccccctgctcaacagcaaagatcccatagaccgaattattgagtttgtccctacaaaaacaccgtacgaccccagatggatgctcgccggtcgcccgcatccaacgcagaagggacagtggcttagcggtttttttgattatggatctttctccgagatcatgcagccatgggctcagacagtggtcgttggtagggcacggttagggggaatcccagtgggtgtcgtagccgtcgagacaaggaccgtggaactcagcattccagccgaccctgccaatttggatagtgaggccaagataatccagcaggcaggacaggtctggtttccagacagcgctttcaaaacctatcaagctattaaagacttcaatcgggagggtttacccctgatggtgttcgccaactggcggggtttcagcggaggcatgaaagacatgtacgatcaggtgctcaagtttggggcctatattgtcgatggtctgcgagagtgttgccagcctgttctcgtgtatatccctccacaggctgagttgcggggtggaagctgggtggtcatagactcctctatcaaccccagacacatggaaatgtacgctgaccgggagagtagaggcagcgtgctggagccagaaggtaccgtggagatcaaatttcggcgtaaagatctggtcaagaccatgcgtcgcgttgacccggtgtatattcaccttgcggagcgccttgggaccccagaactaagtaccgctgagaggaaggagctggaaaacaagttgaaagagagagaagaatttctgattcccatctatcaccaggtcgcggttcagttcgccgatctgcacgatacccctgggagaatgcaggaaaaaggcgtgatctccgatatattggactggaagacttcccgaacatttttctactggcggcttaggcgactgctcctggaggatctggtcaaaaaaaaaattcataatgccaatccagagctcacggatggccaaattcaggcaatgctgcgtcgatggttcgtcgaggttgagggcaccgtcaaggcttacgtgtgggataataataaggacctggccgaatggttggaaaaacaactgaccgaggaggacggcgtgcactccgtcatcgaggagaacattaagtgcatttcacgggactatgtgctgaagcagattcgctctctggtgcaggctaatccagaagttgccatggatagcatcatacatatgacccaacacatttcgcctacacagcgcgcagaagtgattagaatcctgtccaccatggatagccccagcacgtag

SEQ ID NO: 13726 - DNA, 363 bp, Artificial Sequence
  Description of Artificial Sequence: Synthetic coding sequence
atggatgagccctcacccttggcccagcccttagagcttaaccaacactctcgctttatcattgggtccgtgagtgaggacaattcggaagatgaaatcagtaatctcgttaaactggatttgctcgaggagaaagaaggaagcctgtctcctgccagtgtagggagtgataccttgtctgatctggggatctcatccttgcaggatggacttgctctccatatccgttcgagcatgagcggcttgcacttggtgaagcagggtcgagatcggaagaaaatcgactcccagagggatttcacagtagcctctcccgctgaattcgtgactaggttcgggggcaataaagtgattgagaaatag

SEQ ID NO: 13727 - DNA, 7113 bp, Artificial Sequence
  Description of Artificial Sequence: Synthetic coding sequence
agcttctggaagtggatcagcactcagacagtgagaattatccgggctgtgagagcgcattttggcggaatcatggatgaaccatctccactggctcagccattggagctgaaccagcacagtaggtttattattggttcagtctctgaagataatagtgaagatgagattagtaatctggtgaagttggacctacttgaggaaaaggaaggatctttgtcacccgctagtgttggctccgataccttaagtgatctgggcatctcctctctgcaagacgggctggccttgcacatacgaagttctatgtcgggactgcatttggtgaaacagggtagggaccgcaagaaaattgatagccagcgggatttcactgtggcgtcccccgccgagtttgtaacccggttcggcggtaataaggttattgaaaaggtgcttattgcaaacaacgggatcgctgcggtaaaatgcatgagatccatcagaagatggtcatatgagatgtttaggaacgagcgagccattcgttttgtcgtgatggtgacccctgaggatctaaaagccaatgctgagtacattaagatggcagaccattatgtcccagtgccaggcggccccaataacaataactatgccaacgttgagctaatcctggacattgctaagagaatacccgtgcaagcagtgtgggccgggtgggggcatgcttcagaaaatcccaagttacccgagttgttactcaagaatggaatcgcgtttatgggtcccccatcacaagcgatgtgggctctcggggataagatagcctcatctatagtcgcccagaccgccgggattcctaccctgccctggagtggctccggtctacgagtggattggcaggaaaacgacttttcaaagaggatactcaatgtcccccaagagctgtacgagaagggctacgtaaaagatgtcgatgacggccttcaggcagccgaagaagtgggatatccagtgatgatcaaagccagcgagggaggtggtggcaaaggaatacggaaagtcaacaacgctgatgattttccaaacctctttcggcaggttcaggccgaggtgcccggcagcccaatttttgtgatgagactggccaagcagtcacggcaccttgaagtccaaattctggcggatcagtatggtaacgctatttcactgtttggaagagactgttccgttcagaggcgacaccagaagataatcgaggaagctccggccacaatagctacacctgcggtcttcgagcatatggaacagtgcgccgtgaaactcgcgaagatggttgggtatgtctcagcaggcactgtcgagtacctttattcccaagacggcagtttctactttctcgaactgaatccaaggctacaggtcgaacacccctgtaccgagatggtagctgacgtgaatctgcccgccgcccagttgcagattgccatggggatccctctctatagaatcaaggacattaggatgatgtatggggtctccccttggggcgacagccctattgattttgaggattcagcacacgttccctgtccccggggccatgttattgctgctcgcatcacatcagagaaccccgacgaaggtttcaagcccagctccggcaccgtccaagagctaaacttcaggtccaacaagaatgtttgggggtacttctctgttgccgcagcaggtgggttgcacgaattcgccgacagccaatttggacactgcttctcgtggggggagaaccgcgaggaggccataagtaatatggtggtggcactgaaggaactaagcatcaggggagattttcgcactaccgtggaatatctcatcaagttactggaaactgagagctttcagatgaataggatcgacaccggctggctggacaggctgattgctgagaaggtccaagccgagcgtccagacacgatgctaggtgtcgtctgtggcgctctacatgtcgccgacgtgtcgctgcgcaactcagtgtctaatttcttgcacagtctggagcgcggtcaggtgctgcctgcccatacactgctcaataccgtcgatgtggaactcatttacgaaggagtaaagtacgttttaaaagttactcggcagtcccccaatagctatgtcgtcataatgaacggcagctgtgtggaagtggacgtgcatcggctaagtgatgggggactgctgctcagttacgatggaagttcttacacgacgtacatgaaggaagaggttgatcgctatcgcattaccatcggcaacaagacatgcgtgttcgagaaagaaaatgaccctagcgttatgcggtcaccttctgcaggcaaattgatccaatatattgtggaagatggcggtcacgtcttcgcaggtcagtgctacgcagaaattgaggtcatgaagatggttatgacattgactgcagtagagtctgggtgtattcattatgtcaaacggcccggtgcggctttagaccccggctgcgtccttgccaagatgcagctagacaacccttccaaagttcagcaggcagaattgcatacaggatcactgcctagaatacaatcaaccgccctcaggggggaaaaactccatcgagtgtttcactacgtgctagataatctcgtcaacgttatgaatggctactgcctccctgatccttttttttcttccaaggtgaaggattgggtagagagactcatgaagactctacgcgatccatcactgccattactcgagcttcaagacatcatgacgtcggtcagtggccggataccacccaacgttgaaaaatcaatcaagaaggaaatggcccagtacgcttccaacatcacgtctgtgctctgtcagtttcctagccaacagatagccaacatccttgattcacacgcagcaacactcaacaggaagtctgaacgcgaggtattcttcatgaacacgcagagcatcgtacagctcgtccagaggtacagaagcgggatcaggggccatatgaaggccgtcgtgatggacctgctgcgccagtatcttcgggtggagacgcagttccagaacggtcactacgataagtgcgtcttcgcgctccgcgaagagaataaatcagatatgaacactgttctcaactacattttcagtcatgcccaggtcacaaagaagaacctactagtcactatgctgattgatcagctgtgcgggcgagatcccacattgacagacgaattgttgaacatccttaccgaattgacccaactgtcaaaaacaaccaacgctaaagtggccctccgagcccgccaagttctgattgccagtcacttgcccagttacgaactccgtcataatcaggtggaaagtatcttcttaagcgccatagacatgtacggccaccagttttgtatcgaaaacctacaaaagctcatcctgtccgagacgtccatctttgatgtgcttcccaactttttctaccactcgaatcaggtcgtcaggatggctgccctcgaagtgtacgttaggagagcgtacatcgcctacgaactgaatagcgtgcagcacaggcagcttaaggataacacctgcgtggtcgaatttcagtttatgctaccgactagtcatcctaatcgcggcaatattcccactctgaatcgtatgagtttctcttccaacctcaatcactatgggatgactcacgtagcaagtgtctccgacgtgttgctcgataactcttttacacccccgtgtcagcgcatgggaggcatggttagcttccggactttcgaggactttgtgcgaatcttcgatgaggttatggggtgttttagcgactcaccccctcaaagccccacttttcccgaggctggccacaccagcctgtacgacgaggacaaggtgcccagagacgaaccaattcacatcctgaacgtagcgattaaaacagactgtgatatcgaggatgatcgactggccgccatgttccgagagttcacacagcagaataaggcaacccttgttgatcatgggataagacgcctgactttcctcgtggcccagaaggatttccggaagcaggttaattacgaggtagaccggagattccatagagagttcccaaaattcttcacattccgcgctagggataagttcgaagaagatcgcatctaccgtcacctggaacctgccttggcctttcagctggaactcaacaggatgcgaaacttcgatctgacagctattccctgtgctaaccacaaaatgcacctgtatttgggcgctgcaaaggttgaggtcggaaccgaggttaccgactatcggttcttcgtccgagcgatcatccgccatagcgacctggttacaaaggaggcatctttcgagtaccttcagaacgagggcgagcgtttactcctggaggccatggacgaactggaggtcgcattcaacaatacaaatgttcgaactgactgcaatcacatcttcctcaactttgtgccaacagtgattatggacccatctaagatagaagaatcggtcaggtcgatggtgatgaggtacgggagtaggttgtggaagctgcgggtgttacaggcggagctgaagattaacatccgtctgaccccaacggggaaagcaattccaatcaggctgtttcttacaaacgaaagcggttattatcttgacatctctctgtataaggaagtgaccgactcccggactgctcagattatgtttcaggcttatggcgataaacagggccccctgcatggaatgctcattaacacaccgtacgtgactaaggatctgctgcaatccaaacggttccaggcgcagtcactaggaacaacctatatctacgacattcctgaaatgtttagacagtctctcataaaactgtgggagtctatgtcgactcaggcgttcctgccatctccaccactcccttctgacatgctaacatatacagaattggtgctcgatgaccagggacagttggtccatatgaacagactgccaggggggaacgagatcggcatggttgcctggaaaatgacattcaaaagtccagagtaccctgagggcagagatattatcgtgatcggtaatgatatcacataccgcatcgggtcttttggcccccaggaggatctgctgttcttacgtgcttcagagctcgcaagagctgaggggatccctagaatctatgtgtctgctaactcgggagccagaattggactggccgaggaaattcgtcatatgtttcatgtcgcatgggttgaccctgaagatccgtataagggatacaggtacctttacctcacccctcaggactataaacgagtttctgccctgaattcggttcactgcgagcacgtcgaggatgagggagagtcaaggtataaaataacagacattataggcaaagaagagggaatcgggccagaaaatcttagaggcagcggaatgattgccggagagagtagcctcgcgtataatgagatcatcaccatcagtctcgtcacttgccgagccattgggataggcgcttatctggtgcgactagggcagaggactattcaggtggagaatagccacctgatcctgaccggcgccggcgcacttaacaaagtgctgggccgcgaggtgtatacctctaataaccaactgggtggcatacagattatgcataacaacggcgtcacgcattgtacagtttgcgatgacttcgagggagtgttcaccgtgttgcactggctttcatacatgcctaagagcgttcactcctccgtccccctgctgaattccaaggacccaattgatcgcatcatcgagtttgttcctaccaagaccccgtatgatccacgctggatgttagcggggcggcctcacccaacacagaagggacagtggttgagtggtttcttcgactatgggtcatttagtgagattatgcagccttgggcacagactgtggtcgtcggaagagctagactggggggcatccccgtgggcgttgtcgcagtggagacccgcaccgttgaacttagtattcctgctgaccccgctaacctcgacagcgaggcaaagatcatacagcaggcgggtcaggtgtggtttcccgactccgcgtttaagacataccaggcaatcaaggacttcaatcgggaaggactcccgctcatggtgtttgccaactggagagggttttcgggcgggatgaaagatatgtacgaccaggtgctgaagttcggcgcatacatcgttgatgggttaagggagtgctgccagcccgtgctggtgtatatccctccacaggctgagctgcgtggcggttcctgggtggttatcgacagctccataaacccacgccatatggaaatgtacgccgaccgcgaaagtcgagggtcagtcctggaaccagaaggcaccgtggaaattaagttccggcggaaagacttagtcaagacaatgaggagagtagatccggtgtatattcacttggccgagcggcttggcacccctgagctgtcaaccgccgagagaaaggaattggagaacaagctgaaagaacgggaagaattcctcatccccatataccatcaagtggcagtgcaattcgctgacctccacgacactccaggaaggatgcaggaaaaaggtgtaatttccgatatcctggattggaagaccagtagaacctttttttactggaggcttagacgcctgcttctagaggatttagtcaagaaaaagatccataacgccaatcccgagctaacagacggacagatacaggcaatgctccgaagatggttcgttgaggtagaaggtactgtcaaggcatacgtgtgggataataataaagatctcgccgaatggctggaaaaacagctaacagaagaggacggggtacattccgtaatagaagaaaacataaaatgcattagcagggactacgtactcaagcaaatccgctccctggttcaggccaacccggaagtcgcaatggacagcataatacatatgacccaacacatcagccccacccaacgtgctgaggtaatccggattctgagtaccatggactcaccgtccacatag

SEQ ID NO: 13728 - DNA, 777 bp, Artificial Sequence
  Description of Artificial Sequence: Synthetic coding sequence
atgtctggcttacacttggtgaagcaggggcgcgacagaaagaagatcgacagtcagcgcgattttactgtggccagccctgcggagtttgtgaccagatttggcgggaataaggtgattgagaaagtgctgattgccaataacgggatagccgccgtcaagtgtatgcgatccatccggcggtggagctacgagatgttcagaaacgagcgagccataaggttcgttgtgatggtaacaccagaggacttgaaggctaacgccgagtacatcaagatggcggatcattacgtgccagttcccggtgggcccaacaacaataattacgctaacgtggagctcatcttggatattgctaaacgaattccggtacaggctgtctgggcaggctggggtcatgcctctgagaacccaaagcttccagaattactgctaaagaatggaattgccttcatgggacccccaagccaggcgatgtgggcattgggcgacaagattgcatcttctattgtcgctcaaacagccgggatacctaccctgccatggtctggatccggcctgagagtggactggcaggaaaatgacttttcaaagcgaatcctaaatgtacctcaagagttgtacgaaaaaggatacgtgaaggatgtggatgacggcttacaggctgctgaggaagtgggctatccagttatgatcaaagcgtcagagggtggaggaggtaaagggatccgtaaagttaataatgccgatgacttcccgaacctctttcgccaatag

SEQ ID NO: 13729 - DNA, 144 bp, Artificial Sequence
  Description of Artificial Sequence: Synthetic coding sequence
atggatgaaccaagccctcttgctcagcctcttgagctgaaccagcactcacgctttatcatcggaagtgtcagcgaagacaacagcgaagacgagataagcaatctcgtgaagctggaccttctcgaagagaaggaaggatag

SEQ ID NO: 13730 - DNA, 2679 bp, Artificial Sequence
  Description of Artificial Sequence: Synthetic coding sequence
atggaccattatgacagtcaacaaacgaacgattacatgcagccggaggaagactgggaccgcgatttgctactggatcccgcttgggagaaacagcagcgaaagaccttcactgcatggtgcaactcacacctgcgaaaagcaggcacccaaatcgaaaatatagaagaggatttcagggatggtttgaaacttatgctactgctcgaggttatcagtggagagcgcctcgccaagcccgagagaggcaagatgagggttcacaaaatctccaacgtgaacaaggctttagatttcattgccagcaagggcgttaagctcgtgtcaataggcgcagaggaaatagtggatggaaacgtgaagatgacattaggaatgatttggacaatcattctgagatttgcaatccaggacatctcagtcgaggagacctcagccaaggaagggctgctgctgtggtgccagagaaagaccgctccttacaaaaacgtgaatatccagaattttcatattagctggaaagatgggctcggtttttgcgcactgattcaccggcaccgccctgagctcatcgactacggcaaactgaggaaggatgatccactgacaaatctcaatacggctttcgacgtcgccgaaaagtaccttgatatacccaaaatgctcgacgccgaagatattgtgggtaccgcgagacctgatgaaaaggccatcatgacgtacgtgagcagcttttatcacgccttctcaggagcccagaaagcggaaactgctgccaatcgcatttgtaaagtgcttgccgtaaaccaggaaaacgagcagctcatggaggactatgagaagctggcatctgacctactagagtggattagacgaacaataccttggctggaaaaccgcgtcccagaaaacaccatgcacgcaatgcagcagaaactcgaagacttccgagattacagacgcctgcataagcctcctaaggtgcaagagaagtgccagctcgagatcaattttaatacccttcagaccaaactacgtctgagcaatagacctgccttcatgccatccgagggacggatggtgagtgatatcaataatgcctggggctgcctggagcaagtggaaaaaggttacgaggagtggctgctgaacgagattaggaggctggaacgcctagaccacctggccgaaaagtttcgccagaaggcctccatccacgaggcctggacagatggtaaggaggccatgttgcggcagaaggactacgagactgccactctgtcagagattaaggcgctcttaaaaaaacacgaggcttttgaaagtgacttagccgcgcatcaggacagagtggagcagatcgccgccatcgcgcaggaactcaatgaacttgattactacgactctccatccgttaacgcccggtgccagaaaatatgcgaccagtgggacaacttaggggctctcacacagaagcgaagagaggcactggaacgcaccgagaaactgctggagacaatcgatcaactctacttggagtacgccaagcgggcagcgccatttaataattggatggaaggggccatggaagacttgcaggacaccttcatcgtacacaccattgaagagatccagggcctgaccaccgctcatgagcagtttaaagccaccctccccgatgccgataaggagcgcctcgccatcctcggaatccacaacgaggtttctaaaatcgtgcagacatatcacgtcaatatggccgggacgaatccatatactacgataacaccacaggagatcaacggaaagtgggaccatgtcaggcagctcgttcccaggcgagatcaggcactgactgaagaacatgccaggcagcaacacaatgagcggctccggaagcagtttggcgcccaagcgaacgtaatcggaccatggatccaaactaagatggaggagattggccggataagcattgagatgcatggaaccctcgaggatcagctctctcatctgcgccagtacgagaaaagtatcgtcaactataagccaaaaattgaccaattggaaggagatcatcagttgatccaggaagccctgatcttcgacaacaaacataccaattatacaatggaacatatcagggtcggatgggagcagctgcttactacaatagcacgcacaattaatgaagttgaaaaccagatactgacacgagatgccaaggggatttcacaggagcagatgaacgaatttagggcctcttttaaccactttgacagggatcactccggtacactggggcctgaagagttcaaggcgtgtctcatcagtctgggttacgacatcggtaacgaccctcagggcgaggcggagtttgcacgaataatgtctattgtagacccaaatcgactgggtgttgttacattccaggcctttatagactttatgtccagggaaaccgctgataccgataccgcggaccaggtgatggcaagctttaagatcttggcgggagacaaaaactacattactatggacgagctgcggagagaactgcctccagatcaggctgaatactgcatcgctcggatggcaccctacactgggccagattctgtgcctggcgcactcgactatatgagcttttccaccgcattgtacggagaaagcgacctctag

SEQ ID NO: 13731 - DNA, 2745 bp, Artificial Sequence
  Description of Artificial Sequence: Synthetic coding sequence
atggatcattacgattcacagcagaccaatgattatatgcagccagaggaagattgggatagggatctcctcctggaccctgcctgggagaagcagcagcgcaaaacatttacagcgtggtgtaattcacatctgcggaaggcgggtacccaaattgagaacatagaagaggattttagggatggccttaaattaatgctgctgcttgaagtcatcagcggcgagcgtttagcaaagccggagcgcggaaagatgagagtgcacaagatcagcaacgtcaacaaggctcttgactttattgcatctaaaggcgttaagcttgtttctatcggtgccgaggagattgtggatggaaatgtgaagatgactctgggcatgatctggacaatcatcctccgatttgctatacaggacatcagcgttgaagagaccagcgctaaagaagggctgttgctctggtgccagcggaaaactgccccctataaaaacgttaacatccaaaacttccacatctcttggaaagatggactgggtttttgtgcccttatacatcggcacagaccagaacttatcgattacggcaaactccggaaggatgacccgttgaccaatctgaacaccgcattcgacgtcgctgagaaatatctggatatacccaaaatgctggatgctgaggatatcgtcgggacagcgaggcccgacgagaaagcgatcatgacctatgtcagctccttctatcatgccttcagcggcgctcaaaaagctgagactgccgctaaccgaatatgtaaagttctggccgtgaaccaggaaaacgagcaacttatggaagattatgagaaactagcctcagatctgctggaatggatcagaagaacaatcccttggctagagaacagggtcccagaaaatacgatgcacgcaatgcagcaaaagttggaggattttcgcgattacagacgattgcacaagccaccaaaagttcaggaaaaatgtcagctggaaatcaactttaacaccttacagacgaaactgaggctgagcaatcgccccgcgttcatgccttccgagggcaggatggtctctgacatcaacaacgcttggggatgtttggagcaggtcgagaagggctatgaggagtggcttcttaacgagattcggcgcctggagagactggatcatctcgctgaaaagtttcgtcaaaaggcttccatccacgaggcatggacagacggtaaggaagccatgctacgccagaaggattatgagacagcgacattgagcgagataaaggctttactcaagaaacacgaggcgttcgaatcagatctggcagcccaccaagatagggtcgagcagattgcagcaattgctcaggagctaaatgagcttgattattatgactccccaagcgtgaacgcgagatgtcaaaaaatttgcgatcaatgggataatttgggcgctctgactcagaaacgtcgtgaggccttagagcgcaccgagaaactgctggagaccatcgatcagctctatttggagtatgccaaaagggcagccccctttaacaactggatggagggcgccatggaggatcttcaggacacctttattgtgcacacgatcgaggagatacaggggctgacaacagctcacgaacagtttaaggccacattgcctgacgctgataaggaacggttagccatcctcgggatccacaatgaggtgtcaaaaatcgtccaaacgtatcatgtgaatatggccggaaccaacccatacacaactatcactccccaagagattaatggcaagtgggatcacgtgcgccagctggtcccacgtagagaccaggccctgaccgaggaacacgccaggcaacagcacaacgagcggctcagaaagcagttcggcgcccaggcaaatgtcattggaccttggattcagaccaaaatggaggaaatcggacgcattagcatcgaaatgcatggcaccctggaggaccagctctcccacctgcgccaatacgagaaaagtatcgtcaattacaagcctaagattgatcagctcgagggggatcaccaactcatacaggaagcactgatcttcgataacaagcatacaaactacacgatggagcatatcagagtgggttgggaacagcttctcacaactatagcgcgcacaattaatgaagtcgagaatcaaatcctgacccgtgatgctaagggaatctcccaagaacaaatgaacgaatttagagcctcctttaaccactttgatagggaccactcgggcaccctggggcccgaagagttcaaagcctgcttgatcagccttggctatgacatcgggaacgacccgcaaaagaagaccggcatgatggataccgacgactttcgggcttgtttgatctccatgggttacaacatgggagaggccgaatttgctcgcatcatgtcaatcgtggatccgaatcgactgggcgtggtcaccttccaggcattcatcgactttatgagcagggaaaccgccgacacagataccgccgaccaggtcatggcctctttcaaaattctggcgggtgataagaactatatcacaatggatgaactgagaagggagctcccccctgaccaggcggagtactgcattgctagaatggctccatacacgggaccagattccgttccaggagccctcgattacatgagcttctcaactgctctgtatggtgagtcggatctatag

SEQ ID NO: 13732 - DNA, 2664 bp, Artificial Sequence
  Description of Artificial Sequence: Synthetic coding sequence
atggaccattacgatagccaacaaacaaacgattacatgcagcctgaagaggactgggaccgcgatctgctgctcgatcctgcgtgggaaaagcagcagagaaaaacctttaccgcgtggtgcaatagccacttgaggaaagccggtactcaaattgaaaatatcgaagaggattttcgtgatggtctaaagctaatgcttctattggaagttatcagcggagaaaggttggcgaagcccgagaggggcaagatgcgagtgcataagatctcaaatgtaaacaaggccctcgattttatcgcatctaagggggttaagctggtcagcataggggccgaggagattgtggacgggaacgtgaaaatgaccctggggatgatctggaccattatacttcgctttgctatacaggacatctctgtggaagaaacatccgccaaagaaggccttctactgtggtgtcaacgcaagaccgctccttataagaacgtgaatatccagaatttccatatctcttggaaggacggactcggcttttgtgccttgattcacagacaccgccctgaactgattgattatgggaagctgcgaaaggacgaccccctcaccaatttgaataccgctttcgacgtggctgagaaatatttggacatcccaaagatgctggatgccgaagacattgtggggacagcgcgcccagacgagaaagcaattatgacctacgttagcagcttctatcacgcgttcagcggggcccagaaggcagaaacggctgccaatcggatttgcaaagtactggccgtcaaccaggaaaacgaacagctgatggaagattacgaaaagctggcttctgacctcctggagtggatccgtcggactatcccttggctggaaaaccgcgtcccagaaaatacaatgcacgccatgcaacagaagctggaagactttcgtgactaccgaaggcttcataagccacccaaggtccaggaaaaatgccagctcgaaataaacttcaacaccctgcagacaaagctccggctgtctaacagaccagccttcatgccctcagagggtcggatggtatccgatattaacaatgcctggggctgcctcgaacaggtggagaaaggatacgaagaatggctgcttaatgaaatccggcggctggagagactcgatcacttagccgaaaagttcaggcagaaagcctccatccacgaggcctggacggacggtaaggaggctatgctgaggcaaaaagattatgagacagccacactgagcgaaattaaggctctgttaaagaagcacgaggcctttgaaagcgacttggccgcccatcaagatagagtggagcagattgcggcaatcgcccaggaactgaacgaactcgactactacgattccccatcagtgaatgcccggtgtcaaaaaatctgtgatcagtgggataatctgggggccttgacacagaaaaggcgtgaggcgttggaaagaacggaaaaattattagagactatcgaccagctatacctggaatacgcaaagcgtgccgctccctttaacaattggatggagggcgccatggaagacttgcaggacactttcattgtccacaccattgaagagattcagggtctgaccactgcacacgaacagtttaaggccacactgccggatgccgataaagagcggctggctatcttgggcattcacaacgaggtctccaaaatcgtacagacttatcacgtaaacatggccgggaccaacccttacactacgatcacgccacaggagataaacggcaaatgggatcacgtcaggcagcttgtaccacgcagggaccaggcgttgacagaggagcacgcccgacagcagcacaatgaacggctgagaaaacagttcggagctcaggctaatgtcattgggccatggatacagaccaagatggaggagatcggccgcatctcgatcgagatgcatggtaccctggaagatcagttgtcccatctgagacagtatgagaagtcgattgtgaattacaagccaaagatcgaccagctggaaggcgaccatcaactgatccaggaggccctgatattcgacaataaacataccaattacacaatggaacacatcagggtgggatgggaacagctcttaaccaccatcgccaggaccatcaacgaagttgagaatcagattctcacacgggatgcaaagggtatctcgcaggagcaaatgaacgagtttagggccagcttcaatcattttgacagaaaaaagacaggcatgatggataccgacgattttcgcgcctgcctgattagcatgggatataatatgggggaagcggagtttgctcggatcatgtctattgtggacccaaatcggcttggcgttgtcacctttcaggccttcatagactttatgtctagggagaccgctgacactgatactgccgatcaggtgatggcctcttttaagatcctggcgggggacaagaactatatcaccatggatgaactgaggcgggagctgccccctgatcaggccgaatactgcatcgccagaatggcgccatatacagggccggatagcgtgcccggggccctggattacatgtctttcagcacagcattatatggagaaagtgacctgtag

SEQ ID NO: 13733 - DNA, 2736 bp, Artificial Sequence
  Description of Artificial Sequence: Synthetic coding sequence
atggttgactaccacgcagctaatcagtcatatcagtacggaccctcttctgctggaaacggcgcaggcggggggggatccatgggcgattatatggcccaggaggacgactgggatcgcgatttattgctcgaccctgcctgggagaaacagcagcgcaaaacctttaccgcatggtgcaattcccacctgcggaaagccggcactcagattgaaaatattgacgaagactttcgggatggtttaaaactgatgttgctgctggaagtgatctccggggagcgtctcccgaaacccgaaagaggcaaaatgagagtgcacaaaatcaacaatgtgaacaaagccctggactttattgcgagcaaaggtgttaagctggtgagcataggtgccgaagagattgtagatggaaatgctaaaatgacccttgggatgatctggaccatcattttgcgatttgctatccaggatatttccgttgaagaaacctctgctaaggagggcctactgctctggtgccagaggaaaaccgccccttataaaaacgtgaacgtgcagaactttcatatctcttggaaagatggcctcgcattcaatgctttaatccatcgacaccggccagagctgattgaatatgacaaactcagaaaggatgacccagtgaccaatctgaacaacgctttcgaagtcgccgagaagtacctggacatcccgaagatgttagatgccgaggacatcgtcaatacagctagacctgacgagaaggccatcatgacgtacgtgtctagcttctaccacgccttctccggagcacagaaggccgagacagcagcaaaccgcatttgtaaagttctcgctgtgaatcaggagaatgagcatctgatggaagactacgagaaactcgcaagcgatttgcttgaatggattcggagaacaatcccctggctagaggatcgcgtccctcagaagactattcaagagatgcaacaaaagctggaagacttcagggattatcgccgcgtacataagcccccaaaggtccaggaaaagtgtcaattagaaataaacttcaatactctgcagacgaaactacgcctgtcaaaccgccccgctttcatgccaagcgagggcaagatggtatctgacataaacaatggttggcagcatctggagcaggccgaaaaaggctacgaagaatggctactcaatgaaatccggcgcttggagcgtctcgaccacctggccgagaaatttcggcagaaggctagcatccacgaagcttggacagatgggaaagaagccatgttaaagcaccgggactacgaaaccgcgactctcagtgacataaaggcccttattcgcaaacacgaggccttcgaaagtgacctggctgctcatcaggatcgagtggagcaaattgccgccatagcccaggagctcaacgaactcgattactacgatagccataatgtgaacacaagatgtcaaaaaatttgtgaccaatgggacgccttggggtctctcacgcactctaggcgggaggcgctggaaaagacagaaaaacagctcgaggccatcgatcaactccaccttgaatacgctaaacgcgcagcccccttcaacaactggatggagagtgctatggaggatctgcaggacatgttcatagtgcacacaatcgaggagatcgaaggtttgatctctgctcacgatcagttcaagtccacgctgccggatgccgatcgggagagggaggccattcttgctatccacaaggaagcccagcgcatcgcagaatcaaatcacattaaactgagcggcagcaacccttacaccaccgtaacccctcagatcatcaacagcaagtgggagaaagttcaacagctagtgcccaaacgcgaccacgcattgctggaagaacagtccaagcagcagtccaacgagcacctgcggcggcagtttgcaagccaggctaatgtggtagggccctggattcagactaagatggaggaaattggtagaattagcattgagatgaacgggaccttagaggaccagttgagtcacctaaaacagtatgagcggagcatcgtcgattataagccaaacctcgacctgctggagcagcagcatcagctgatacaggaggcgctgatctttgacaacaagcacacgaactatactatggagcatatccgggttggctgggagcagctgttgaccaccattgcacgcaccatcaacgaagtggagaatcagatcctgactcgagatgctaaaggcatcagccaagagcagatgcaagaattccgagcgtcgttcaaccacttcgataaggatcacggcggggcactgggacctgaagagttcaaggcttgcctgatatctctcgggtatgacgtcgaaaatgacaggcagggtgaggctgagttcaatcggatcatgagtctcgtggatcctaatcattctggactcgtgactttccaggccttcatcgactttatgagtagggagaccactgatacagatactgccgaccaggtcatcgcttctttcaaggtgctggccggcgataagaatttcattacagcagaggaactacggagggagctgccgcctgaccaggccgagtattgtatagcaaggatggctccttatcagggacccgacgccgtccccggcgccctcgattacaaatccttcagcaccgctctttatggagaatcggatctgtag

SEQ ID NO: 13734 - DNA, 2079 bp, Artificial Sequence
  Description of Artificial Sequence: Synthetic coding sequence
atggttgactatcacgctgcaaaccagtcataccaatatggaccaagttctgccggaaacggagcagggggggggggatcaatgggcgactatatggctcaggaggacgactgggatcgcgatctcttgctggatcctgcctgggagaaacagcagcgcaaagccgaaaccgcggctaaccgaatttgtaaagtactcgcagtcaaccaggaaaatgaacatctgatggaggattatgagaagctcgcatccgatctccttgaatggatcagaaggacgattccatggcttgaagacagagtacctcagaagacgatccaggaaatgcaacagaaactggaggatttcagggactatcgtcgcgtccacaagccacctaaggtgcaagagaagtgtcagctggaaattaattttaatacgctgcagacaaagcttaggttgagtaatcggcccgcgttcatgccaagtgaggggaaaatggtgtccgatattaacaatggctggcagcacctggaacaggcggaaaagggctatgaagagtggctcctgaatgagatccggagattagagcggctggaccacctggctgaaaagttcaggcaaaaggcttccattcatgaagcctggacagacggaaaagaagccatgctgaagcatagggactacgaaacagcgacactaagcgacattaaagctttgattcgaaagcacgaggcatttgaaagcgatcttgctgctcatcaggatcgggtggaacaaatcgctgctatcgcccaagaactgaacgagcttgactactacgactcacataatgtgaatacgaggtgtcagaagatctgcgaccaatgggacgcccttgggagcttgacccattcaagacgggaggctcttgagaagacagagaagcagctggaagccatagaccagttgcacctggagtacgccaagcgcgccgccccattcaataactggatggagagtgcaatggaggacctgcaggacatgttcattgtgcacacaatcgaagagatcgagggcctgatatccgcccatgaccagtttaagtctactcttccagatgcagatcgggagagggaagcaatcctagcaatccataaagaagcccagaggatcgccgagtcgaatcacattaagctgagcggaagcaatccctacacaacagtgactccacagataattaattcaaaatgggagaaggttcagcagctcgtgcccaagcgcgatcatgccctgttggaagagcaatctaaacaacagagtaacgaacacctaaggcggcagtttgcatcacaggcaaacgttgtcggtccctggatacagaccaaaatggaggagatcggacgtattagtatcgagatgaacgggaccttggaggatcaactatcgcacctgaagcaatacgaaaggtcgatcgtagactataaacccaatttggatttgctggagcagcaacatcagctgatccaggaagctctgatcttcgacaataaacacactaactatactatggaacacatcagagtcgggtgggaacagctgttgaccacaatagctaggacgattaacgaggtagagaatcagatactcacccgtgacgcaaaagggattagccaggagcagatgcaggaattcagagcttcatttaaccacttcgataaggatcacggcggcgccctgggcccagaggagttcaaagcctgtttaatttcgctggggtatgacgtggagaatgaccggcagggtgaggcggaatttaaccggattatgtccctggtggacccaaaccacagtggactcgttacttttcaggccttcatcgattttatgtctcgggaaactactgataccgatacagcagatcaggtaatcgcctcatttaaggtgttggccggtgacaagaatttcatcactgccgaggaattgcgaagagaacttccacctgaccaggccgaatactgtattgccagaatggccccctaccagggaccggacgctgtgcctggtgcccttgattacaaaagcttcagtacagctctctatggtgagagcgacctgtag

SEQ ID NO: 13735 - DNA, 1566 bp, Artificial Sequence
  Description of Artificial Sequence: Synthetic coding sequence
atggtcgactaccatgcggccaaccagtcgtaccagtacggcccaagctccgcagggaacggagccggcgggggcgggagcatgggagattatatggcgcaggaagacgattgggatcgagatctgctgcttgaccccgcttgggaaaaacagcagagaaagactttcacagcttggtgtaattcccacctgagaaaggccggcactcagatcgaaaacatagacgaagacttccgcgacggtctcaagctgatgctgctgttggaggtgcatgagcttgactattatgacagccataacgttaacacccgatgtcagaagatttgcgatcagtgggacgctctgggctctcttacgcattctcggagagaggcgctggaaaaaaccgaaaagcaactcgaagctatcgaccaacttcacctggagtacgctaaacgtgccgctcctttcaacaactggatggagagtgctatggaggatttgcaggatatgtttattgtgcacaccattgaagaaatcgagggactgatttccgcacacgaccagtttaagagcacgttgccggacgccgaccgagagcgagaggccattcttgccatccacaaagaagcccaacggatcgccgagtccaaccatatcaaactgagcgggtccaacccctataccaccgtcactcctcagataatcaactctaagtgggagaaagttcagcagcttgtccccaagcgggatcacgctctcctggaggaacagtcgaaacagcagagcaacgagcacctccgccggcaattcgcctcacaggctaacgtcgtcggtccgtggatccagactaagatggaggaaatcgggagaatatccatagagatgaatggcacactggaggatcagctgtctcatcttaaacagtacgagcgttctatcgtggactataaaccaaatcttgacctgctggaacaacaacaccaactcatacaagaggctctgatcttcgacaataagcacactaattacacgatggagcacattagagtggggtgggagcagctgcttaccactatcgctcggaccatcaatgaggtggaaaaccaaatactgacgagggacgcaaagggcatctcccaggagcagatgcaggaattccgcgccagcttcaaccatttcgacaaagaccatggcggagctctgggtccggaggaattcaaggcgtgccttatcagcctgggatatgacgtagagaacgaccgccaaggtgaggctgagtttaatagaataatgagtctcgtcgaccctaaccatagcggattagtcacctttcaggcctttattgattttatgagcagggagacaactgacacggataccgccgatcaggtgatcgcatccttcaaggtgctggcgggtgataagaattttatcacagctgaggaacttcggcgcgagctgcctcccgaccaggctgaatattgcatcgcaaggatggctccatatcaagggcccgatgctgtaccaggcgcccttgactacaagtcgtttagcactgctctttacggcgagtctgacctgtag

SEQ ID NO: 13736 - DNA, 1689 bp, Artificial Sequence
  Description of Artificial Sequence: Synthetic coding sequence
atggtggattatcatgccgctaaccagagttaccagtacggaccgagctcagcagggaacggtgccggcggcggaggaagtatgggcgattatatggcccaggaggatgattgggaccgggacttattgttagatcccgcctgggagaagcagcagaggaagacttttacagcctggtgtaacagtcacttgcggaaggccggaacacagatcgaaaatattgatgaggattttcgcgatggcctgaagctgatgctattgcttgaagtgataagcggcgagcgactgccaaaacccgagaggggcaagatgagggttcataaaatcaataatgtgaacaaagccctggacttcatcgcaagcaaaggtgttaaactggtgagcatcggggctgaggaaatagtcgacggaaatgccaagatgacacttggtatgatctggacaattatccttcggtttgcgatacaggatatttcagtcgaggaaacaagcgccaaagaggggctgcttttatggtgccagagaaagaccgcaccctacaaaaatgtgaacgtgcagaatttccacatctcttggaaggacggcttagctttcaacgccctgatacaccggcacaggcccgagctgatcgagtatgataagcttaggaaagacgaccctgtcaccaacttgaataacgccttcgaagtagcagagaagtacctggatattccaaaaatgctggatgcggaggatattgttaacaccgcccgccccgatgagaaagctataatgacatacgtgtcctccttctatcatgcattctctggagcacagaaagcagagactgcagcaaatcgtatttgcaaggttttggccgtgaatcaggagaacgaacatctcatggaagattacgaaaaactggccagcgacctgttggaatggatccggcgtaccattccctggctcgaagatcgggtgcctcaaaagactatccaggagatgcagcagaagttagaagatttccgggactatcgcagggttcacaaaccgccgaaggtgcaggaaaaatgccagcttgagattaactttaatacgctccagacgaaattgaggctgagtaaccgccccgcgttcatgccatccgaagggaagatggtgtcagacataaacaatggttggcagcacctcgaacaagctgagaagggctacgaggagtggctcctaaacgagatccgacggttggaaagactcgatcatctcgctgagaaattccgccagaaagccagcatacatgaggcatggacggatgggaaggaagcaatgcttaagcacagagattacgagacggcgacgttaagcgacatcaaagcactgattaggaaacacgaagctttcgagtccgacctcgccgcacaccaggatcgagtggagcagattgctgcaattgcacaggagctcaatgagctcgattactacgactcgcataatgtgaatacgccagatggtttgcaggaaggcccagggcagccccatagtcccatcccgcccctctgtatttatgccaagcacagtctgcagtctagcggggtgggagggtgggccggtagggggtggggacgattgtccccactgtcactttgtgggcttgctaggcgctttccgcgccccggatggggagatctgggcccggctcttctagtatggtag

SEQ ID NO: 13737 - DNA, 1518 bp, Artificial Sequence
  Description of Artificial Sequence: Synthetic coding sequence
atgaagtttaagctgcatgttaattccgccagacagtataaggatctctggaacatgtcagatgataagccattcctctgcaccgcgcccgggtgtggtcaaaggttcacaaatgaagatcatcttgcggtgcacaaacataagcacgaaatgactctgaaattcggacctgcgcgaaacgattcagtgatcgttgcggaccaaacacccacacctactcgattcctaaagaactgtgaggaagtgggactttttaacgagttggcctctccttttgagaatgagtttaagaaagcatcagaagacgatatcaagaaaatgcccctggacttgagcccacttgcaactcccataattcgcagcaagatcgaggagccgtctgtagtagaaacaacacatcaagattctcccctccctcacccagaatctacaacatctgatgaaaaggaagtgcccctggcccaaacagcccagcccacgtctgccatagtgcgaccggcatccttgcaggtgcctaacgtgctgctgaccagctctgactcctcagtgatcattcagcaggcagttccaagcccgacaagcagcacagttattacacaggcaccctcctccaaccgtcccatcgtacccgtccccggcccgttccctctgctcctgcatctgccgaacggtcaaactatgcccgttgctattccagcctctattaccagctctaatgtgcacgttcctgctgctgtgccgctggtgcgccccgtgacgatggtgccttcagtccccggaattcctgggccaagctcaccacagcccgtgcaaagcgaggccaagatgcgcctgaaagcagctttgacgcagcagcatccccccgtcaccaatggcgacacagtgaagggtcacggaagcggtcttgtcagaacccagtccgaggaaagcaggccgcagagcctgcagcagccagccacctctactactgaaacacccgcctcgcctgctcataccaccccacagacgcagagtacgtccggccgcagacgcagggccgctaacgaagatcctgatgaaaagcggcgcaagttccttgagagaaacagagctgctgcctctcgttgcagacagaaaaggaaggtctgggtgcagtccctggaaaagaaagccgaagacctctctagtctgaatggtcagctgcaatccgaagtgacgcttctgcgcaatgaagtggcccagctcaaacagttgcttttggcacataaggattgtccggttaccgctatgcagaagaaatcggggtaccacacagccgataaggacgattcttcagaggatatttccgtcccttccagtcctcataccgaagccattcaacacagctcggtcagcaccagtaacggagtgtccagcacaagcaaggcggaagctgtggctacctctgtcttaactcagatggctgaccagagcaccgagcctgccttgtctcaaattgttatggcacccagctcccagagccagccttccggctcttag

SEQ ID NO: 13738 - DNA, 1344 bp, Artificial Sequence
  Description of Artificial Sequence: Synthetic coding sequence
atgtactgcgcctggatgtggccagatcagacacccacacccacacggtttttaaaaaactgcgaagaggtggggctgttcaatgagctcgcctccccatttgagaatgagttcaaaaaggcttcggaagacgacattaagaaaatgcccctggatttaagccccttggccaccccgatcatccgcagcaaaatcgaggagccttcagtggtggagaccacccaccaggatagccccctgccacatccggagtcaacgacctcggatgaaaaggaagtccctttagctcagaccgctcagccaacaagcgcaattgtgagaccagccagcctgcaggtaccaaatgtgctgctaacgtctagtgactcttcagtaatcattcagcaggctgtgccttctcctacttctagtacagtgattacgcaagcaccttcatccaatcgccctatagtccctgtgccaggtccgttcccacttctgcttcacttgccaaacggtcagacaatgcccgtcgccatccctgcttctatcaccagctccaacgtccatgtgcccgctgctgtccctcttgtccgacctgtgactatggtgccttcagtcccagggatccctggtcccagtagcccccaacctgtgcaaagcgaggctaagatgcggcttaaagccgccctcacacagcaacatccaccggtaacaaacggggacactgtcaaaggccatgggagcggactcgttaggactcagtccgaggagtctcgacctcaatcactgcagcagcccgccacatccacaaccgagacgccagcctctccagcacataccaccccacaaacccagtctacctcaggtcgccggcggagggccgccaacgaagatccagatgagaaacgccggaagttcttggaacggaatagggcagccgcttctagatgtagacagaaacgaaaagtgtgggtgcaatcacttgagaaaaaagcagaggacctgtcgtccctcaatgggcagctgcagtccgaggtcacgcttctccgtaatgaagtggctcagcttaaacaattattgctggctcataaggattgtcccgtgaccgcaatgcagaagaaaagtggctatcatacagccgacaaagacgatagctccgaggatatttcagtgcctagctctccccacacggaagccatacagcactcatctgtatctacgtccaatggcgtttccagtaccagtaaggccgaggccgtcgctacctccgtgttaacccagatggcagaccagtctaccgagcccgccctatctcagatcgtgatggcccccagttcccaaagccagccgtccggttcctag

SEQ ID NO: 13739 - DNA, 381 bp, Artificial Sequence
  Description of Artificial Sequence: Synthetic coding sequence
atgtccgacgataaaccatttttgtgcacggcaccaggatgtggccagtcagaggtcacactgctgcgcaatgaggtcgctcagctcaagcagctgctattagcccataaagattgccccgttaccgccatgcagaagaaaagcggttatcacaccgccgataaggacgactccagcgaagatatttccgtaccctcgtcaccacacaccgaggccatccaacactcttcggtgagtacctccaacggggtgagtagcaccagtaaggccgaggcagtggctacctctgtgctgacccagatggccgaccagtcgaccgagcccgctctgtcccaaattgtcatggcccctagttcacagtctcagccatctgggtcttag

SEQ ID NO: 13740 - DNA, 1518 bp, Artificial Sequence
  Description of Artificial Sequence: Synthetic coding sequence
atgaagttcaagctgcatgttaactctgcaaggcaatacaaagacctctggaatatgagcgatgacaagccttttctttgtacggcgccaggctgcggacagcggtttacaaacgaggaccatcttgccgttcacaaacacaagcacgagatgacccttaagttcggaccagctcgcaatgacagcgtgatcgtcgcagaccagacacctacccctacaaggttcctgaaaaactgcgaagaggttgggctctttaacgagctcgccagtccattcgagaatgagtttaaaaaagcttcagaggacgatatcaagaagatgccgcttgatctgtcccctctcgccaccccaattatacgaagcaagattgaggagccatctgttgtggaaacgactcaccaggactccccattaccccaccccgagagcaccacctctgatgaaaaggaagttcccctagcccagaccgcgcagcccacctctgccattgtgagaccagcaagtcttcaggtgcccaatgtcctgttgacaagtagtgacagttccgtgattatccaacaggcagtgccttcccccacaagttccacagtgatcacccaggccccctcctccaaccgcccgattgtgcccgtgcctggacccttcccactactcctgcatctgcctaatggccaaactatgccagtcgccatccccgcctctatcacatcctcaaatgtccacgtccctgctgccgtgcctttggtaagaccggtgaccatggtgccatcggttcctggcattccgggaccaagcagtccccagccggttcagtccgaggctaaaatgcgcctgaaagcagcattgacacagcagcaccctcctgttaccaacggagatacggtcaaaggccacggttccggacttgtgcggacacagtctgaggaaagtcggccccagtcacttcagcaacccgccacttcaactactgagactccagcatcacctgcccatactaccccccaaacccagtctactagcgggaggaggcggcgcgccgccaatgaggacccggatgagaaaagaaggaagtttctggagcgcaaccgtgcagcagcgtcccgatgtcggcagaagcggaaagtctgggttcaatccctggaaaagaaagcagaggacctgtcttcattaaacggacagctgcagagcgaggtgacgttactgaggaatgaggttgctcagctcaagcagctgctgttagcgcacaaggactgtcccgtgacagcaatgcagaaaaagtccggataccacacggccgataaggatgatagttctgaagatatctcggtcccaagcagccctcacactgaagccatccaacacagtagcgtgtccacgtcaaacggagtgagcagcacttccaaagccgaggctgttgcaactagcgtcctgacgcagatggctgaccagtccaccgaaccagcgctgagtcagattgttatggccccatcctcccagtcgcagccttcagggagttag

SEQ ID NO: 13741 - DNA, 1344 bp, Artificial Sequence
  Description of Artificial Sequence: Synthetic coding sequence
atgtactgcgcatggatgtggcctgaccaaacaccgacgcccacgaggtttctgaagaattgcgaagaagtgggcctgtttaacgaattagcaagccctttcgaaaacgagtttaagaaagcttcggaagacgatatcaagaagatgcccttggaccttagtccacttgctacaccgatcataagaagcaagatagaggaaccatccgtcgtagaaaccacgcatcaggactcacccctacctcatcctgaaagtactacatccgacgagaaggaagtgcctctcgcacagaccgcccagccaacctccgctatcgtgagacccgcctcactgcaggtacctaacgtgctcctcactagttctgactcctctgtgataattcaacaggcagtgccgagccctacgtcctccacagtcatcactcaggcgccgagctctaacagaccgatcgtccctgtgcctggaccattccctctgctgctgcatctaccaaatggccagacaatgcccgtggctattcctgcttccattactagctccaacgtgcacgttcctgcagcagtgcctcttgtgaggcctgtaacaatggtcccctctgtgccggggattcctgggcctagcagtccgcagccagtacaatccgaagccaaaatgcggttaaaagctgcgctcacccagcagcaccccccggtgaccaacggcgatacagtcaagggacacggcagcggcctggtccgcactcaatcggaggaaagtcgcccccaaagcctacaacagccggcaacttcaaccacagaaactccagcatcccctgcccacaccacccctcaaacgcagagcaccagtgggcgacgcaggcgcgccgccaatgaagatccagatgagaaacgcagaaagtttctggagagaaaccgagcggctgctagtcggtgtaggcagaaacgcaaggtgtgggtgcagtcactggaaaagaaggccgaggatcttagctccctgaacggccagctgcagagtgaagttacgctgcttaggaacgaggtggctcagctaaagcagttgctgctcgcacataaggattgccccgtgaccgcaatgcagaagaaaagcggctaccataccgcggataaggatgatagcagcgaagacatatcagtgccctcttctcctcataccgaggccatccagcattcatccgtgagcacctcaaatggagtgagttcgacttctaaagcagaggctgtggccacatcagttctaacacagatggccgaccagagtacagaacccgctctgtcccaaattgtgatggcccctagcagccaatctcaacccagtggaagctag

SEQ ID NO: 13742 - DNA, 630 bp, Artificial Sequence
  Description of Artificial Sequence: Synthetic coding sequence
atgaaatttaaactccatgtaaatagcgcccggcagtataaagacctctggaacatgtcagatgataaacccttcctctgtacggcccctggatgcggtcagcggtttaccaatgaggaccacctggcagttcacaaacacaaacatgagatgaccctgaagtttgggccagctagaaatgactcagtgatagtcgctgatcagacccccacccctactaggttcctgaagaactgcgaagaggtaggactgtttaatgaactggcttcaccattcgagaacgaattcaaaaaagcttctgaggacgacatcaagaagatgcctctcgacttgagtcccctcgccaccccgatcatccgttccaaaatcgaggaacccagcgtggtcgaaacaacccaccaggatagccccctccctcatccggagtctacaacgtcagatgagaaggaagtgcctctagctcagactgctcaacctacgtccgccatagttcggcccgcttccctgcaggtccccaatgtgctgctcacctctagcgacagcagtgtcattatccaacaggctgtaccctcacccacgtcatctacggtgattactcaagccccttcatccaacagacccatcgtctag

SEQ ID NO: 13743 - DNA, 1188 bp, Artificial Sequence
  Description of Artificial Sequence: Synthetic coding sequence
atgaagttcaagttacacgtgaattcagcacggcagtacaaggacctgtggaacatgtctgacgacaagccatttctctgtactgccccaggctgcggccagaggttcaccaacgaggaccatttagctgtccataagcacaagcacgaaatgactctgaaatttggcccggctagaaacgattctgtgatcgtggccgaccagactcccacacccaccaggtttctgaaaaattgcgaagaagtcgggctgttcaacgaattggcatcaccttttgagaacgagttcaagaaggccagtgaggatgacatcaagaagatgccactcgacttgagtccactcgccactcctatcattcgcagtaaaatcgaagaacctagtgtggtcgaaaccacccatcaggacagccccctgccccaccccgaaagcactacctccgatgaaaaagaggtgcctcttgcacaaacggcccagcctacctctgcaatagtgcggcctgccagtctgcaggtgcctaacgttctacttacatccagcgactctagtgtcattattcagcaggcagtgccgagccctacgagttccaccgtgattacacaggcaccctcctctaacagaccaattgtcccagtaccagggccatttccgctcctgctccatcttcccaacggacaaactatgcctgtggccattccagcgagcatcacctccagtaacgtccacgtcccggcggccgtacctctcgtccgacccgttacaatggtcccctccgtccccggcattccaggcccttcgagccctcagccagtccagagcgaagccaagatgcggcttaaggcagcattgactcaacagcatccccctgtcactaatggggacaccgttaaagggcatgggagcggcctggtaagaacccaatccgaggaaagtcggccccagtcactgcagcaacccgccacatcaacaaccgagacgccagcgagtcctgcccatacaaccccgcagacacagagcacgagtggccgtcgccgcagagctgcaaatgaagatccagacgagaagcgaaggaaattcttagaaagaaatagggctgccgccagccgatgtaggcagaagcggaaagtgtgggttcaatccctcgaaaaaaaagctgaggatttgagctctttaaacggacaattgcagtag

SEQ ID NO: 13744 - DNA, 714 bp, Artificial Sequence
  Description of Artificial Sequence: Synthetic coding sequence
atgaagtttaagttacatgtcaactcagcgcggcaatataaagatttgtggaatatgtcggatgataagccattcctgtgcacagcccccggctgtgggcagaggtttaccaacgaagaccatctcgctgttcacaaacataagcacgagatgacactcaaatttggaccagcacgtaacgactcagtgatcgttgctgatcagactcccactccaacgagatttctcaaaaattgcgaagaagtggggctcttcaacgaactggcctcacccttcgaaaacgaatttaaaaaggcttcagaggatgacattaagaaaatgccactggacttgtcacctcttgctacacctatcatcaggagtaaaatcgaagagccctccgtcgtggaaactacacaccaggactcaccccttccgcatcctgagagtaccaccagtgacgaaaaggaggtgcccctggctcagaccgcacagcctacgtccgccattgtgcgccctgcaagcctccaggtccccaatgtactcttaacaagctctgactcttctgtaattattcaacaggccgttcccagccccacaagctcgacggtgatcacacaggcaccatcttccaatcggccgatcgtctccttcgatcagagcccatggtgcctggtttttcaggagagtcaggtgctccccttgccgaatcaatattcccagaaacagaagtag

SEQ ID NO: 13745 - DNA, 1464 bp, Artificial Sequence
  Description of Artificial Sequence: Synthetic coding sequence
atgagcgacgataagccttttttgtgcacagcgccaggttgcggccaaagatttacaaatgaagatcatctggccgtacataagcacaagcatgagatgacgttaaagttcggtccagctcggaacgattctgttattgtggccgatcagacccccacacccacacggtttttaaaaaactgcgaagaagtcggcttattcaacgaattagccagtcccttcgagaatgaattcaaaaaggcgtctgaagatgacatcaagaaaatgccactcgacctgagcccactggcgacaccaataatcagaagtaagatagaagagcctagtgtggtggagacaactcaccaggacagtcccctgccccaccctgagtcaacaactagtgatgagaaggaggtgcctctggcccagacggcccagccaaccagcgcaattgtccgccccgcctctctacaagtacctaacgtgcttcttacctcctccgactcctccgtgatcattcaacaggccgtcccgagccctacctctagtaccgtgataacacaggcacctagctcgaacaggcccatcgtcccagtgcccggtcccttccccctgctcttgcaccttcccaatgggcagacgatgccggtggctatacctgcatctatcacgtcttcaaacgtacacgtgcccgccgcagttcccctggtgaggcccgttacaatggttcccagcgtacccggaattcctggcccatcctctccccaacccgtgcagagtgaggcaaaaatgcggctcaaagccgccttaacgcaacagcatcctccagttaccaacggagatacggtgaagggtcatggtagcggcttagtgcgtacacagagcgaggaatcaagaccgcagagtctgcagcagcccgccacttctacgactgaaacccctgccagtcccgcacacactactccccagacgcagagcacgtccgggcgtcgccggcgggcagccaacgaggatccggacgagaagcgcaggaaattcctcgaacgaaatagggcggctgccagcagatgtcgccaaaaacgcaaagtgtgggtgcagagcctggagaaaaaagctgaagaccttagctctctaaatggacaacttcagagcgaagttaccctgctgcgcaatgaggtcgcccagctcaagcaactgctattggcccacaaagattgtccagtcactgctatgcagaagaagtccggctaccataccgcagacaaagatgattcttcagaggatatcagcgtcccatcctcacctcacactgaggcaatccagcactcctcagtcagtacttcaaacggcgtgtcttctacgtcgaaagctgaggccgtcgccacctcagtgcttacgcagatggcagaccagagtacagaaccagccctgagccagatcgtcatggctccttcaagccagtcacagccctcgggtagctag

SEQ ID NO: 13746 - DNA, 1188 bp, Artificial Sequence
  Description of Artificial Sequence: Synthetic coding sequence
atgaagtttaagctgcatgtgaacagcgcaaggcagtataaggacctctggaatatgtcagatgacaaacccttcttgtgcaccgcccccggctgcggacagagatttacaaacgaagatcatctcgccgttcacaaacataagcatgaaatgaccctgaagtttgggcctgcaagaaacgatagtgttatcgttgcagaccagactccaacaccaactagatttcttaagaactgtgaggaagttggcctgtttaatgagctggcctcgcctttcgagaatgaattcaagaaggccagcgaagacgatatcaagaagatgcctctggatctttcaccgcttgcaacccctattatccggagcaaaatcgaggagccaagcgttgtagaaactactcatcaagatagcccgctgccgcacccagagtccactaccagtgatgagaaagaggtgcccctcgctcagacggctcaacccacctctgccatagtacgaccagcaagcctgcaggtgcccaacgttttactcaccagctctgattcctccgttattatccaacaggccgtgccatcacccacctcaagtaccgtgatcacccaggcgcccagcagcaaccgccctatcgtgccggtgccgggaccattccccctcctgctccacttgcccaacgggcagacaatgcccgttgccatcccagcctctattacaagcagcaacgtgcacgtcccagccgcagtaccgctcgtcaggccggtgacaatggtgccctcagtcccaggcatccccggcccatcatctccacaaccggtccaaagcgaagccaaaatgcgactgaaggccgcactcacacagcagcatccgccagtgaccaatggtgacactgtgaaagggcatggcagcggcctagttaggactcagagtgaggagtcgcgcccacagtccctccagcagcccgccactagcacgaccgaaactcccgcctcccccgcgcatactactccccagacacagagtaccagcggcagacggcgtcgggcagccaacgaagaccctgatgaaaaaagaagaaagttcctcgagcgtaatcgggctgcagcctctcgctgcaggcaaaagaggaaggtttgggtgcaatcgctggagaaaaaagctgaagacctgtctagcctgaacgggcagctgcagtag

SEQ ID NO: 13747 - DNA, 1188 bp, Artificial Sequence
  Description of Artificial Sequence: Synthetic coding sequence
atgaaattcaagctgcacgtaaatagtgcacggcagtacaaagacctatggaatatgtcggacgataagcccttcctgtgtacagcccctgggtgtggacagagatttactaacgaggatcacctggcagtccacaaacataagcacgagatgacactcaagtttggaccagctagaaacgattccgtgatagtggccgatcagacccccactcccacccggttcctgaaaaattgcgaggaagttggcctgttcaacgagctcgcttctcccttcgagaatgaattcaagaaggcaagcgaagacgatatcaagaaaatgccccttgacctgtcaccactagcaacaccaataatccgctcgaagattgaagaaccatcagtggtggagaccacccatcaggactccccgcttcctcaccctgagagtaccacgtctgacgagaaagaggtcccgctagcccaaaccgcgcagccaacgtcagctatcgtgaggcctgcttcacttcaggtgccaaatgtgttactgacctcaagtgactctagcgtcataatccagcaggcagtgccatcacctacttcttcaacagttataacacaggccccctcctcgaacagaccaatagtgccagttccgggtccttttcctctgctactgcatttgccaaatgggcagaccatgcctgtggccattcccgcctccattacttcttcgaatgtgcatgtgccggctgccgtgccattggtcaggcccgtgacaatggtcccatcagtaccaggaatcccagggccgagctcaccccagcccgtacagtcagaggcgaaaatgcgactcaaggcagctctgactcaacaacatcccccagtgacaaatggtgacacagttaaagggcacggttctgggctcgtgagaactcagtctgaagagagtcgccctcagagtttgcagcaacctgccacatctaccaccgaaacaccagcatcgcccgcccataccacgcctcagacacagagcaccagcggcagaagacgcagagctgccaacgaggacccagacgagaagagacgaaagttcctcgaacgcaacagggcagccgccagcaggtgtcgacagaaaaggaaggtctgggtccaatccctcgagaagaaggctgaggacctctcttccctgaacggacagctgcagtag

SEQ ID NO: 13748 - DNA, 660 bp, Artificial Sequence
  Description of Artificial Sequence: Synthetic coding sequence
atgagtgatgataagccatttctgtgtactgcaccaggttgtggacagagattcacaaatgaagaccacctcgctgtacacaagcataagcatgagatgacactcaaattcgggcctgctaggaatgattctgtaatagtggcagaccagacacctacccctaccagatttttaaagaattgtgaggaggtcggattatttaatgagctggcttcaccctttgaaaacgagtttaagaaagcaagcgaggacgacattaaaaaaatgcccttagatctgtctcccttggccacacccatcattagatccaagattgaagagcctagcgtggtggagaccacacatcaggattccccattgcctcaccctgaatccaccacttccgacgagaaggaggtcccgttagctcaaacagcgcagcccacaagcgcaatcgtgcggcccgcttccctgcaggtaccgaacgttctgctaacaagctcggattctagcgttatcattcagcaagctgtcccctcccctacttcttctaccgtgattactcaggctcccagctcaaacaggcccattgtctcgttcgatcagtccccttggtgtctggtctttcaggagagccaggtgcttccgctcccgaaccaatactctcagaaacagaagtag

SEQ ID NO: 13749 - DNA, 1134 bp, Artificial Sequence
  Description of Artificial Sequence: Synthetic coding sequence
atgtccgacgataaacccttcctctgtaccgcccccggctgtgggcagcggtttaccaatgaggatcacttggcagtccacaaacacaagcacgaaatgaccctgaagttcggtcctgctagaaacgatagtgttatcgtagcggaccagacaccaacccctaccagatttctcaaaaactgtgaagaggtgggcctgtttaatgagcttgcatcccccttcgaaaatgagtttaaaaaggcttccgaagacgacatcaagaagatgcccctggacctcagccctttggctacacccattatccgttcaaagatagaggaaccgtcagtggtggagacaactcatcaggatagccctcttccgcacccagagtccacaacgagtgatgagaaagaggtgccactcgcccaaacagctcaacctacaagtgccatcgtcaggcccgccagcttacaagtcccaaacgttctacttaccagctcagactccagcgtgatcattcagcaggctgtgccgtcccccacatcttcaacagtgataacgcaagccccgagctctaatcgacccatagtgcctgtgccaggtcccttcccattgctgctgcacctgccaaacggccaaactatgcctgttgccattcctgccagcattacatcgtcaaatgtgcatgtgccagccgctgtgccactagttcgccccgttaccatggtcccatcagtgcccggaataccagggcccagttccccgcagcctgtgcagagtgaggccaaaatgcggttaaaggctgcccttacccagcagcacccccccgtgactaatggggatactgttaagggtcacggttccggtctggtgaggacccaatcggaagagtcacggccgcagtcactgcaacagcccgccacatctaccactgagactccagcttcacctgcccacaccactcctcagacccagtcgactagcggccggcgtcggcgggcagccaatgaagaccccgatgaaaaacgtaggaagtttctggaaaggaatcgggctgctgcaagtaggtgtcgccagaaacgaaaagtctgggtgcagtctctggaaaagaaagccgaagacctgtccagtcttaacggacaacttcagtag

SEQ ID NO: 13750 - DNA, 1449 bp, Artificial Sequence
  Description of Artificial Sequence: Synthetic coding sequence
atgaaattcaaattacacgtgaactccgctcgccagtacaaggacctgtggaatatgagtgatgacaaaccatttttatgtaccgcccccggctgcggccagaggttcacaaacgaggaccatctggccgatcagactccaaccccgactaggtttttgaagaattgcgaggaggtcgggctctttaatgagctcgcctctccgttcgagaatgaattcaagaaagcctctgaggatgacatcaaaaagatgccactggatctgtctcctctggcaacccctatcatacgttcaaagattgaggaacctagcgtcgtggaaacaacgcatcaggactcgcccctgccacaccccgagtcaactacttctgatgagaaagaagtaccactagcccagacggcgcaacctacttcagccatagtgcgtccagctagcctgcaggttccaaatgtcctcctcacaagttctgacagctctgtgatcatccagcaggccgtgccttcgcctaccagttcaacagttatcacacaggcccccagcagtaaccggcctatagtgcctgtgccaggacccttcccactccttctgcatctaccgaatggccagaccatgcctgtagccattcctgcatcaattacgagttcaaacgtccatgtgccagcagccgtccccctcgtaagacctgtgaccatggtgccttcggtgcccggaatcccgggtccttcaagcccacaaccagtgcagtccgaagccaagatgagactgaaggcagcccttacccagcaacacccacccgtaacaaacggcgatacagtgaaaggccacggcagcggcttagtgcgtacccagtcagaggagagccggccacagtccctccagcagcccgcgacatccacgacagagactcccgcaagcccagctcacacaacaccccagacacagtccacctctgggaggcggcgacgggccgcaaacgaagacccagatgaaaaacgaagaaaattcctggaaagaaaccgggcagccgcctcacgctgccggcagaaacggaaggtatgggtacaatcactcgagaagaaggcggaggacttgtcctccttaaatggacagctgcaatccgaggtcaccctgcttcgaaacgaggttgcccagttaaaacagcttctgttggcacataaggattgccctgttactgccatgcagaagaagagtggataccataccgctgataaagacgacagcagcgaagacatctccgtcccatcgagtcctcacacagaggcaattcagcatagctccgtaagtaccagcaatggggtgagcagcacctctaaggccgaagcagtggcaacaagtgtattgactcaaatggccgaccagtctaccgaacccgcactgtcacagattgttatggcccctagctctcagtcccagccgtcaggttcgtag

SEQ ID NO: 13751 - DNA, 2136 bp, Artificial Sequence
  Description of Artificial Sequence: Synthetic coding sequence
atgaaactgaaactgaacgtgcttaccatcatattgctgccagtgcatctactgatcaccatttacagtgctctcatctttataccctggtattttcttaccaatgccaaaaaaaaaaacgctatggccaagcgaatcaaggcaaagccaacctccgacaaaccaggatccccctatagatccgttactcacttcgatagcctggctgtgatcgacattccaggggcggatacactggacaagttgtttgatcacgccgtgtccaaattcggcaagaaagattccctggggacccgtgaaatcctcagtgaggaaaatgaaatgcagcctaacggcaaagtgtttaaaaaactcatcctgggaaactataagtggatgaattatctggaggttaacagaagagtgaacaatttcggttccggattaacagccctgggtctcaaaccaaagaacactatcgctatcttttgcgaaacgcgtgccgaatggatgatcgctgcccagacctgctttaagtataattttccactggtgactctgtacgccaccctggggaaagaggcggtcgtccatggactgaatgaatccgaagcgtcctatcttataactagtgtggaactgttggaaagtaaattaaagaccgccctcctagatatcagttgtgtgaaacatattatctatgtggataataaagctatcaacaaggcagagtacccagagggcttcgagatccattctatgcagtctgtggaagagctggggtcaaaccccgagaatctcgggattccaccctcaagaccaaccccatcagatatggcgatagttatgtacacatcaggaagcactggtcgtcccaaaggcgtgatgatgcaccatagcaacctgatcgccggcatgaccggtcaatgcgagagaatacccggactgggtccgaaagatacatatatcgggtacctgcccctggcccatgttctggaattgactgccgaaataagctgtttcacctatggatgtcgcattgggtattcttccccgctgaccctcagtgaccagtctagtaagatcaagaaagggagtaagggggactgcactgtattaaaacccaccctgatggccgctgttcctgaaatcatggatcgaatatataaaaacgtaatgagcaaggtacaagagatgaactatattcagaagacgttatttaagattggttatgattacaagctggagcagataaagaaagggtacgatgcacctctctgcaatctgctactcttcaagaaagttaaagcactgctggggggcaatgtgaggatgatgctgagtgggggagctcccctgagcccacagacacaccggttcatgaacgtgtgcttctgttgtccgataggacaagggtacgggctcacggagtcctgtggcgcaggaacagtaaccgaggtgaccgactacaccaccggccgtgtcggggcaccacttatttgctgcgagatcaaactaaaggactggcaagagggcggctatactattaatgacaagcctaatccgagaggtgaaattgtgattggaggccagaacatctccatgggttacttcaagaacgaggaaaagacggccgaagactacagtgtggatgaaaacggtcagaggtggttctgcactggcgatatcggcgagtttcacccggatggctgcctgcagatcatagataggaagaaagacctggttaagctgcaagcgggagagtatgtcagcctgggtaaggtggaggccgctctcaagaattgcccactgatcgacaatatctgtgcatttgccaaatccgatcagtcgtacgtcatctcattcgtggtgcccaaccagaagcgccttactctgttggcccagcaaaagggggtggaaggcacctgggtggacatatgcaacaatcccgcgatggaagccgaaattctcaaagaaattagagaagcagctaacgccatgaagcttgagcggtttgagattccgattaaggtacgactttcccctgaaccttggactcctgagacagggttagttacggacgcgtttaagcttaagaggaaagaattgagaaaccactacctcaaagacatcgaaaggatgtacgggggtaagtag

SEQ ID NO: 13752 - DNA, 2013 bp, Artificial Sequence
  Description of Artificial Sequence: Synthetic coding sequence
atggcaaagcgtataaaagccaaaccgacaagcgataagcccggcagtccgtatagatcagtgacacatttcgactcccttgccgtgattgatattcccggagctgatactctggacaaactgttcgatcatgccgtgtctaaatttggcaagaaggactcactgggcaccagggaaatactctcagaagagaatgagatgcagccgaatggaaaggtgtttaagaagctaatcttggggaactacaagtggatgaattacctagaggtcaatagaagagttaataatttcggctcaggcctgaccgcactaggactcaagcctaaaaatacaattgccatattttgcgaaactcgcgctgagtggatgattgcagcacaaacctgcttcaagtacaattttcccctggttaccctttacgctacccttggtaaagaagcggtggtgcatggactcaacgagtctgaggcatcttatctcattacctccgtggagcttcttgagagcaagctgaagactgcactgcttgacatatcgtgtgtgaagcatatcatctatgtggataacaaagctattaacaaggcagagtaccccgaggggttcgagattcactccatgcagagcgtcgaggaactcggatctaatccagagaacttaggcattcctcccagcagaccgaccccgagcgatatggctattgtcatgtacacctctggcagcacagggcggcctaaaggagtgatgatgcatcattccaatctcattgcaggcatgactggccagtgtgaacgcatccccggacttggcccaaaagatacgtatattggttacctgccgttggcgcacgtgttggagctaaccgcagagatcagctgcttcacctatggctgtagaatcggctactctagccctctcactctgtctgaccagtcttccaagattaaaaagggatccaaaggagactgcaccgtacttaaacctaccttaatggctgccgtgccagagatcatggatagaatttacaaaaacgttatgtctaaggtgcaggaaatgaactacatacaaaagaccctgttcaagattggttacgactataagctggagcagattaagaagggttacgatgcaccgctctgcaatctccttttatttaaaaaggttaaagctctcctgggggggaatgtccgcatgatgctttctgggggcgcacctttaagtccacaaactcacaggttcatgaacgtctgcttttgttgtcccattgggcaggggtacgggcttacagagagctgcggcgctggcactgtaacagaggtcacggactacacaaccggcagggttggggcgcctcttatttgttgtgagataaagctgaaagattggcaggaagggggttatacaatcaacgacaagccaaatcctaggggtgagattgtgattgggggtcagaatatttccatggggtactttaagaatgaagaaaaaactgccgaagattactctgtagatgagaacggccagaggtggttttgcaccggggatatcggtgaattccatcccgacggctgtcttcagatcatagatcggaaaaaggacttggttaagctgcaggctggcgagtacgtttccctcgggaaggttgaagctgcccttaagaattgccccctcatcgacaatatctgcgcctttgccaagtctgaccagagctatgttatatcatttgtcgtcccaaatcagaagagactgactctgctcgcccagcagaagggagttgaggggacgtgggttgatatctgcaataatcctgcgatggaagcagagatcctgaaagaaatcagggaagcagcgaatgctatgaagttggagaggtttgagatcccaatcaaagtgcgcctgtcacccgagccgtggacaccagaaacgggattggtgactgacgcttttaaactgaaacgaaaagagcttaggaatcattacctgaaagatatcgaacgcatgtacggaggtaaatag

SEQ ID NO: 13753 - DNA, 2136 bp, Artificial Sequence
  Description of Artificial Sequence: Synthetic coding sequence
atgaagctgaagttaaatgtcctcacgatcattctccttccagtgcatctgttgattactatatattctgctcttatttttattccttggtatttcctgaccaatgccaagaagaagaatgcaatggcgaagcggattaaagcaaaaccgacatcagataagcctgggtcgccttatcggtccgtcacgcacttcgacagtctggcagttatcgacattcctggtgccgacaccctggataaactcttcgaccatgcagtcagcaaattcggcaagaaggacagtctgggtacacgtgaaatcctgtcggaagagaacgagatgcaacctaacgggaaggtgttcaaaaaactgattcttggtaattataaatggatgaactacctcgaggtaaaccgccgagtgaacaactttggttccggcctcacggctctcgggttaaagccgaaaaatacaattgcaattttttgcgagactagagccgagtggatgatcgcagcccagacctgcttcaagtataattttcctctggtcacgctgtatgcaacgctggggaaagaggcagtggtgcatggcttgaacgagtccgaagcttcttatttaattacatcagttgagctcttggagagcaagctgaagacagccttactggatattagctgcgtgaaacacattatttatgtcgacaataaagccatcaataaggccgaatatccagaggggttcgagatacattcgatgcagtctgtggaggaactgggctccaaccctgaaaacctcgggattcctccatccaggccaaccccctcagacatggcaatcgtcatgtatacaagcggtagtacaggcagaccaaagggcgttatgatgcaccatagtaatctgatcgcgggcatgaccggccagtgcgaacgtatccccggtctcggtccgaaggacacatacatcggctatttgcccttggcacacgtgctggaactcaccgccgagatctcttgtttcacttacggatgtcgaattggctattcctcgccattaaccctgtccgaccagagtagtaagattaaaaagggtagcaagggggactgcacggtgctcaagccaaccttgatggccgccgtcccggagataatggaccggatttataagaacgtcatgtccaaagtccaggagatgaattatatccaaaagactcttttcaaaattggctatgattacaagttggaacaaattaagaagggctacgacgcacccctctgtaacctactgctttttaagaaagtgaaggcactcctgggtggcaatgtgaggatgatgctatctggtggtgcgcctcttagccctcagacacataggtttatgaatgtgtgcttctgctgcccaataggccaggggtacggtctgacagagagctgcggagctggcaccgtgactgaagtgacagattatactacggggcgggtgggcgcgcctcttatttgctgcgagataaagcttaaggattggcaagagggcggctatacgatcaacgacaagccaaatcctcgcggcgaaatagttattgggggccagaatatctccatgggctattttaaaaatgaggagaagactgccgaggactattccgttgatgaaaacggccaaaggtggttctgcactggcgatatcggcgaattccatccggacggttgcctccagatcatcgaccgcaaaaaagatctggtcaaattgcaggctggagagtatgtgtccttgggtaaggtggaggcggccctcaaaaattgcccgctgattgacaatatctgcgcctttgccaagagcgatcagtcatacgtcatcagtttcgtggttcccaatcagaagcgtctcaccctgctggctcagcagaagggggtcgaggggacatgggtggacatctgcaacaacccagccatggaagcagagattctgaaagagattcgagaggctgcaaacgcgatgaaactggagcgttttgagattccgatcaaggtgcggctttctcctgagccatggacacccgaaactggcctagtgactgacgcttttaagctgaagcgcaaagaactccgaaatcattacctcaaggatattgagaggatgtacggtggcaagtag

SEQ ID NO: 13754 - DNA, 165 bp, Artificial Sequence
  Description of Artificial Sequence: Synthetic coding sequence
atgaagctgaagctaaacgtcctgacaattatactgctgcccgtacacctgctgatcacaatatacagcgcacttattttcattccatggtattttctaactaacgctaagaaaaaaaatgccatggcgaagagaattaaggctaagccgacctccgacaaatag

SEQ ID NO: 13755 - DNA, 438 bp, Artificial Sequence
  Description of Artificial Sequence: Synthetic coding sequence
atgaaactcaagctgaatgtgctcactatcatactgctgcctgtccacctgctcattacaatatacagcgccttaatcttcatcccgtggtactttctgacaaatgccaagaagaaaaacgctatggccaaacgtattaaagccaaacctacgagcgacaaaccaggcagcccctaccgcagtgttacgcattttgatagtctggcagtcatagatataccaggagccgacacgctggacaagctgttcgatcatgctgtctccaagtttggcaagaaggatagcctcggcactcgggagattctaagtgaggagaatgaaatgcagcccaacggtaaagttttcaaaaaactgatccttggaaattacaagtggatgaactatctcgaagtcaatagacgagtaaacaatttcggcagcggcctgactgctctttag

SEQ ID NO: 13756 - DNA, 381 bp, Artificial Sequence
  Description of Artificial Sequence: Synthetic coding sequence
atgaagcttaaactcaacgtgttaacgattatcctgctgccagttcatctgcttattacaatctacagcgccctaatcttcattccatggtactttcttaccaatgccaaaaagaaaaatgccatggcaaaacgaatcaaagctaagcctacttctgataagcccggttccccttatcggagtgtaactcacttcgactcacttgctgttatcgacattcctggcgccgacaccttggacaagttgtttgatcacgcagtcagcaagttcggtaagaaggattcactgggaacaagggagatactgagcgaagaaaatgaaatgcaacctaatggtaaggtgttcaagaagctcattctgggcaattacaaatggatgtag

SEQ ID NO: 13757 - DNA, 465 bp, Artificial Sequence
  Description of Artificial Sequence: Synthetic coding sequence
atggcgaagcggattaaggccaagccaacatcagacaagcctggctccccctaccggtccgtgacccacttcgactcgcttgccgtcatcgacatccctggtgccgatacgctcgacaaactcttcgaccatgccgtctcgaagttcggaaaaaaggattctctcgggacgagggagatcctatccgaagaaaacgagatgcagcctaacgggaaggtgttcaagaagctaattctaggaaattataaatggatgaactatctggaagtgaacaggcgcgtaaacaactttggctccggcctaactgctctgggactcaagcccaagaataccattgcgatcttctgcgagactagggctgagtggatgatagcagcccagacttgttttaaatataactttcctttggtcacactctatgctacgctgggaaaagaagcagtggtgcacgggctgaatgaatag

SEQ ID NO: 13758 - DNA, 387 bp, Artificial Sequence
  Description of Artificial Sequence: Synthetic coding sequence
atgaagctgaagctgaatgttctcacaatcatattgctgccagttcatctcctgattacgatctattcagcgctcattttcatcccttggtactttcttacgaatgccaaaaaaaagaatgccatggccaagcgcattaaggctaagccgacgagcgacaaaccgggatctccttatcggtcggtgacacacttcgactccttggcagttattgatattcccggagccgacactctggataagctgttcgatcatgccgtttccaagtttggaaagaaggactccttgggcacccgagagattttgtccgaggagaatgagatgcaaccaaacggtaaagtttttaagaagttgattttgggcaactacaagtggatgaactattag

SEQ ID NO: 13759 - DNA, 2475 bp, Artificial Sequence
  Description of Artificial Sequence: Synthetic coding sequence
atgcgccagtcactgctgtttctgaccagcgttgtgccattcgtgctggctccccgaccgcccgacgaccctggcttcggacctcatcagcggctcgagaaattggattcactgcttagcgattatgatatactgtctctctctaacatccaacagcactctgtccgcaagcgggatctgcagacgtcaacacacgtggagaccctcttgacgtttagcgcactgaagcgtcattttaagttgtatctgacttctagcaccgagcgcttttcccagaacttcaaggttgtggtcgttgatggcaaaaacgaatcagaatataccgtcaaatggcaagatttctttacagggcacgttgtaggagaaccggattctcgggtgctggcccacattcgggacgatgatgtgatcattagaatcaacaccgatggtgctgagtacaacatcgagcccctatggcgttttgtcaatgacaccaaagacaagcgcatgctggtatataaatccgaggacattaaaaatgttagccggcttcagtcccccaaagtgtgcggatacctgaaagtcgacaacgaggaactactgcctaaagggctggttgatagagagcccccagaagaattagtacatcgtgtgaagcggagggcagatcccgatcctatgaagaacacttgcaagctgctcgtagtggccgaccaccgcttctatcggtatatgggcaggggggaggagagcactacaacaaactatctgatagaactgatcgatcgagtggacgatatttaccgcaatacaagttgggacaacgccgggttcaagggatatgggatccagattgaacaaatccggatccttaagtcaccacaggaagtgaagcccggtgaaaagcattacaatatggccaagtcctatccaaatgaagagaaagatgcttgggatgtgaagatgttgcttgagcaattctcattcgatattgcagaagaggcaagcaaagtttgtttggctcatttattcacataccaggactttgacatgggtactcttgggctggcttacgtcgggtccccaagagcgaattcccacggcggtgtgtgtccgaaggcctattacagccctgttggcaagaaaaacatctacttaaattctggattaacgtcaacaaaaaactacgggaaaactatattaactaaggaagcggacttagtcacaactcatgagctggggcacaatttcggcgcagagcatgacccagatggccttgccgagtgcgcaccgaacgaggaccagggaggcaaatacgtgatgtacccaatagctgtgtcaggtgatcatgaaaataataagatgttttcaaactgtagcaagcagagcatctacaaaaccatcgagtccaaggcccaggaatgctttcaggaacggtccaacaaagtctgcgggaacagtcgcgtagacgaaggcgaagagtgtgaccctggaatcatgtacctgaacaacgatacttgctgtaattcagattgcaccttaaaggagggggtacagtgcagcgacagaaattccccatgttgtaaaaactgccaattcgaaaccgcacaaaagaagtgccaggaggccatcaacgccacttgtaagggagtatcctactgcacaggcaatagctctgagtgtcccccccccggcaatgccgaagatgataccgtctgcctcgatctcggaaaatgcaaagacggaaagtgtataccattctgcgagcgggaacagcagctggagagttgcgcatgtaatgaaacagataattcttgcaaagtgtgctgccgagacctctccggcagatgcgtgccctacgtcgacgctgagcagaaaaacctgttcctgagaaaaggcaaaccatgtactgtgggattctgtgatatgaatggaaaatgcgaaaagcgcgtgcaggatgtcatcgaacgattctgggactttatcgatcagctctcaatcaatacctttggaaagttcctcgcggataacatcgttgggtcggtactggtcttcagcctgatcttctggattccgttcagcatcttagttcactgcgtcgacaaaaaattggataaacagtacgagtcactgtccttgtttcatcctagcaacgttgaaatgctcagctcaatggattccgccagtgtgcggattatcaagccctttcccgccccgcagacccctggtcgcttacaaccagccccagtgatacctagcgcccccgccgcgcctaaattggaccaccagagaatggacacgatacaggaagatccgtctactgacagccatatggatgaagacggctttgagaaggatccttttccaaattcctccaccgccgctaagagctttgaggatctgaccgaccacccagtcactcgtagcgagaaagcggccagctttaagctacagaggcagaatcgcgtagactcaaaggagaccgagtgttag

SEQ ID NO: 13760 - DNA, 777 bp, Artificial Sequence
  Description of Artificial Sequence: Synthetic coding sequence
atgcggcagtcacttctgttcttgacatccgttgtgccctttgtgttggcccctcggccaccagacgatcctggctttggaccacaccagaggctcgagaagctggattctctcctgagcgattatgatattttgagtctatctaacattcaacagcatagtgtacggaaacgggatctccaaaccagcacacatgttgagaccctgttaacattcagcgccttgaagcgccatttcaagttatatttgacttcctccacggagaggttcagtcagaacttcaaagtagtggtcgtcgacggcaaaaacgagtccgaatacacagtgaagtggcaggacttctttactgggcatgtggtcggcgagcccgattcacgagtcctggcacacatccgagatgacgacgtgataatccgcatcaacactgacggggccgagtataacattgaaccattatggcgctttgtcaacgatacaaaagacaagcggatgctcgtctataaatcagaagacatcaagaatgtgagccgactccagagtcccaaggtgtgtggctacttaaaggtggataacgaggagctgctacccaaagggctggtggatagggaaccccccgaggaacttgtgcatcgtgtgaaacggagggccgacccagatcctatgaaaaatacctgcaaattattggtggtggccgatcacagattttaccgatacatgggacgcggcgaggaatctacaacgaccaactatctcatccataccgacagggctaactag

SEQ ID NO: 13761 - DNA, 2499 bp, Artificial Sequence
  Description of Artificial Sequence: Synthetic coding sequence
atgaagccccctggttccagcagccggcagccaccgttagcaggatgtagtctggccggtgcatcctgcggcccgcagcgagggccagcgggatccgttccagcctcagcccccgccagaacccccccgtgtagattgctcttggtcctgttactcttaccacctttagccgcaagttccagaccaagagcttggggggccgctgcccctagcgctccacactggaatgagaccgccgaaaaaaacctgggggtcttggccgacgaagacaacacactgcagcagaatagctcatccaacattagctactccaatgccatgcagaaggaaatcacactgccatcgcggctgatatactacatcaaccaagattctgaaagcccataccatgtgctggatacaaaagcacgtcaccagcagaaacataacaaggccgtgcatctcgcacaggccagcttccaaatcgaggcctttgggtccaaattcatacttgacctcatattaaacaatggcctgctgagctccgattacgtggaaatccactacgagaacggtaagcctcagtatagcaaggggggtgaacactgctattatcatggatccattcgcggagtcaaggattctaaggtggctctgtcaacgtgtaacggcttgcacggtatgtttgaggacgacactttcgtctacatgatagagcctctggaattagtgcatgacgagaagagtactgggaggccgcacattattcagaagacgctggccgggcagtatagcaaacagatgaagaacctaacgatggaacgaggagaccagtggccgttcctgagcgagttgcaatggctgaagcgacgtaagcgcgctgttaacccaagcaggggtatcttcgaggagatgaaatacttggagctgatgatcgtcaacgaccataaaacatataagaagcacaggagttcacatgctcataccaataatttcgccaaaagcgtggtgaaccttgtggactctatttacaaggagcagctgaacacacgcgtggtgcttgtagccgtcgaaacatggaccgagaaggatcagattgatatcactactaacccagttcagatgctgcatgagttcagcaagtatcgccaaagaattaagcagcacgccgatgccgtgcacttaatcagcagggtgacatttcattacaaacgaagctcacttagttactttggaggcgtctgcagtcgtacacggggggttggtgtgaatgagtatggccttccgatggccgtcgcgcaggtactgtcccagtctctggctcagaacttggggatacaatgggaaccttcttcacgaaaaccaaaatgcgactgcactgaatcctggggagggtgtattatggaggagaccggcgtgtctcattccaggaagttttcaaaatgcagtatcctcgagtacagagactttcttcaaaggggcggtggcgcatgtctcttcaacagacctacaaagttgttcgagccgacagagtgcggcaatgggtacgttgaagccggagaggagtgcgactgcggctttcacgtggagtgttatgggctctgttgcaagaagtgttctttgagcaatggagcccactgcagcgacggcccctgctgcaataatacatcttgtctcttccagccccggggttacgagtgccgcgatgctgtaaatgagtgtgacataacagagtactgcactggtgattcaggtcagtgtcccccaaaccttcataaacaggatgggtatgcttgtaaccagaaccagggtagatgctacaatggcgagtgtaagaccagggataaccagtgtcagtacatttggggcacgaaggccgcagggtccgacaagttttgctacgagaagctgaacacagagggaaccgagaagggaaactgtggtaaggatggcgacaggtggatacagtgtagcaagcacgacgtgttttgtggatttctgctgtgcacgaatcttaccagggccccccggattgggcagctgcagggagaaataattcctacctccttttatcaccaggggagggtgattgattgcagcggagcccacgtcgttctggacgacgacacagatgtcggctatgtggaggatgggacaccttgcggaccttcaatgatgtgtctggatcggaagtgccttcagatccaggccctcaacatgtcttcctgcccacttgattctaaaggaaaggtctgcagtggccatggcgtctgttctaatgaggctacatgtatctgtgactttacatgggccggaacagactgcagtatcagagacccagtgcgcaacctgcaccctcctaaggacgaggggccaaagggccctagcgctaccaacctcatcattgggtccatagcaggggcaatccttgtggccgccatagtgctgggcggaacgggctggggcttcaaaaacgtgaagaagcgacgattcgaccctacgcaacaggggccgatctag

SEQ ID NO: 13762 - DNA, 2499 bp, Artificial Sequence
  Description of Artificial Sequence: Synthetic coding sequence
atgaagcctccagggagctcttcacggcagcctcccctggccgggtgctccctggctggagcatcttgtggaccacagcgcggtcccgctgggtctgtgccagcaagtgcccccgccaggactcccccatgccgcctgctgcttgtgctccttctattgccaccactggcggcgtctagtagaccacgggcctggggcgccgccgccccttctgctccacattggaatgaaacagccgaaaagaacctgggggtgttggcagacgaagacaacacccttcaacagaacagctcctctaatattagctactccaacgccatgcagaaggagatcaccctcccaagccgattaatctattacataaatcaggattcggaaagcccttatcacgtcctagacaccaaggctcggcaccagcagaaacataacaaggccgtgcatctggcacaggccagtttccagattgaggcattcggatctaagtttatcctggatctaatcctgaacaacgggttgctgtccagcgattatgtggagattcactatgagaacggtaagccgcagtactctaaaggtggagaacactgctactatcacggctccattcgtggggtcaaggattcaaaggtagccttgtccacctgcaatggtctgcatgggatgtttgaagacgatactttcgtgtatatgatcgagccactcgaactcgtgcacgatgagaagtcgaccggaagaccacatattatccagaagacccttgcgggacaatacagcaagcagatgaagaatttaaccatggaaaggggagaccagtggccctttctgtcagagctgcagtggctcaagagaagaaaacgtgccgtgaacccatccagaggcattttcgaagagatgaagtatttggagctcatgatcgttaatgatcacaagacatataaaaagcacagatcgtctcatgctcacaccaataacttcgcgaagtccgtggttaatttagtggactccatatacaaggagcagttaaacacacgagtcgttctggtggctgtggaaacatggactgaaaaagatcaaatcgatattaccactaatcccgtgcagatgctgcacgaattcagcaaatacaggcagaggattaagcagcacgccgacgcagtgcatctgattagtagggtgacgttccattacaaacgtagctccctgagttatttcgggggagtctgctctaggacaaggggcgttggtgtaaatgaatacggacttccaatggctgttgcccaggtactgtcacagtctttggctcagaatctcggaatccaatgggaacctagctccagaaaacctaagtgtgactgcaccgaatcctggggcgggtgcattatggaggagacaggtgtatcccacagcaggaagtttagcaagtgtagcattctggagtatcgtgactttttacagcgcggaggcggcgcttgcctgtttaatcgccccacaaaactattcgagccaactgagtgtggtaatggctacgtggaggctggcgaggagtgcgattgcgggtttcacgtcgagtgctatggcctgtgctgtaagaagtgcagcctgtcaaacggagcgcactgcagcgatgggccatgttgcaataatacatcttgcctgtttcagccacggggatatgaatgccgcgacgccgtgaatgagtgcgatattaccgagtattgtactggggattctggacagtgtcctcctaatctgcacaagcaagacgggtacgcctgcaatcagaaccaggggagatgttataacggtgaatgtaagaccagagacaatcagtgccagtacatatggggcaccaaggcagccggaagtgataaattttgttacgaaaagcttaacactgagggcacggaaaagggaaactgcgggaaggacggcgatcgctggatccagtgcagtaagcacgacgtgttctgcggcttcctgctgtgtaccaatctcacaagggctccacgaatcggccagctgcagggcgaaataattcctacctccttttaccaccaaggccgcgtcatcgattgctctggagcacacgtagtactggacgatgacaccgatgtgggctacgtagaggacggcactccttgtggaccctctatgatgtgcctggatcgcaagtgtttgcagatccaggctttaaacatgtcctcgtgccccctagacagcaagggcaaggtgtgtagcgggcatggagtctgtagcaacgaagcaacgtgtatttgcgacttcacctgggctgggacagattgctcaattagggaccccgtgagaaatctccatcctccaaaggacgagggccctaaggtgaatatggctactagccgcttgatcggagcagtggccggaacgatcttggccctgggggtgatattcggaggcacaggttggggcattgaaaatgtgaagaaacggaggttcgaccctacgcaacagggtccaatctag

SEQ ID NO: 13763 - DNA, 2499 bp, Artificial Sequence
  Description of Artificial Sequence: Synthetic coding sequence
atgaagcccccagggtcctcctcacgccagccccctctagctgggtgttctttagccggcgcttcctgcggcccacaaaggggccccgccggcagtgtcccagcgagtgcaccggccagaacacctccctgcaggctgctcctggtcctcctcctcctgcccccgctggccgccagcagccgtccaagagcatggggggccgctgctcctagcgcgccacactggaatgaaaccgcagagaagaacctgggggtgctggcagacgaggacaataccctgcagcagaatagctcctccaacatatcatacagcaatgccatgcagaaggagatcactctccccagccggctgatttattacataaaccaggattcagaatcaccttaccatgtgctggacactaaggcaaggcaccagcaaaaacacaacaaagctgtgcacttggcccaggcgagttttcagattgaagcctttggatccaaatttatccttgatctcattctgaacaacggcctgctcagcagcgactatgtcgaaattcactatgaaaatggcaagccacagtactcaaagggcggagaacattgttattaccatggctcaatccgcggagttaaggattctaaggtggctctgtcaacgtgcaacggcctgcacggtatgtttgaagacgacacattcgtttatatgatcgagccgcttgaactagtgcatgatgagaagagtacaggacgtccccatattatacaaaagactcttgcgggacagtactcaaaacagatgaagaacctcaccatggagagaggtgaccaatggccgttcctgtcggagctgcagtggctgaagcggcgaaagcgggcagtgaacccctcccgcgggattttcgaggaaatgaaatatctggagttgatgatagtgaacgaccataaaacatataaaaaacataggtctagccacgcacacaccaataactttgcgaaatcagttgtgaacctcgtagatagcatatataaggaacaactgaacactagagtggttttggtagcagttgaaacttggaccgagaaagatcagatcgacataaccactaaccctgtgcagatgctccacgagttctccaaatataggcaaaggatcaagcagcatgccgatgctgtccatttgatctctcgggtcactttccactataaaagatcctctttatcctatttcggcggcgtgtgtagcagaacacggggcgtgggggtaaacgagtatggtttacccatggccgtggctcaggtcctgagccagagccttgcgcagaacctggggatccagtgggagccgtccagtcgcaagcccaagtgcgactgcactgagtcctggggaggatgcatcatggaggagacgggcgtttcacactcacgcaaattcagtaagtgtagcatcctggagtacagggactttttacagcgggggggaggcgcctgcctgtttaaccgcccaaccaagctgtttgaacctactgagtgcggcaatggatacgtggaggctggagaagagtgtgactgtggctttcacgtggagtgttacggcctctgctgtaagaagtgtagtctgtccaatggcgcccactgttcagacgggccctgttgcaacaacacttcttgcctgttccagcctagaggctacgagtgtagagatgcggtgaatgagtgtgacattactgagtattgcaccggggattcaggtcagtgtcctcccaatctgcataagcaagacggatacgcctgtaatcagaatcagggcaggtgttacaatggcgaatgcaagacccgtgataaccagtgtcagtacatttggggtaccaaagccgccgggtccgacaaattctgctacgagaagctgaacacagaaggtacagagaaggggaactgcggtaaggatggcgatcggtggatccagtgttcgaagcacgatgtgttttgcgggttcctactgtgcaccaacttaacccgcgctccacggataggtcagctccagggcgaaattatacccacaagcttctatcatcagggtagggtgattgactgcagcggcgcgcatgttgtgttggacgacgataccgacgtgggatacgtagaagacggaactccatgcggcccttccatgatgtgcttagatcgtaaatgcttgcagatccaagcccttaatatgtcctcatgccctctggacagcaaaggcaaagtgtgttccggacatggggtgtgttcgaacgaagcaacttgtatttgcgatttcacctgggctggcaccgactgcagtatccgagacccagtacgcaatctgcaccctccaaaggatgagggacctaaggaaatgtccaggagagagggctccatcctactgagtaaggctcccagtgagtccgccgccttagacggccaccgcctcgcactcctcgattcagggtatgatatcctagctgcagtactcctggagctgctgtccctgtag

SEQ ID NO: 13764 - DNA, 2100 bp, Artificial Sequence
  Description of Artificial Sequence: Synthetic coding sequence
atgcaaaaggagattacccttccttcgcggttgatttactacataaaccaggactctgaatccccatatcacgttctcgacactaaggctaggcaccagcagaaacacaataaggcagtccatctcgcccaggcgagtttccagattgaggcctttgggagcaaatttattctggatctgattttaaacaacggtctgctatcatctgactacgtggaaatacactatgagaatggcaaaccacagtattctaaaggcggtgagcactgctattatcacggatcgattaggggcgtaaaggatagtaaagtggccctgtctacatgcaatggcctccatggaatgttcgaggacgataccttcgtgtatatgatcgagcccctggaattggtacatgacgagaagagcactggccggcctcacattattcaaaaaaccctggccgggcagtactccaagcagatgaagaatctcacaatggagagaggggaccagtggccttttctgagcgagctacaatggctgaaaaggagaaagagggctgtgaaccctagtcgtgggatttttgaggagatgaaatacctagagctcatgattgtgaacgaccacaagacctacaagaagcaccgctcatcccacgcccatacaaataatttcgccaaaagcgtcgtgaatctggtcgacagtatctacaaggagcagctgaacacacgtgtggtgctggtcgccgtagagacttggaccgagaaagaccagatagacattacgaccaatcccgttcagatgcttcacgagttctcaaaatataggcaacgaattaagcagcacgccgacgcggtgcatctcatttcgagagtgacctttcactataagaggagctccctcagctattttggaggagtgtgcagcaggacacgcggagtgggcgtcaatgagtatgggctgccgatggcggtggcacaggtgctctcccagagtctggcacagaatcttggcatccagtgggaaccaagttcacggaagcccaagtgcgactgtacagagtcatggggaggctgcatcatggaagaaaccggggtttcccattcccgcaaatttagcaagtgctcaattctcgaatacagggactttctccagcgaggcggaggagcctgcctgttcaacagacctactaaactgtttgaacccaccgagtgtgggaatgggtatgtagaagccggcgaggaatgtgattgcggctttcatgtggaatgttacggtctatgctgtaagaaatgcagtctgagcaacggtgctcattgctcagatgggccgtgctgtaataacacgtcttgcttgtttcagccccggggctacgaatgtcgcgatgccgtaaacgaatgcgatatcacagagtactgtacaggagattccggacagtgcccacctaatctccataagcaggacggctacgcttgcaaccaaaaccagggtcgctgctacaacggcgagtgtaagacccgggacaatcaatgccagtacatctgggggaccaaggcagctggctctgacaaattttgttacgagaaattaaacaccgagggcactgagaaagggaattgtggaaaagatggagatcgctggatccagtgtagtaagcatgatgtgttctgcggctttttgctgtgtaccaatctaacacgcgctcctcggattggtcagcttcaaggggaaatcattccaactagtttctaccatcaaggccgagtgatcgattgttccggcgctcacgtggtgctggatgacgatactgacgtggggtacgtggaagatgggactccatgtgggccatcaatgatgtgtctggaccggaagtgcctccaaatacaagctcttaacatgagtagctgtcccctggactccaaagacgaaggccctaaggcttgttttttgaaacgcaccaaatgtaagtcctaccccaagcaccggaagtgccaggaggagaaggtacgctcatacagcgcccggccccacctcaatcagttgcgctggatggacacagcgttacattgttggatattgggaatgacttattctcagcagtgctattggaattactag

SEQ ID NO: 13765 - DNA, 324 bp, Artificial Sequence
  Description of Artificial Sequence: Synthetic coding sequence
taacagatccaggcccttaatatgtcatcttgccccctggattctaaaggtaaggtgtgcagcggccatggagtgtgctctaacgaagccacgtgtatctgtgacttcacatgggcgggaacagactgcagcattagagatcccgttcgcaatcttcatccaccaaaggatgaaggtcctaaggaaatgagccggcgcgaggggagcattttgctatcaaaggctccctcggagagtgcagctctggatggccaccgccttgcactactcgacagcggctacgacatcctggccgctgttctactggaacttttgtccctgtag

SEQ ID NO: 13766 - DNA, 8532 bp, Artificial Sequence
  Description of Artificial Sequence: Synthetic coding sequence
atggccgccgcttcttacgatcagttgctgaaacaggtagaggcattgaagatggaaaattctaacttgcgccaagaactggaggataatagtaaccacctcacaaaattagagaccgaggctagcaacatgaaagaggtgcttaagcaactacagggatccattgaagatgaggctatggcgagtagtgggcagatagatctgctggagcgcctcaaagagttaaacctggactcttccaacttcccaggtgtgaaactccgcagtaaaatgtctttacgctcctatggctccagagaaggatccgtctcatctcggtctggcgagtgcagtcccgtgccaatgggcagcttccccagaagggggttcgtcaacggatctcgggagtcgaccggctacttagaggagttggaaaaggagaggtctttgttgttagcagacctcgacaaagaggagaaggagaaggactggtactatgcgcagctgcaaaacctcaccaagaggatagatagcctgcctctcacagagaatttctcactccagaccgacatgaccagaaggcagttggagtatgaggcccgtcaaatcagagtggctatggaggagcaattagggacctgtcaggacatggagaaacgcgctcagcgtcgtatcgcccggatccaacaaatcgaaaaagacattctgaggatccggcagctgctgcagtctcaagctaccgaagcagagcgttccagccaaaataaacacgagacagggagccacgacgcagagagacagaacgaaggccagggtgtgggggaaattaatatggccacttctgggaacggtcagggatccacgacaagaatggatcatgagacagccagcgtcttatcatcctcctccacccatagcgctccaaggagactcacctcgcatctcgggacaaaagtggaaatggtctacagcctgctgagcatgctgggaacccacgataaggatgacatgagccggaccctcctggcgatgagtagctcacaggactcgtgcatttccatgcgacagtctggctgtctgccactgctgatacagttgctgcatggcaacgacaaggattccgtgctgctgggtaactccagggggtctaaggaagcacgtgcgcgagcctcagcagcccttcataatattattcactcccagccagacgataaacggggacggagggagattcgagtcctgcatctgctcgaacagattagggcttactgcgagacctgctgggagtggcaggaagcccacgaacccggcatggaccaggataaaaatccgatgcctgcaccagtcgaacaccaaatatgtcccgccgtgtgcgtactcatgaagctgagtttcgacgaagaacaccgccacgcaatgaacgaattgggagggctacaagcgatcgcggagttactgcaggttgactgcgagatgtacggtctgaccaacgaccattactcaattacattaagaagatacgccggtatggcgctgaccaacctgacttttggtgacgtcgctaacaaagcaacgttgtgctctatgaaggggtgtatgcgcgcactggtagctcagctgaaatcggaaagtgaagacttacaacaggtgattgctagtgtgctgcgtaatctttcctggcgggcagatgtgaacagcaaaaagactttacgggaggtaggatcggtcaaggcacttatggaatgtgccctcgaggtgaagaaggagtccaccctgaaaagtgtgcttagcgctttgtggaacctgagcgcccattgcaccgaaaacaaggccgatatctgtgctgtggatggggcgcttgctttcctcgtcggcacgctcacttaccgaagccaaactaacaccctggcaattattgaatctggcggggggatactcagaaacgtttcaagtcttattgccaccaatgaagatcaccggcagatcttacgggaaaacaattgcctgcagactttactgcaacatctgaaaagccactcccttactatcgttagtaatgcatgcggaacactttggaacctctccgctcgcaaccccaaggatcaggaggccctgtgggacatgggcgcagtgtctatgttgaaaaatctgatccacagtaagcataagatgatcgccatgggatcagcggccgctctcagaaatctgatggccaatagaccggccaaatacaaggatgcaaacattatgtctcccggctcatctctgccctcgctgcatgtgcgcaagcagaaggccctggaggccgagctcgatgcccagcatctgagtgagacctttgataacatcgacaacctctcacccaaggccagtcacaggagtaagcagaggcacaagcagtctctgtacggggattatgtgtttgatactaatcggcatgatgacaaccgctcagacaattttaacaccggaaatatgactgtgttatcgccttacctcaacaccacagtgctccctagcagttccagtagccgcggatctctggacagctcccggagcgagaaggaccgttcattggaacgagagcgagggattggcttgggcaattatcacccagcaacagagaatcctgggacctccagtaaaaggggccttcagatcagtaccacagcagctcagatcgcaaaagtgatggaggaggtgagtgctatccacaccagccaagaagaccgcagctcagggagtaccactgagttgcattgcgtgactgacgaacgaaatgcactgcggcgcagctcggctgcgcacactcattccaatacgtacaactttactaagtccgaaaactcaaacaggacatgctccatgccatacgcaaagctagagtataagcgatccagcaacgatagcctgaactccgttagttccagcgatggctacgggaaacggggccagatgaagccatccatagaaagttattctgaggatgatgagtccaagttctgttcttatggccaatacccggcggaccttgctcataaaattcatagcgctaaccacatggatgataacgacggcgaattggatacccccatcaattattctttgaagtactctgatgaacagctcaactccggccggcagagccccagtcagaacgaacgttgggcaagacccaagcatatcattgaggatgaaatcaaacagtctgaacagagacaatccaggaatcagtctacaacttatcccgtctacacagagagtacagatgacaagcacctcaagtttcagcctcactttggtcagcaggaatgcgtgtctccctacagaagtagaggggctaacggaagcgaaacgaaccgcgtaggttcaaaccatggaattaatcagaatgtgagtcagtcactctgccaagaagatgactatgaggacgacaagcccacgaactactctgagagatacagcgaggaagagcagcatgaagaagaggagcgaccaacgaactatagcattaaatacaatgaggaaaagcgtcatgtggatcagccgattgattacagcctcaaatacgctaccgacattccctcttcccagaagcagtcattcagtttttctaaaagtagctctgggcagtcctctaaaacagaacacatgtcctcttcttcagagaacacatcaaccccaagctctaacgccaaacgccaaaatcagctgcatccatcgagtgcccagtccaggagcggacaaccccaaaaggcagcaacatgtaaagtttcaagtatcaaccaggagactatccagacttactgtgtggaagacacaccgatttgtttctcaagatgtagttctctgtcatcactttcaagcgctgaggatgagattggatgtaaccagacaacgcaagaggcagactcagctaatacacttcaaattgccgagattaaagaaaagattgggacccgctccgctgaagaccctgtaagcgaggtgcctgcagtgagccagcaccctcggactaagtccagcagactgcagggcagttccctgtcaagcgaaagcgcacgacacaaagcggtggagttttcgagcggcgccaaaagtcctagcaagtcgggtgcccagacgcccaagtcaccaccagaacactatgtccaggagacacctctgatgttctctcgttgcacatccgtgagttctttggatagcttcgagtctcggagcatcgcgtcatccgtgcaaagcgagccctgctccggtatggtctcgggtatcatcagcccctcagatctgccagattcaccaggccagaccatgcctcccagccgctcgaaaacccctcccccaccgcctcagaccgcccagactaagagggaagtccctaagaataaggccccaactgcggaaaagagggagtctggccccaagcaggcggcggttaacgctgccgtccagcgggtgcaggtcctcccggatgccgatacactgcttcactttgccactgaatccacccccgacgggtttagctgtagctcttcactatcagccctctcactcgatgaacctttcattcagaaggacgtggaattacgaattatgcctcctgtacaagagaacgacaacggtaacgagacagaatcggagcagcctaaggagagtaacgagaatcaggagaaggaggcagagaagaccattgactcagaaaaggacctactggacgacagcgacgacgacgacatcgagatcctggaggagtgtatcatcagtgctatgccgactaaaagcagcaggaaggcaaagaagcctgctcaaacagcctcaaagctgcctccccccgtggcccgaaaacccagccagctgcccgtgtacaaactcctcccttcccagaacagattacagccacagaaacacgtgtcttttaccccaggcgatgacatgccacgagtatattgtgtggaaggtacaccaattaactttagtactgctacctccctaagcgatctgactatcgagtcgccacctaacgaattggcagcaggggaaggggtgaggggtggcgctcagtcgggagagttcgagaagcgggacactatcccgaccgagggacggagcaccgacgaggctcagggcggcaaaacttccagcgtcacaattccagagctagacgataacaaagctgaagagggagacatcttagcagaatgtattaattccgccatgccgaagggaaagagccataagccctttcgggtgaagaaaatcatggaccaggtccaacaggcttctgcgtcaagtagcgctccaaataagaatcagctggatgggaaaaaaaagaagcccacttctcctgtcaaacccatccctcaaaatactgagtatcggacccgagtacgaaagaacgcagacagtaagaataatctaaacgccgagagagtcttcagcgacaataaagacagcaagaaacagaatctcaagaacaattccaaagtctttaacgacaaactgcccaacaacgaagatcgcgtacggggcagttttgcctttgattctccgcaccactacacccctattgagggcaccccctattgcttttcacgtaacgacagcctaagctctctagacttcgatgatgatgatgtcgacctgtcccgggaaaaagcagagctgcggaaagcaaaggaaaataaggaatcagaagcgaaggtcaccagccacactgagctcacatcgaatcagcagagcgccaataagacacaggccatcgccaagcagcccataaatcgaggccaaccaaagccgatcctacagaagcaaagcaccttccctcagagtagcaaggacatacccgaccggggggccgctactgatgagaagctgcagaatttcgcaatagagaatactcccgtctgcttctcccacaattcatctttgtcttcgctgtccgatatcgaccaggaaaacaacaacaaagagaacgaaccaataaaagagactgagcccccagacagccagggagaaccaagtaagcctcaggcatctggatatgcacccaaatctttccacgtggaggatacgccagtgtgtttttctcgaaattctagcctttcatccctgtcgatcgattctgaggacgatcttctccaggaatgtatcagttcggccatgcccaagaagaaaaaaccctctcgcctgaaaggcgacaatgaaaagcattcccctaggaacatgggtgggattctgggcgaggacttgaccctggacctgaaggatatccagcgaccagacagcgaacacggcctctctccagactccgaaaattttgattggaaggcaatccaggagggggcaaactccatagtgagtagtctgcaccaggcagctgccgctgcgtgcttgagtcggcaggcttccagtgattccgactctatcctgtccttgaaaagtggtatcagcttaggaagtcccttccacttgactcctgaccaggaagagaaacctttcactagcaataagggccctcgcatcctgaagcctggcgaaaagtcaacccttgagactaaaaagatcgaaagtgaatctaaaggaatcaagggagggaaaaaggtctataagagcctcatcacaggcaaagtgcgtagcaacagtgagattagcggccagatgaaacaaccactccaggcgaacatgccgtctatttcccgaggccgcactatgatacacatcccaggagtgaggaactccagcagtagtaccagccctgtcagcaaaaagggcccccccttaaaaacaccagcctctaaaagtcctagtgaggggcaaacggctaccacctcccctagaggggccaagccaagcgttaaatcagaattgagtccagtagctcgccagacgagccagataggcggctcgagcaaagcccctagccgctctgggagccgtgattcgacccctagcagacccgcacagcagcccttgagtagaccgattcagagtccggggagaaactccatctcacctggaaggaatggaatctcacctcctaacaagctatcacagctgcctagaacctctagcccaagtaccgcgagtaccaagtcttcgggatctggaaagatgtcctatacctcacctggcaggcagatgtcacagcagaacctcaccaaacagaccggactgtccaagaatgccagctctattcctagaagtgaatcggccagtaaggggctaaatcaaatgaacaatggcaacggagccaataaaaaagtcgagttaagtagaatgtcatcaactaagagcagcggatcagagagtgaccgaagcgaacgacctgtcctagttagacagtccactttcataaaggaagccccaagtcctacattgcggaggaagctggaggagtcagccagttttgaatctctctcgccctcatccaggcctgcttcccccacaaggagccaagcacagacccctgtgcttagcccaagcctgccagatatgtccctgtcaacacatagtagcgtccaagctggcggctggcgaaagctgccccctaatctgtctcccactattgagtacaatgatgggcggccggctaagcgtcatgatatcgcgagatcccattcagagtcacccagcaggctcccaattaatcgatccggaacatggaagagggaacatagtaaacactcaagcagcctcccacgcgtgtccacgtggcgaagaaccggttccagtagttcaattctgtcagcttcctctgagtcttccgaaaaggccaagagcgaggacgagaaacacgttaatagcatatctggaacgaagcagagtaaggagaatcaagtctccgccaaagggacatggcggaaaattaaggaaaacgaattctcccccaccaactctactagccagaccgttagctcaggggccactaatggggctgagagtaagactctgatttatcagatggctcccgctgtatctaaaacagaggacgtgtgggtgagaatagaagactgtcctatcaacaatccacggtccggccgctcaccgacagggaacacaccccccgtcatcgactctgtgtctgagaaggcgaatcccaatatcaaagattctaaagacaatcaggccaagcagaacgtcggaaatggaagtgtgccaatgaggacagtgggtctggagaaccgactcaactcattcatacaggtggatgcgcccgaccaaaaagggacagagatcaagccaggacaaaacaaccccgtgccagtcagcgaaacgaacgagtccagtattgtagagcggacgccattctcttctagttctagctccaaacactcctcgcccagcggaacagtcgctgcacgtgtgacccctttcaactataacccatccccccgcaaatctagtgctgattccacaagcgcccgcccgtctcagatcccaaccccggtgaataataatactaagaagagggattctaaaacagactcaactgagagtagcggaactcagtcccccaagaggcattctggcagttacctggtcacatctgtctag

SEQ ID NO: 13767 - DNA, 8532 bp, Artificial Sequence
  Description of Artificial Sequence: Synthetic coding sequence
atggcagcggcatcctacgatcagctgttaaaacaggtggaggcactcaagatggagaactccaacctccgtcaggaactcgaggataactccaaccaccttaccaagttggagactgaggccagcaatatgaaggaggtccttaagcaactacagggaagtatcgaggatgaagctatggccagcagtggacagatcgatctcttggaaagacttaaagagctgaatctcgattcaagtaatttcccaggcgttaagctgaggtctaagatgagtttgaggagctacggctctagagaggggtcagtgagtagtcgctctggcgagtgtagccccgtgccaatggggagtttcccccgacgaggcttcgtgaatggaagccgggagagcacgggatatctggaagagctcgagaaggaaagatccctcctgctggctgatctggacaaggaggaaaaggaaaaggactggtactacgcccagctgcagaaccttaccaagagaattgattccctgcccctcaccgaaaacttcagtctgcagaccgacatgacacgcaggcagctcgagtatgaggcgcggcagattagagtcgcaatggaagaacagctcggcacttgccaggacatggaaaagcgggcgcagcgccgcattgcccgaattcagcagatcgaaaaagacatactgcgcatccgacagctgcttcagtctcaggccaccgaggctgagaggagcagtcagaacaaacacgaaacggggagtcatgatgcagagcgtcaaaatgaaggtcagggcgtaggggaaattaacatggcgacttccggaaacggccaaggcagcacaacacgcatggatcacgagaccgccagtgtgttgtcaagctctagtacacacagcgctcctaggcgcctaacttctcacctcggaaccaaagtggagatggtgtactccctactgagtatgctcggaactcatgacaaagacgatatgagccggaccttgcttgccatgagtagctctcaggatagttgtatttctatgcggcagtcagggtgcctgccactgctgatacagctactccacggtaatgataaggattcagtgctcttagggaactcgaggggatcgaaagaggccagggcacgagcatcggcggcgctgcataacattatccactcccagcctgacgataaacgtgggaggcgcgagataagggtgctgcacttgctggaacagatccgggcatactgtgagacctgctgggaatggcaggaagcacacgaacccggaatggatcaggacaaaaatccaatgccggcgccagtggagcatcaaatatgcccagccgtctgcgtgctgatgaaacttagctttgacgaagaacacaggcatgcaatgaacgagctaggcggccttcaggcgattgcagaactcctgcaggtggattgtgagatgtatgggttgactaacgaccactactcaattacgctgcggaggtatgcaggaatggccctgactaaccttaccttcggggacgtagccaacaaggccacactttgcagtatgaagggttgcatgagagctctcgtggcccaattgaagtccgagtcagaggatctgcagcaggtgattgcttcagtgcttcggaacctctcttggcgcgcggatgtcaactccaaaaagacattacgtgaagttggatcagtgaaggccctcatggaatgtgcacttgaggtcaaaaaggaatcgactcttaaaagtgtgttgtctgccctgtggaacctatcagcccattgcacagagaacaaagccgacatctgtgcggttgacggggccttggccttcttggtgggcaccttgacctacagatcgcagacgaacaccctcgccattattgagtccgggggtgggattctgaggaacgtaagttcactgattgccactaacgaagaccatagacagatattgcgggagaacaactgcctccagaccctcctccagcatctaaaatcccacagcctgaccattgtgtctaatgcctgcggcaccttgtggaaccttagcgctagaaatcccaaagaccaggaggccctatgggatatgggggcagttagtatgctgaaaaatcttattcatagcaaacataagatgatcgccatgggctctgcggcggctctccgtaatctgatggcaaataggccagcaaagtacaaggacgccaacatcatgagccctggcagctcgcttcccagcctgcacgtgagaaaacagaaggctctggaagccgaactggacgcccagcatctttctgaaaccttcgataacatcgataacttgtcccctaaagcctcccatcggagtaagcagaggcacaaacaaagcctgtacggcgattacgtttttgatactaatcgccatgacgacaatcggtctgacaactttaacacaggcaacatgacagtgctttcaccatacttaaacacgactgtgctgccaagcagttcttcttcccgtggctctctagacagctcccgttcagaaaaagaccgctcactagagcgcgagagagggatcggactggggaactaccatccagccactgaaaatcccggaacctccagcaaacgggggcttcagatctctacaactgccgctcagattgctaaggtcatggaggaagtttccgcgatacataccagccaagaggacaggagtagcggcagtaccactgagcttcactgcgttaccgatgagcgaaatgctttgagacgctcttccgccgcccacacacattcaaatacctacaacttcactaagagcgaaaatagcaatcgaacatgcagtatgccgtatgcaaaactcgaatacaaaaggtcctccaacgacagccttaactctgtttcctcctctgatggatatggcaagcggggccagatgaaaccaagtatcgagtcctatagcgaggacgacgagtccaagttttgctcttatggccagtatcccgcggacttggctcataaaatccactccgccaaccatatggacgataatgatggtgaactcgacacccccatcaactactctctcaagtactccgacgagcagttgaactccggccgccagagtccttcgcagaacgagcgttgggctaggcctaaacacatcatcgaggacgaaatcaagcagagtgaacaaagacagagcagaaatcaaagcaccacttatcccgtgtataccgaatcaaccgatgacaaacacctaaaattccagccacatttcggtcagcaggaatgcgtttccccttatcgttcccgaggcgcaaacgggtccgaaacgaatcgagtcggtagtaatcatgggattaaccaaaatgtcagccaaagcctgtgtcaggaggatgactacgaggacgataagccgactaattactctgaacggtacagtgaggaggagcagcacgaggaggaagaaagacctaccaattacagcataaaatataatgaggaaaagagacacgtggatcagcccattgattacagtctgaagtacgctaccgacatcccgagttctcagaagcagtccttttcgttcagcaagagttcctctggccagtcatcaaagactgagcatatgtcttcctccagtgaaaacactagcacaccctcctcaaacgccaagcgccagaaccagcttcatccttcctctgcccagagcaggtcaggccagccccagaaggctgcgacttgtaaggtctcttcaatcaatcaagaaactatccagacttactgtgtcgaagacactcccatttgtttctcaagatgcagctccttatccagccttagttcggccgaggacgagattggttgcaaccagaccactcaggaagctgacagcgccaatactctgcagatcgcggagataaaggagaagattggcacacgcagcgccgaagatcctgtgagtgaggtaccggctgtgtctcagcacccacggacgaaaagcagcaggctgcagggcagcagcctctcatccgagagtgcccgccataaagccgtagagttctcctctggggctaagtccccctcgaaaagcggggcacagacaccaaagtcccctcctgaacactacgtgcaggagactccgcttatgttttcacggtgtacaagtgtttcgtcgctcgacagctttgagagccgtagcatagccagcagtgtacagagtgaaccgtgctctggcatggtgagcggcattatttcccctagtgacttgccagacagccccggtcaaacgatgcccccctcaagaagtaagacaccccctccaccaccccagactgctcagaccaaacgtgaggtccctaaaaacaaagcccctactgctgaaaaacgggagagtgggcccaagcaggcggccgtgaacgctgcagtccagagagttcaagtgcttccagatgcggacactctgcttcattttgctacagagtccacgccagatggattctcttgcagcagctcactgagtgcattgtccctggatgagcccttcatccagaaggatgtcgagttgcgcattatgcctcctgtccaggagaacgataatggcaatgagacagagagcgaacagcctaaggagtccaatgaaaaccaagagaaggaagccgaaaagacaatcgacagcgaaaaagatctgttggacgatagcgatgatgatgacatagagatcctcgaagaatgcattatatcagcaatgcccaccaagtctagcagaaaggccaagaagcccgctcagaccgcatctaaactgcccccacctgttgccaggaagccaagtcagctacccgtttacaagttactgcctagtcagaacaggctgcaaccccaaaaacacgtgagcttcacccccggcgacgacatgccgcgcgtctactgcgtggagggaacacccatcaatttttccactgcaacatcattatcggatctcacaatcgaaagtcctcccaacgaactggccgccggagagggggtaaggggcggcgctcagtcaggagagtttgagaagagggacacaatacccactgaggggaggagtacagatgaagcccagggaggtaagacgagctcagtgactattcccgagctggacgataataaggccgaagaaggcgacatcctggctgagtgcattaactctgcaatgcccaaagggaagtcccataaaccatttcgcgtcaagaagatcatggatcaggttcagcaagcttccgcttcgagctctgctccgaacaagaatcagctggatggtaagaaaaagaagcctacctctcctgtcaaaccaatcccccagaacacagagtaccggacccgggtgcggaagaatgccgatagtaagaacaacctaaatgctgagagggtgttcagcgataacaaggattctaagaagcagaacctgaagaacaattctaaagtttttaatgataaattgcctaataacgaggatcgggtgagaggcagttttgctttcgatagtccccaccattatacgccaattgaaggtaccccctactgcttctccagaaacgattctctttcatctctagacttcgatgatgacgacgtggacctgtcccgagaaaaagccgagctccggaaggccaaagaaaacaaggagagtgaggctaaagtgacaagtcacaccgaactcacatccaaccaacagagcgccaacaagacacaggcaattgccaaacagcccattaaccggggccagccaaagcctatcctacagaaacagtctacgttccctcagagctcgaaggatattcccgataggggagccgcaactgacgagaagttgcagaacttcgctattgagaacacacccgtttgtttcagtcacaattcatccctttcttctttgagtgacatcgaccaggaaaacaacaataaagagaatgaacctatcaaagagacggagcctccggacagccagggcgaaccctcgaaaccgcaagccagcggatatgcacctaagtcatttcatgtcgaagacacaccagtttgctttagccgtaacagtagtctatccagcctgagcattgattccgaggacgacctcctccaggagtgcattagttccgctatgcctaaaaaaaaaaagccgtcccggctcaagggagacaacgagaagcacagccctaggaacatggggggtatattaggagaggaccttacgttagatctcaaagacatccagcgccccgactctgaacacggactcagccctgattccgagaacttcgactggaaagcaatccaggaaggcgccaattccatcgttagtagcttacatcaggctgctgcagctgcctgtctgtcacgccaggccagttcagactcagacagcattctgtccctcaaatcgggcatttcattaggaagccccttccatctgacccctgatcaggaagagaagccttttacctctaacaaaggaccacgaattcttaagccgggtgagaaaagcaccctggaaaccaagaaaatcgagtctgagagtaagggtattaaaggcgggaaaaaagtatataagagccttatcacaggaaaggttcgtagtaactccgagatctccggccaaatgaaacagcctctccaggcgaacatgcccagcatttcacgaggccgcacaatgattcacattcctggcgtgcgcaacagcagctctagtactagcccggtgagcaaaaaaggaccgccactaaaaacccctgcctccaaaagtccttctgagggccagacagccaccacgagtcccaggggagccaaaccatcggtcaaaagcgagttatctccagtggcgaggcagacctctcagatcggtggaagctctaaggctccctcaaggtccggcagcagagacagcaccccgagccggcccgcccagcagcctttaagccggccaattcagtctccaggaaggaattcaatctcaccagggcggaacgggatctcaccccctaataagctgtcccagctcccacgaacctcctctccatccacggccagcactaagtcatctgggagtggaaaaatgtcttatacttcacctggccgacagatgtcacaacagaatctgaccaaacagactgggctgtcgaagaacgcaagttctatcccgcgctcagaaagcgcaagcaagggcttgaaccagatgaataacgggaacggagcaaataagaaagtggaactatcccgaatgtcatcgaccaagtccagtgggagtgagagcgaccgcagcgagcgacccgtgttggtccgccagagtacttttatcaaagaggccccgtctccgacactgaggcgcaagcttgaggagagtgcctccttcgagtccctgagtccgtcaagcaggcccgcctctcccacacgcagccaagcccagacgccagtgctgtcccctagcctcccggatatgtcccttagtacccacagctccgtccaggctggtggatggaggaaactgcctcccaacctgtcccccaccattgaatataacgatggtcgccccgcaaaaagacatgacatagcccgatcacattccgaaagtcccagccgtctccctatcaatcggtccggaacgtggaaacgcgagcactctaaacactcttcttctctgcctagagtctccacctggcgccgcaccggttccagctctagcatcctatccgcatctagtgaatcctctgaaaaagcaaagagtgaagacgagaaacacgttaatagcattagcggaactaagcagtccaaggagaatcaagtgtccgctaagggaacttggagaaaaattaaggaaaacgaattctctcctactaactcgacatcacagaccgtgagctcgggagccaccaatggggcagaatccaaaacccttatttaccagatggcacccgccgtatctaagacagaagacgtgtgggtgaggattgaggactgccccattaacaatccaagatctggacggtctcctacgggaaatactccccctgtgattgattcggtttctgagaaggcaaatcctaacatcaaagattcgaaggataaccaggcgaagcagaacgtcggcaacggctccgttccaatgcggacagttggactagaaaataggctcaactccttcatccaggtcgacgctccggaccagaagggaacggaaataaagcccggtcaaaacaatcccgtgcctgtgagcgaaaccaacgagtcgagcattgtggaaagaacgccattcagctccagttcctcttcaaagcactcctccccaagtggaaccgtggctgcacgagtgacgccctttaactacaatcccagccctcgtaagagctcggcagactcaactagcgcgcgcccatctcaaattccgacacctgtaaacaacaatactaaaaagcgggattcaaaaacagattccaccgagagttctgggacccaaagtcccaagcgccacagcggtagttacctggtgactagcgtgtag

SEQ ID NO: 13768 - DNA, 8532 bp, Artificial Sequence
  Description of Artificial Sequence: Synthetic coding sequence
atggctgcggcctcttatgatcagttgctgaaacaggtcgaagcactgaaaatggagaactcaaaccttcggcaggaactcgaggacaatagtaatcacttaacaaaacttgaaaccgaggcctctaacatgaaggaggttctgaagcagctacaggggagtatcgaagacgaggccatggcaagcagtggccagattgatctcctggaacggcttaaagaattaaatctcgattcgtccaattttcctggggttaaactgagatccaagatgagccttaggtcctacggaagcagggagggatccgtaagctcccgaagcggcgagtgttcccccgtgccgatgggatcctttccaagacgcggctttgtcaatggatcccgtgaaagcactggatatctggaagaattggaaaaggaacgcagccttctgctagctgatttagacaaggaggagaaagagaaagactggtactacgctcagctgcaaaatctgactaaaagaatcgacagcctgcctctgacagagaacttttctttgcagacagatatgacaaggcggcagctggagtacgaggcccgacagattcgggtggccatggaggagcagttagggacatgtcaagacatggaaaagcgggcccagaggcgaattgcacggattcaacagatagagaaggatattcttcgcattcgccagctgctccaatcccaagctaccgaagccgaaaggtcttctcaaaataaacacgaaacggggtctcatgatgccgaaaggcaaaacgaaggccagggtgtgggggaaatcaatatggcgactagcgggaacggccagggttcaactactcgcatggatcacgaaacggcaagcgtgttgtctagttccagcacacactctgccccgcggagactgacctctcacttgggcaccaaagtggagatggtttattcattgctctccatgctggggacccacgataaggatgatatgtcccgaactctcctcgccatgtcctcatctcaagattcgtgcatttccatgcgccagagtggttgcctcccactgctgattcaactgctgcacggaaatgacaaagacagtgttctgctggggaattcaagagggtccaaagaggcccgggcccgggccagcgcagctctacacaatatcattcacagccagcctgacgacaaaagaggcagaagggaaattagggtcctgcacctcctcgagcagattcgcgcttattgcgagacctgctgggagtggcaggaggcacacgaacccggtatggaccaagataagaatcccatgcctgctccagtggagcatcagatctgccccgcggtgtgtgtgcttatgaaactgtctttcgacgaagagcacagacatgccatgaatgagctggggggccttcaggccatcgctgagcttctgcaggtggattgcgaaatgtacggcttgaccaacgaccactacagcattacactacggcggtatgccgggatggcccttacaaatctcacctttggcgacgttgccaataaagccacactgtgcagtatgaaaggttgtatgcgcgcacttgtggcccagctgaaatctgagagcgaggacttacagcaggtcattgcgagtgtgctgcgcaacctgtcgtggagagccgacgtaaacagtaaaaagaccttgagagaagtaggttccgttaaagcacttatggaatgtgccctcgaggtaaaaaaggaatccacattgaaatcggtgctgtctgccctttggaacctgagtgcacattgtaccgagaacaaggctgatatctgcgccgtagacggagcactggcctttctggtgggcacattgacataccgtagccagacgaacacactcgccataatagaatcaggaggcggcatcctgagaaacgtatctagcctgattgccactaatgaagatcatcgacaaatccttcgcgaaaataattgccttcagacactgttgcaacacttgaagtcacacagtttaacaatcgttagtaatgcgtgtggcaccttgtggaatctgtcagcccggaatccaaaggatcaggaggctctgtgggatatgggggctgtgagtatgctgaagaatctgatccactccaagcataagatgattgccatgggatcagccgcagccctccggaacctgatggccaatagacccgctaaatacaaagacgccaacatcatgagcccgggcagttcccttccaagtctccacgtcagaaagcagaaagccttggaagccgagctggacgcgcaacacttaagtgagacctttgacaatattgacaatctgagccctaaagcgagtcatcgaagcaaacagcgccacaagcagagtttgtacggggactatgtgtttgatacaaacaggcacgacgataaccgttcagataattttaatactggcaatatgaccgtcctgtccccgtacctgaacacaaccgtgctgcccagcagctcctcttcgagaggcagtctggatagctctagaagtgagaaagatcgcagtctggagagggaaagaggcatcgggctgggaaattaccatcctgccacagaaaatccgggcacttcttctaaacggggcctgcagatatccaccaccgcggcccagatcgccaaagtaatggaggaggtgtccgccatccataccagccaggaggatagatcctctggttctaccaccgaacttcactgcgttactgacgaacggaacgcactgcgtaggagctcagctgctcacactcacagtaatacgtataattttactaagtccgaaaacagtaaccgcacatgtagtatgccttacgcgaagctggagtacaagcgcagtagcaacgactctctgaattcagtttccagcagcgatggctatgggaaaagagggcagatgaaaccctccatcgaatcgtactccgaggatgacgaatccaagttttgctcatacgggcagtacccagccgatctggcgcataaaatccacagcgcaaatcacatggatgacaatgatggggaactagacacccccatcaattacagcctgaagtactccgacgagcagctaaatagcggccgccagagtcctagccagaatgagcggtgggcacgccctaaacacatcattgaagatgagattaagcaatccgaacagaggcaatctcggaaccagagtacaacataccctgtctacactgagtcaaccgatgataaacatttaaaattccaaccccactttggccagcaggagtgcgtgtctccctaccgctcccgcggggctaatggctcagaaaccaaccgagtaggatctaaccacggcatcaatcaaaatgtgagtcagagtctgtgccaggaggatgactacgaagatgacaaaccaacaaactactctgaaagatactccgaagaagagcagcatgaggaagaggaaagacccaccaactattccatcaagtataacgaagaaaagcgtcacgttgaccagcccatagattactctctgaagtacgcgactgatataccttcttcccaaaagcagagctttagtttctctaaatcctcctcaggacaaagtagtaaaaccgaacacatgagttcctcttctgagaatacctctactccctcctcgaacgcaaaaagacagaaccagttacacccttcgtccgcacagagccgcagtggacagccacagaaggctgctacatgcaaggtcagtagtataaaccaagaaacgatccagacatactgtgttgaggacacccctatctgtttctctcggtgttctagtttgtcctccctgtcgtccgcagaggacgaaatcggatgcaatcagacgacacaggaagccgattctgcgaacacactgcagattgcggaaatcaaagagaagatagggactaggtccgcagaagatcccgtgtcagaggtgcctgcagtatcacagcacccgcggacaaaatcatcccgcttacaaggcagttctctctcctcagaatctgcgaggcataaggccgttgagttttccagcggcgccaagtctccttccaagtccggagcccagacgcccaaaagccctcctgagcactacgtgcaagaaacccctctaatgtttagtaggtgtacatctgtgtccagtttggatagctttgaatcccgatctatcgcttcttcggtgcagtccgagccttgtagcggcatggtgtccggcatcatttccccatccgacctgcccgatagccctgggcaaaccatgcctccaagtagatctaagactcctccaccaccacctcaaacagctcagactaaacgagaagtacccaagaataaggcccctacagcagaaaagcgcgagagcggccccaagcaagcagccgtgaatgcagccgtgcagagggtgcaagttctgccagatgccgatactctccttcattttgccacagagtcaactcccgacggctttagctgcagttctagcctctccgcattgagtcttgatgaaccttttatccaaaaggatgtggagcttagaattatgccacccgtgcaggagaacgacaatggcaacgagactgaaagtgagcaacccaaagagagcaatgagaaccaggagaaggaggctgaaaagacaatcgacagcgaaaaggacctcctggatgactcggatgatgatgacatagagattctcgaagagtgcataatttccgccatgcccaccaagtcttctcggaaggctaagaagccggcccagacagcctcgaaattgcccccacccgtggcccggaagccaagtcaacttcctgtatataagttgctgccctcccagaatcggctgcaacctcagaagcacgtgagttttacacctggcgatgacatgccccgagtctactgtgtggagggaacccccatcaatttctcaacggccacaagcttaagcgacctcactattgagagtcccccaaacgaacttgctgctggcgagggcgtgagggggggagcccagagcggggagttcgaaaagagagatacaatcccaacggaaggccgatcaactgacgaggcacaggggggtaagaccagttctgttactattccagagctagacgacaataaagcagaagagggcgatatcctagctgagtgcattaacagcgcaatgcctaaagggaaatcccataaacctttccgggtcaagaaaataatggaccaggtgcagcaggcaagtgctagttctagcgcccccaacaagaaccagctcgacggaaagaaaaagaaacctactagccctgtgaaaccaatccctcaaaataccgaataccgcacacgtgttcggaagaacgctgactccaaaaataatctgaacgcagaaagggtgtttagcgataataaagattctaagaaacagaacctgaagaataattccaaggttttcaacgacaagttacctaataacgaggacagagtacgagggagttttgcgtttgatagtccgcatcattacactccaatcgagggcacgccatactgtttcagccgcaacgacagtctctcctcactggacttcgatgatgatgacgtggacctgtctcgggagaaggctgaactgcggaaggcaaaagagaataaggagagcgaagcaaaggtcacctctcacaccgagctgacttcgaaccagcagtccgccaataagacccaggcaattgctaaacaacccatcaacagaggtcaacctaaacccattctgcagaagcagtccacattccctcagagctcgaaggacatacccgacagaggtgcggcaacagacgaaaaactccaaaatttcgccattgagaatactccggtctgcttctcccacaactctagcctttctagcttgtcagatattgaccaggaaaacaataacaaggaaaatgagccaatcaaagagacagagcccccagattcccagggggaaccttcaaagccccaggccagcggctatgcacctaaatccttccatgtcgaggataccccagtatgcttctctagaaactcttcgctgtcatctctgagtattgatagcgaggatgatctcctgcaggagtgtatatctagtgccatgccgaagaagaagaagccctctcgcctgaaaggcgacaatgaaaagcattcaccaagaaatatgggcggcatccttggggaagatctgactttggacctcaaagacattcaaaggcctgactccgagcatggcttgagccctgatagtgagaactttgactggaaggccatccaggagggtgccaatagcattgtttcaagcctgcaccaagccgcggctgctgcctgcctgagccgtcaagctagtagcgactccgactcgattttgtccctcaaatccggcatttcactgggtagccctttccaccttactcccgatcaggaagagaaaccattcacgtccaacaaaggtcctagaatcctaaagcccggggaaaagagcacactggagaccaaaaagattgaaagtgaaagtaagggaatcaagggtggaaagaaagtgtacaaatccctcatcacgggcaaggtccgatctaattcagagatttcggggcaaatgaagcagccgctccaagccaacatgccgagcattagccgcggcaggactatgattcacatacccggcgtaagaaattcgagcagtagtactagccccgtgagcaagaagggaccccccctgaaaacccctgcttcaaagagcccatccgaaggtcaaactgctacgaccagccctcgaggtgctaaacccagcgtgaaaagtgaactaagcccggttgcccgacagacaagccagatcggcgggagcagcaaggccccatcccgctccggctctagggactccacaccctcccgtccagctcagcaacctctctctagacctattcagagtccgggacgaaacagtatctcccctgggaggaatggcatttcgccacctaataaattgagtcaactgcctcgcacgtccagccccagtacagcatctacaaaatctagtggatccggtaagatgagctatacatctcctgggaggcaaatgtcacaacagaatctgaccaagcagaccggcttgagtaaaaatgcctcttctatcccgagaagcgagagcgcctcaaagggtctcaatcagatgaacaacggcaacggagcaaataaaaaggtggagttaagcagaatgagcagcacaaagagcagtggctcagagagcgacaggagcgagcggcctgtcttggtgaggcagagcaccttcatcaaagaagcccccagcccaaccctccgtcgaaagctcgaggaaagtgcctcttttgaaagcctctctccgagctcacggccagcctcacctactagatcccaggcccagacccctgtgctgagtccatccctgccggacatgagcctcagcactcacagcagtgtccaggcaggtgggtggcggaagttgccaccaaacctgtcccccaccattgagtataacgacggccggccagctaaacgtcatgatatcgcaagaagccattctgagagtccatctaggctccccatcaaccgtagtggtacctggaagcgcgagcatagtaagcactccagttccctgcctagggtaagcacctggcggcgcaccggctctagctcttccatcctgagcgctagttctgagagcagcgagaaggccaagagtgaagacgagaagcacgtgaattccattagcggaaccaaacagagcaaggagaaccaagtcagtgcaaagggaacttggcggaagatcaaggagaacgaattttctccaacaaacagtaccagtcagactgtctcaagcggtgcaacaaatggggccgagtccaaaaccttgatttaccaaatggctcccgccgtgagcaaaacagaagacgtgtgggttcgtatcgaggattgtcctataaacaaccctagatcgggccgctcacctaccggtaatacgcctcccgttattgatagtgtatctgaaaaagcaaaccctaatatcaaggatagcaaagacaatcaggcaaaacagaatgtgggcaatggttccgtccctatgcgcaccgttgggttggaaaaccgcctgaactcttttatccaggttgacgcccccgatcagaaaggcaccgagataaaaccagggcagaacaacccggtcccagtttctgagacaaacgagagcagcatcgtggagaggaccccattttccagcagttctagcagcaagcattcatccccttctggtacagtggccgcgagagtcactccttttaattacaatcccagccctagaaagtccagtgccgatagcacaagcgctcggcccagccagatcccaaccccagtgaataataataccaaaaagagagattccaagaccgattccacagagtcctctggcacgcagtctccaaagaggcactctggtagttatctggtaaccagtgtgtag

SEQ ID NO: 13769 - DNA, 864 bp, Artificial Sequence
  Description of Artificial Sequence: Synthetic coding sequence
atggccgcagcctcctacgaccagttgctcaaacaggtggaggctcttaagatggagaactcgaatctcagacaagagctcgaagataattccaaccacctgacgaagctggagactgaagcctcgaatatgaaagaggtgctgaaacagctccaaggcagcattgaggacgaagccatggcaagcagcggccagatcgacctgctggaaaggctgaaagaactgaaccttgacagttctaatttcccaggggtcaagctgcgatctaagatgtctttgcgtagttatgggtccagagaaggcagcgtgtcaagtcgcagtggcgagtgctcaccagttcctatgggctcttttccacgcagaggctttgtcaacggatccagggagagcacgggatatctggaggagttggaaaaggaacgctccctgcttctggccgatctcgacaaagaagaaaaggaaaaagactggtactacgctcagctacagaatctgactaagaggatcgactcacttcctcttaccgagaatttcagccttcagactgatatgacacgccgacaactggaatacgaggctcgccagattcgagtcgccatggaggagcaactgggcacctgtcaagacatggaaaagagagcgcagaggaggattgcgagaatccagcagatcgaaaaagatatactgagaattagacagctgttgcagtcccaagccactgaggccgaacgatccagtcagaacaaacatgagaccggttcacacgatgccgaacgccagaacgagggacaaggcgtgggggaaattaatatggcgactagcggaaatggacagatcgaaaaaatgcgaatgtttgaatgctag

SEQ ID NO: 13770 - DNA, 357 bp, Artificial Sequence
  Description of Artificial Sequence: Synthetic coding sequence
atggctgctgctagttacgaccaactgttaaagcaagtggaagccctcaaaatggagaactctaatctgaggcaagagctggaggataacagcaaccaccttactaagctggagacagaagcttctaatatgaaggaggtgctgaaacaattacaaggatctatagaagacgaagctatggctagtagtggacagatagatctgctcgagaggctgaaggaacttaatctggactccagcaacttccccggcgtgaaattgagatccaagatgagcttaaggtcctacggttcaagggaaggctctgtgagcagcaggagcggtgagtgttctccggtcccaatgggatccttttag

SEQ ID NO: 13771 - DNA, 3918 bp, Artificial Sequence
  Description of Artificial Sequence: Synthetic coding sequence
atggcggccgcctcctacgaccagctgctcaaacaggtagaggctctgaaaatggaaaactctaacctgagacaggagctcgaagacaactccaaccaccttaccaagctggagaccgaggcctccaacatgaaagaagtactgaagcagctccagggtagtattgaggacgaggccatggcctcttcaggacagatagatttgctggaaagactcaaagagttgaacctcgactcatctaactttccaggagtcaaactcaggagcaagatgtccctacggagttacgggtctagggaagggtccgtgtcctctcgaagcggggagtgcagccctgtgcctatgggatcgtttcccaggagaggatttgtgaacggttctcgggagtctactggctacctagaggaactggagaaagaaaggagcttgctcctggcggacctagataaggaggagaaggaaaaagattggtactatgctcagctccagaatctgactaaaagaattgattcgctaccgttgacagaaaatttctccttacagacagatatgacaagacggcagctggagtatgaagcccggcagattagagtggcaatggaggagcagctggggacgtgccaggacatggagaagcgtgcccagcggagaatcgcccgtattcagcaaatcgagaaggacattctgcggattagacagttgcttcagtcacaggctacagaggctgagagatcttcgcagaataaacacgagactggctcgcacgacgccgagcggcagaatgaaggccagggcgtgggggagatcaacatggcaacctctggcaatggacaagggtccaccacgaggatggaccatgaaaccgccagtgtattgagttcaagctccacacacagcgccccaaggaggctcaccagccatcttgggaccaaagtggagatggtgtatagcctgctcagcatgctgggtacccatgataaggatgacatgtcacggactctgctcgcaatgtcatccagccaagatagctgcatctccatgaggcagagtggctgtctgcccctcctaattcagctattgcatgggaacgacaaggatagtgtgctcctgggaaacagtcggggctccaaggaggcccgggcccgggcctcagctgccctacataacatcatccactcccagccggacgataaacgggggcgtcgcgagatccgagttctgcatctgctcgagcagattagagcttattgcgaaacgtgttgggagtggcaagaagcccacgagccaggaatggatcaggataaaaaccccatgccggcccccgtggaacatcagatttgtcctgccgtttgcgtgctaatgaaactctccttcgacgaagagcacaggcacgcaatgaatgagctgggtggactgcaggccatcgccgagctacttcaagtcgattgcgagatgtacggactgacgaatgaccactactccattactctgaggcgatacgccggaatggcacttacaaatctgacattcggggacgtcgctaacaaagctaccttgtgttcaatgaagggatgcatgcgcgcactagtcgcacagctgaaatcagaatcagaagacttacaacaggtgattgcatccgttcttcgcaatctgtcttggcgcgcggacgtgaatagtaaaaagacactccgtgaggtgggctccgtgaaggcccttatggagtgcgcattggaggtgaaaaaggagagtactttgaagtccgtgctgagcgccctttggaatctctcggctcattgtactgagaataaggctgacatctgcgccgtcgacggagcactggcatttctagtaggtaccctcacataccgatctcagacgaatacactagctatcatcgagagcggcgggggcattctcaggaatgttagtagtctgatcgccacaaatgaagatcatcgacagattctacgtgaaaacaattgcttacagacactactgcagcatttgaagagtcacagccttactattgttagcaacgcttgcgggaccttgtggaatctgagcgctcgcaaccccaaggatcaggaggccctctgggatatgggtgccgtcagcatgctgaaaaaccttatacacagcaagcataagatgatagcaatgggctccgcagccgcgctaagaaacctgatggccaacagacccgcaaaatacaaagacgctaatataatgtcgcccggatcttcactacccagccttcacgtgcgcaaacagaaggctctggaggccgagttggacgcgcagcatctatcagagacattcgacaacattgataatctgtcaccaaaggcaagccatagatctaagcaacgtcacaaacagagcctttacggagactatgtctttgacacaaaccggcatgatgacaatcgctctgataatttcaataccgggaatatgacagtcctgtccccttatctgaacactactgtcttgcctagtagctcttctagcagaggctccttagacagctcccgcagcgagaaagatagatcactggaaagagagcgaggcataggactgggcaattaccatccggccacggaaaaccccggcacatcttccaagcggggcttgcagatctctacgaccgcggcccaaatagcaaaggtcatggaggaggtgtctgcgattcacacttctcaggaagacagaagcagcggcagtaccacagaactgcactgcgtgaccgacgaaagaaacgccctccggcgctcttctgcggcgcacactcattccaatacttacaacttcaccaaaagcgaaaattcgaatcggacctgttcgatgccttatgcgaagttggaatacaaacgctcctccaatgacagcctgaatagtgtttcctctagcgatgggtatggaaaacgtggacaaatgaagccatcaatagagtcctatagcgaggacgacgagtcaaaattttgcagctatgggcagtaccctgcagacctggcccataaaatccacagtgcaaaccacatggacgataatgacggagaactggacaccccaattaattatagtctcaaatattccgatgaacagcttaatagcggcaggcaaagcccttcccaaaatgagagatgggcgaggccgaaacatataatcgaggatgagattaagcaatccgagcagcggcaaagtcggaaccagtctaccacctatcccgtttacaccgagtctacagacgacaaacatcttaaattccagccacattttggacagcaagagtgtgtctctccgtatcgatcaaggggtgctaatgggagcgaaactaatcgcgtcggctccaaccacgggataaaccagaatgtatcgcagagcctctgccaggaggacgactatgaggatgacaagccgacgaactattctgaacgctattcggaagaggaacagcacgaggaagaggaaaggccaactaactactccattaagtacaacgaggagaagcgacatgtagatcagccaatcgactactcactcaagtatgccaccgacatcccctcctcacagaaacagagcttttcattttcgaagtcctctagcggtcagtcgtctaagaccgagcatatgtcaagctctagcgaaaatacctctaccccttcatctaatgctaaacgccagaaccagctacacccaagttcagcccagagccgctccggccagccacagaaggcagcaacgtgtaaagtctcctcaatcaatcaggaaaccattcagacctactgcgtcgaggacaccccaatctgcttctctcggtgcagctctctttccagtttgtctagcgcggaggacgagatcggttgcaatcagaccacacaggaggccgattcggctaacactttgcaaatcgcttag

SEQ ID NO: 13772 - DNA, 2796 bp, Artificial Sequence
  Description of Artificial Sequence: Synthetic coding sequence
atggctgaaatcaaggaaaagatctgcgactatttgtttaacgtcagcgacagcagtgcgcttaatctggctaagaacattgggttgactaaagccagagacataaacgccgtgctgatagacatggagcgtcagggtgacgtgtacaggcagggcaccacaccaccaatttggcacctgactgataaaaagagggagcgcatgcagatcaaacgtaacactaatagtgtacccgagactgcacctgcagccattcctgagacaaaaagaaatgctgaatttctgacctgcaatatacctactagtaatgcatcaaataatatggttactaccgagaaggtggaaaatggccaggagccagtgatcaagttagagaaccggcaggaagctaggccagagcctgcccgcctcaagccgcctgtgcactataacggacccagtaaagcaggctacgtggactttgagaacgggcaatgggccactgatgacatccctgacgacctgaactccataagggccgcacccggcgaattccgcgccatcatggagatgccttcgttttactctcacggactgccacggtgctctccgtacaaaaagctgactgagtgccagctgaagaaccccatctccgggttactggaatatgcacaattcgctagccagacttgcgagttcaatatgattgagcagtccgggccacctcatgagcctaggttcaaatttcaagttgtgatcaacggacgtgagttccctcccgccgaagctggcagtaagaaagtggctaagcaagacgccgcaatgaaagctatgacaattttactggaggaggcgaaagctaaagactctgggaaaagcgaagaaagctctcattatagcactgaaaaagagtcagaaaaaaccgccgaatcccagactcctacaccgagtgccacaagttttttttcgggaaagtctcccgtcaccactttgctggagtgcatgcacaagctcggcaactcttgcgaatttcgactattatccaaggaagggccggctcacgaacccaaatttcaatactgtgttgctgtgggggcccagacctttccatccgtaagcgccccatctaaaaaagtcgcgaagcaaatggccgcagaggaagccatgaaggcactacacggagaagctaccaattccatggcttcagacaaccaacccgaaggcatgatcagtgagtctttggataatcttgaaagtatgatgccaaataaagtcagaaagattggggagctggttcgttacctgaatacgaatcccgttggtggtttgttggagtatgcaaggtcacacggctttgccgccgaatttaagttggtggaccagagcggtcccccgcatgaacctaagttcgtctaccaggcaaaagtcggaggtcgatggttccccgcggtatgtgctcactctaagaaacaaggtaagcaggaagcagccgacgccgcgctgagggtgctgatcggtgaaaatgaaaaggccgaacgcatgggcttcacagaagtgacccccgtaaccggcgcctccctacggagaactatgcttctgctctcccgttctcccgaagcacagcccaaaactcttccactgacagggtcaaccttccatgatcagatcgcgatgctgagtcatcggtgctttaataccctgactaactcttttcaaccgtccttgttggggagaaagatcttggcggctattattatgaagaaggacagcgaggacatgggcgtggtggtctccctgggcaccggaaaccggtgtgtgaagggcgattccctatcactgaagggagagaccgtgaacgactgccacgctgagattatttcacggagaggattcattcgctttctctacagcgaattaatgaagtataatagccaaaccgcaaaagattccattttcgaaccagccaaaggaggcgagaaactccagatcaagaagacagtgtcgtttcacctctatatcagtaccgctccttgcggggatggcgcactatttgacaagtcctgtagtgaccgggccatggaatctactgagtctcgacactacccggtgttcgagaatcctaaacaaggaaaactacgaacgaaggtcgagaatggggaaggtacaatccccgtggagtcctccgacattgttcccacatgggatggtattcgcctgggcgagcggctccgcaccatgagttgtagcgataagatactgcgatggaatgttctgggcctgcagggggctctattaactcactttctccagccaatttacctcaaatccgtgaccctcggctatctttttagtcagggccacttgacccgcgcaatatgctgcagggttacacgcgacggctccgcattcgaggacggccttaggcatcctttcatcgtgaatcaccctaaagtgggcagagtgtccatatacgattccaagcgccagagcgggaagactaaagaaactagcgtgaactggtgtctagccgatggttatgatttagaaatcctcgatggcacaaggggaactgtcgatgggccacggaacgagctctctagagttagcaagaagaatatctttcttctctttaaaaagctctgtagttttagatatagacgcgatttgctgcgcttaagctatggcgaggccaagaaagccgcgagggactacgagactgcaaagaattacttcaaaaagggactgaaggatatgggatatggcaactggatctccaagccccaagaagaaaaaaatttttatttatgccccgtgtag

SEQ ID NO: 13773 - DNA, 3681 bp, Artificial Sequence
  Description of Artificial Sequence: Synthetic coding sequence
atgaatccccgtcagggctattccctgtcaggatactatacacaccctttccagggatacgagcacaggcagctgcggtaccaacaacctggtcccggcagctctcccagcagtttcttactcaagcagattgagtttttaaaggggcagctgcccgaagcgcccgtgattggcaaacagacacccagtttacccccctccttgccaggtctgagaccccgctttccagtactactggccagctcaacacgggggcggcaggtcgacatcagaggggtgcctagaggcgtccatctcaggtcacagggcctgcagagaggcttccagcatccatcccctaggggtcgctcacttccacagcgaggggtagattgcttgtcttcccattttcaagagctcagtatctatcaggatcaggaacagcggatacttaagttcctcgaagagctgggagaagggaaggctactacagctcatgacctctctggcaagctcgggaccccgaagaaagagataaacagggtcctgtactcgctcgctaaaaaaggcaaactccaaaaagaagccgggacaccacccctctggaaaatcgctgtgtcaacccaggcatggaatcagcactctggagttgtaaggcctgacggacatagccagggcgcacccaatagcgacccttccctagaaccagaagacagaaattccactagcgtatccgaagatctcctcgagccgttcattgcagtgagcgctcaggcctggaatcaacacagtggggtcgtgcggccggactcccatagccaggggtcccctaacagtgatcctggccttgagccggaggactctaattccacaagcgcactggaagatcccttggagtttctcgatatggctgagatcaaggagaaaatttgtgactacctgttcaacgtcagcgattcgtccgctctgaacctggccaaaaacattgggctcacaaaggcccgggacatcaatgccgtgttgattgatatggagaggcagggggatgtgtacagacaggggaccacacctccaatatggcatcttactgacaaaaagagggagcgtatgcagatcaagagaaatacaaacagcgttccagaaacggctcccgctgcaataccagagaccaagcggaatgctgagtttctgacttgcaatatccctacttccaacgccagcaacaatatggtgaccacagagaaagtagagaacgggcaggagcccgtcatcaagctagagaatagacaggaagctcgaccagaaccagccagactcaagcctcccgtgcactataatgggccatctaaggccggctatgtcgattttgaaaacgggcagtgggccaccgacgatattcccgacgatctgaattccataagagccgcgcccggggagttcagagccatcatggaaatgccaagcttctacagccatggtctcccaagatgttcaccatacaaaaaattgaccgagtgccaactcaaaaatccaataagtggtctgctagaatatgctcagtttgcatctcagacctgcgagtttaacatgattgagcagagcgggcccccccacgagccaaggtttaagtttcaggtggtcatcaacggaagggagtttccccctgctgaagccggttctaagaaggtggcaaaacaggacgctgctatgaaagctatgacaatacttcttgaggaggcgaaggcaaaggactctggcaagtccgaagagtcaagtcactatagcacagagaaggaaagcgaaaaaactgccgaatcccagactcctacgcccagtgccacctctttcttctcagggaaaagccccgtaactactctcctggaatgcatgcacaagctggggaacagctgtgagtttaggcttctctccaaggagggaccggctcacgaaccaaaattccaatactgcgtcgccgttggcgcccagacctttccgtccgtgtcagccccttctaagaaggtggccaaacagatggcggctgaagaggcaatgaaagccttacatggcgaggcgactaattctatggcttccgacaatcagccggagggaatgatcagcgaatctctggacaatttggaatcaatgatgcccaacaaggtgaggaaaatcggcgaacttgtgcgttatctgaacacaaatccggtggggggactcctcgaatacgcaaggagccacgggttcgcagccgaattcaaactggtggatcaatccgggccaccccatgagcccaagttcgtctaccaggctaaggttggtggcagatggttccccgcagtgtgcgcacactccaagaaacaggggaaacaggaggcagccgacgcggccctccgcgtgcttattggagaaaatgagaaagccgaaagaatgggctttaccgaagttaccccggtcactggagcctcactgagacgcaccatgctcctgctctccaggagtcccgaggcccagcctaaaactctccctctgacagggtccacattccatgatcaaattgcaatgctgtcccataggtgcttcaacaccctgacaaatagcttccagccttctttgctagggagaaagatccttgcagctataatcatgaaaaaggactcggaagacatgggagtggtggtgagcctgggaacaggcaaccgatgtgtcaaaggtgactctctgagccttaagggcgaaaccgtcaacgattgtcacgccgagataatttcccgccgcggctttatccgtttcctgtactccgaactgatgaagtacaatagccagacagctaaggatagtatcttcgagccagctaagggtggcgaaaaactgcagataaagaaaacagtctctttccatctgtatatctccactgccccatgcggggacggcgccctgtttgataaaagctgttccgacagagcgatggagagcacagaaagtaggcactaccctgttttcgagaatcctaagcaaggcaagttgcggaccaaggtagagaatggggagggaaccatccctgtcgaatcaagcgacattgtgcctacttgggacggcatccggctgggcgagcgattgcgtaccatgagctgcagcgataaaatactgcgctggaacgtgttagggctgcagggggcattactgacccattttttgcagcccatctacctgaagtccgtcaccctggggtacctattctcacagggtcatttaacacgggctatctgctgtagggttacgcgggacggcagcgcctttgaagatggcctgaggcacccctttatcgtgaaccacccaaaagtaggccgtgtgtctatatacgatagcaagcggcagtctggtaagacaaaggaaacctctgtgaattggtgtctggcggatgggtacgatctggaaatcctcgacggaacgcgtgggacagtcgatggccccagaaacgagctgagccgggtaagtaagaagaacattttcctgcttttcaaaaagctttgttctttcaggtataggagagatctactgagattgtcctatggcgaggctaagaaagccgccagggattacgagaccgccaagaactatttcaaaaaaggtcttaaagacatgggttacggaaattggatctccaagccgcaggaggagaaaaacttttatctttgccctgtatag

SEQ ID NO: 13774 - DNA, 3588 bp, Artificial Sequence
  Description of Artificial Sequence: Synthetic coding sequence
gggtattctctgtccggatactacacccatccattccaaggctatgaacacaggcagctgaggtaccagcaacctggacctggctcttccccttcttctttcctcctgaagcagatagaatttctgaagggccagctccccgaagccccggttattgggaaacaaaccccctccttgcctccaagcctccctggactccgcccacgctttcccgttctcctggcaagctcaacaagaggccggcaggtggatatccgcggagtccccaggggggtccatctacggagtcagggcctgcagaggggatttcagcacccttctcccagagggcgctctctccctcaacgcggagtcgactgcctgagcagtcacttccaagaactctcaatataccaggatcaggagcagaggatcctgaagttcttggaggagctcggagaaggaaaggccacaacagcccacgacctcagcggcaagttaggaaccccaaaaaaggagataaacagggtgctctacagtctggctaagaaaggaaagctgcagaaagaggcagggacaccacccctctggaagatcgcggtgtctactcaagcttggaatcagcattctggggtcgtgcggcctgacggccactcccaaggtgcacctaattctgatccaagtctggagcccgaagataggaatagcaccagcgtctcagaggacctcttggagccattcatcgccgtcagcgcccaggcctggaatcagcactcaggcgtcgtgcggcccgattcccattcacagggaagccctaacagcgatcccggactcgagccggaggacagcaattcaacttccgcactggaggacccgctggagttcttagacatggcagagattaaggaaaaaatctgtgactatctgttcaacgtgagtgacagtagcgctctgaatttggccaaaaacatcggcctgacaaaggctagagatatcaatgctgtgctgatagatatggagaggcaaggagacgtatataggcagggaactacaccccccatttggcacctaaccgacaaaaaaagggaaagaatgcagattaaaagaaataccaattccgtgccagagaccgcaccagccgctattcccgagacaaagcgaaatgcagagttcctgacatgcaacatacccacctcaaacgcgtccaacaacatggtgacaactgagaaggttgaaaacggccaagagccagtcataaaactggaaaacaggcaagaggcccggcctgagccggcccgactaaagccacccgtgcactataatggtccaagtaaggctggatacgtcgatttcgagaacggacagtgggctacagacgatatccctgatgacctgaactcaattcgcgcagctcccggtgaattccgtgctattatggagatgccgtcattttactcacacggattgccaagatgcagcccttacaaaaaattgacagaatgtcaactgaaaaatccaattagcggactcctggagtatgctcagtttgcatcccagacatgcgagtttaatatgattgagcaaagcgggccccctcatgaaccacgcttcaagttccaggtcgtcatcaatggacgagaattccctcccgctgaggccgggtcaaagaaggtggccaagcaggatgccgctatgaaagccatgactattctgctggaagaggctaaggcaaaggacagcgggaagagcgaggagagctcacattatagcaccgaaaaggaatccgaaaaaaccgccgagtcccagacgccaaccccatcagctacctcctttttttcaggcaagtcacctgtgaccacactcttagagtgtatgcataaacttggaaattcctgcgaattcaggctgctcagtaaagagggtcccgcacacgagcccaaatttcagtactgcgtggctgtgggagcacagaccttcccctctgtctcagctccgagcaaaaaagtcgccaagcagatggcagctgaagaagcgatgaaagccctccacggcgaggccacaaacagcatggcttctgacaaccaaccagaaggaatgatatcggagtcgctggataacctggaaagtatgatgcctaataaagttagaaagatcggagaactcgtcagataccttaacaccaatcctgtgggtggacttttggagtacgcacggtcccatggcttcgcggcagaatttaagctggtcgaccaaagtgggccaccccatgagcctaagtttgtctatcaggccaaagtaggtggacgttggttccctgcggtctgtgcacacagcaagaaacaaggtaaacaagaggcagccgatgccgcactgagagttctgatcggggaaaacgaaaaggcagaaagaatgggcttcacagaactcccactaactggatccaccttccacgaccagatcgccatgctgagccaccgatgctttaataccctaaccaattcctttcagccaagcctgctgggtaggaagatactagccgctattattatgaagaaagacagcgaggacatgggtgtagtggtcagccttgggaccggaaatagatgcgtgaagggcgactcactaagccttaagggtgagacagtgaacgactgccatgccgaaatcatcagtaggcgcggcttcattcggttcctgtatagcgaactcatgaaatacaattcccagaccgcaaaggacagtatctttgagccagccaagggaggcgagaaattgcagattaaaaaaactgtgagtttccacttgtatatttccaccgcaccctgcggcgatggcgctttgttcgacaagagctgctctgacagagcgatggaaagtacggaatcccgacactatcctgtatttgaaaatcccaaacagggcaaattgcggacaaaagtagaaaatggagagggtactatccccgttgagagtagtgacatcgtcccgacctgggatgggattcgcctgggggagcgtcttaggaccatgtcatgttccgataaaatcctgagatggaacgtgctcggactgcagggcgccttgctgacccacttcctacaacccatctacctgaagtccgtcacgctcggatacctgttcagccagggccatctgacccgggccatctgttgccgagtcactcgcgacggttcagcgtttgaggatggactgcggcacccgtttatcgtcaaccatcctaaggttggaagggtctccatctacgacagcaaacggcagtcagggaagacaaaggagacctctgtcaattggtgtctcgccgatgggtacgatcttgagattctggacgggacacggggaactgtcgatggccccaggaacgaactctccagggtatccaaaaaaaacatattcctcctgtttaagaagctgtgttccttccggtaccggcgagacctgctgcgactctcttatggcgaggccaagaaagctgcccgggactatgaaactgcaaaaaattattttaaaaagggtctcaaggacatgggttatggcaattggataagtaaacctcaggaggagaagaacttttatttatgccccgtttag

SEQ ID NO: 13775 - DNA, 528 bp, Artificial Sequence
  Description of Artificial Sequence: Synthetic coding sequence
atggggaaggtcctgtccaagatcttcggcaacaaggagatgagaatcctaatgctcggcctggatgcagccggtaagactacaatcttatataagttgaaactgggccaatctgtcacaacgatccctactgtcggatttaacgtcgagaccgtcacctataaaaatgtgaagtttaatgtatgggatgttggggggcaggataagattcgccccttgtggagacactactataccggtacacagggactgatatttgtggtggactgcgcagatcgtgaccgtattgacgaagccagacaggaacttcaccgaattatcaacgatagggagatgagagatgctattatcctgatattcgccaataaacaggacctccccgacgccatgaaacctcatgaaattcaggaaaagttgggtctcacccgcatcagggacaggaattggtatgtacagccaagctgtgctactagcggcgatggtctctatgaaggtctgacctggctgacgtctaactacaaaagttag

SEQ ID NO: 13776 - DNA, 1398 bp, Artificial Sequence
  Description of Artificial Sequence: Synthetic coding sequence
atgttcagacaagaacagccgttggctgaagggtcctttgcgccaatgggcagcctccagccggacgccggtaatgcatcctggaatggaaccgaggcccctggcggcggcgcccgggccacgccatatagcctacaagtcactttaaccctggtctgcctggccgggttgctgatgttgcttaccgtgtttgggaacgttttagttatcatcgccgtctttaccagccgtgccctcaaagccccacaaaatttatttctggtctctctggccagcgccgatatattggtagcaacgcttgtcattcccttctccctcgcaaatgaggtgatggggtactggtattttggcaaagcgtggtgcgaaatctaccttgcccttgacgttctgttctgcacatcatcaatcgtccacctgtgcgccatcagcctcgaccggtactggagcattacccaggcaatcgagtataacctgaagcgaaccccacgacgaattaaagcaattattatcactgtctgggtgatcagtgccgttattagtttcccccctcttataagtattgagaaaaaggggggcgggggcggtccacagccagctgaaccacgttgcgagatcaacgaccaaaaatggtatgtgatctcctcctgtatcggatccttcttcgctccatgcctcatcatgattttggtgtacgtgagaatttaccagattgctaagagaagaactagggtgccaccgtccagacgcggcccagacgccgtagccgctcctccgggcgggacagaacgtaggccaaatggtctgggtcccgaacgaagtgctggccccgggggcgctgaagccgagcccctcccaacccagcttaatggggcacccggagaaccggcacccgccggaccacgagacaccgacgctctcgacctggaggaaagcagttcatccgatcacgctgaacggcctccagggccacggcggcctgagcgtggcccccgtggcaaaggcaaagccagagcaagccaggttaagcccggcgattctcttcccagaaggggcccaggggctacagggattgggacgcccgccgcggggccaggggaggagcgcgtgggggcagcgaaggcgagccggtggaggggccgccagaacagggaaaagcgcttcactttcgtcctggccgtggtaataggggtgttcgtggtgtgttggtttccattcttttttacctacacgcttacagccgtcggctgtagcgtccctagaaccctatttaagtttttcttttggttcggttactgtaatagctctctgaaccctgtcatatacaccatttttaatcatgacttccggcgcgcttttaagaaaatcttgtgtcgaggggatcggaaacgtattgtgtag

SEQ ID NO: 13777 - DNA, 285 bp, Artificial Sequence
  Description of Artificial Sequence: Synthetic coding sequence
atggcccccctgaagatgctggcactcgtaacccttttgctcggagccagtctccagcatatacatgccgcccgtggaactaatgtgggaagggaatgctgcctggaatactttaaaggagccatcccccttagaaaattaaagacttggtaccagactagtgaggactgctccagggacgccatagtgttcgtgaccgttcaaggtcgagccatttgtagtgaccctaataataaacgtgtgaagaacgcagtgaagtatctgcaatccctggagcgtagctag

SEQ ID NO: 13778 - DNA, 1635 bp, Artificial Sequence
  Description of Artificial Sequence: Synthetic coding sequence
atgccggggaggtgccagtctgacgctgcaatgagagtgaacggccctgctagccgcgccccagcaggctggacatctggcagccttcataccggcccgcgggccggcaggccaagagcccaggccagaggcgtgcgcgggcggggtctgctcttaaggccacggccagcgaaggagctcccactccccagaaagggaggtgcctgggcccctgccggcaaccctggtcctcttcaccctctgggagtcgccgtgggaatggccggatccggacgactggtcctacggccctggattcgcgagttaatcctcggaagtgagacaccctccagccctagagctggacagctgctagaggtactccaggacgccgaggccgctgtcgcgggcccgtcccacgcacccgatacctctgacgttggtgccaccctgctcgtgagcgacggcacccatagtgttagatgcctagtcacgagagaagcattagatacgtcagactgggaggaaaaggaatttggattcaggggaaccgaaggacgtctgttgctgctccaggattgcggcgtacacgtgcaggtagccgaagggggagctcccgccgagttctacctgcaagtggatagattttctcttctgcctaccgagcagcccagactccgggtaccaggctgcaaccaggacctggacgtccagaaaaaactgtacgactgtcttgaggaacacctgtctgaatcgacctcgtcgaacgccgggctgagtctcagccagctcttggatgagatgagggaggaccaggaacaccagggagcgttagtgtgcctggcagaaagctgcctcaccttggaaggcccatgtacagccccgcctgttactcattgggccgcctcccgttgtaaagccacgggcgaggctgtctatacggtgcccagttctatgctgtgtatttccgagaatgaccagctaatcctgtcctctctgggcccctgccagcgcactcagggtcccgaactgccaccccccgatcctgctctccaggatctgtccctcacattgatcgcgagtccaccgtcctcgccctcatctagcggaacacccgcacttcccggccacatgagcagcgaggagagtggtacttctatcagtttactaccggccttatctctggcggcgcctgatcccggccaaagatccagctctcaaccctcccctgccatttgttcggcgcccgctactctgacgccacggtccccccacgcctctagaaccccctcatctcccttgcagtcctgtacccccagcctctcccctagatcccacgttcccagcccacaccaagctctggtgactcggccgcagaagccatctctggaatttaaagaatttgttggcctaccctgcaaaaatcgccctcccttcccccgaaccggggccactcggggcgcccaggagccctgctccgtgtgggagccacctaaacgacacagagatgggagtgcttttcagtacgaatatgagcctccttgcaccagcctatgcgcgagggtgcaggcagtgaggcttcctccacagctcatggcatgggccctccacttccttatggatgcacaacccggatctgagccaaccccaatgtag

SEQ ID NO: 13779 - DNA, 558 bp, Artificial Sequence
  Description of Artificial Sequence: Synthetic coding sequence
atgaagctggtctctgtggctctcatgtaccttggtagcctagccttcctgggagctgatactgccagactagacgtcgccagcgaattccgcaagaaatggaacaagtgggctctctcccggggaaaacgtgagcttcggatgagctcctcatatccgactggcctcgcagacgtgaaggcaggaccggcacaaacgctcattcgcccccaggatatgaagggggcgtccaggagccccgaggatagcagccccgacgccgctcgcattagagtaaagagatacaggcagtctatgaataattttcaaggcctgagaagtttcgggtgcagattcggaacctgcaccgtgcagaagttggcccatcagatttaccaattcaccgacaaagataaggataatgttgcccctagatccaaaatctcaccccaagggtatggccgccgccgcagaagatcattaccagaggccggaccaggcagaacactcgtgtcctccaaacctcaggctcacggtgcaccagcacccccttctggttcagccccacactttctgtag

SEQ ID NO: 13780 - DNA, 558 bp, Artificial Sequence
  Description of Artificial Sequence: Synthetic coding sequence
atgaagctcgtatcagtagcactgatgtacctgggcagtttggcgtttcttggcgccgacaccgcacggctcgatgttgcctctgaatttagaaaaaagtggaataagtgggcgttgagtagaggcaagagggagctgcgtatgagttccagttaccctaccgggttggccgacgttaaagctggacccgctcagactctgatccgccctcaagacatgaaaggcgcctcgcggtcaccggaggactccagtcccgacgctgctcgaattcgggtcaaacggtatcggcagtctatgaataatttccaggggctgcgcagctttgggtgcagattcgggacgtgcacagtccaaaagctggctcaccagatttatcagttcacggataaagacaaagacaacgtcgctccccggtctaagataagcccccagggttatggacggaggagaagaagatcattgcccgaagccgggccaggccgaacactggtgtcttctaagccacaggcccacggggcaccggctcccccgagcggcagcgcgccacacttcctatag

SEQ ID NO: 13781 - DNA, 558 bp, Artificial Sequence
  Description of Artificial Sequence: Synthetic coding sequence
atgaagctggtgagcgtcgctctgatgtacctcggctctttggccttcttgggggcagataccgcccgcctcgacgtcgccagtgaattccgaaagaagtggaacaaatgggccctctcacgggggaagcgcgagcttcggatgagctcctcctatcctactggactcgcagatgtcaaggctgggcctgcccagaccttgatcagacctcaagatatgaagggggcgtccaggtcaccagaagacagctcacctgatgctgctcgcatccgggtgaagcgatacagacagtctatgaacaacttccagggcctgcggagtttcgggtgtcgctttgggacttgcaccgttcagaaacttgcgcaccagatatatcagtttacagacaaggataaagataacgtcgcccctcggtctaaaataagtccgcagggatatgggcgaagacggcgacgcagtctgccagaggctggccctggcagaaccttggtctcctccaagccacaggctcatggagctccagccccaccttcaggctccgcccctcatttcctatag

SEQ ID NO: 13782 - DNA, 702 bp, Artificial Sequence
  Description of Artificial Sequence: Synthetic coding sequence
atggcagcaggtactgctgtgggggcttgggttctcgtgcttagcctgtggggcgcagttgtgggcgctcaaaacataaccgcccgaataggcgaacctctcgtgctgaagtgcaaaggcgctcccaaaaagcccccccagcgcttggagtggaagctgaataccggaagaacagaagcctggaaagtcctgtcgcctcagggaggcgggccgtgggacagcgtggcccgtgtcctgccaaactcttctttattcttgccagccgtgggcattcaggacgaggggatattcaggtgtcaggctatgaataggaatggcaaagaaaccaaaagcaattatagagtaagagtctaccagattccaggcaagcccgaaatagtggattccgcttccgagctcacagctggcgtgccgaataaggtggtcgaggaaagtagaagatcccggaaacggccatgtgaacaggaagtcgggacttgtgtaagcgaaggatcttaccccgccggcacactgtcctggcacctggatggcaaaccactggttccaaacgaaaaaggggttagtgtgaaagaacagaccagacgccatcccgaaactggcctgtttacccttcagagcgaactaatggtcacccccgcgcgggggggggacccacggcctacatttagttgtagcttctcacccggcttaccaaggcactag

SEQ ID NO: 13783 - DNA, 1029 bp, Artificial Sequence
  Description of Artificial Sequence: Synthetic coding sequence
atggctgcggggacagccgtgggggcctgggtgctggtattgtctctttggggcgccgttgtcggagcccagaacatcacggcgcgaataggggagcccctcgtgctgaagtgtaaaggcgcccccaagaagcctcctcagcgattggagtggaaactagggggtggcccttgggactctgtcgctcgagtgcttcccaattcatcccttttccttcctgctgttggcattcaggacgaaggaatctttaggtgtcaggccatgaaccgaaatgggaaagagacgaaatccaattacagggtgagggtctaccaaattcccgggaagccagagattgtagactccgccagtgagctgacggccggtgttcctaataaagtgggcacctgtgtgtccgagggctcttatcccgctggcacattgtcctggcatcttgatgggaaaccactggtccccaatgagaaaggcgtctccgtgaaggaacagacccgtaggcacccagaaacgggattattcaccctgcagagcgagctcatggtaacacccgcaaggggcggcgaccctcgtcccaccttttcatgctcattctctcccggattaccccggcatcgagccctgcggaccgcaccaatacagccacgcgtatgggagcctgtccctctggaggaggttcagcttgtggtcgaacctgagggcggagctgtggctccaggaggaacagttacccttacttgcgaggtgccagcccagccgagcccacagatccactggatgaaggacgtttccgacctggaaaggggagccgggcgaaccagacgcggcggagcaaactgtaggttgtgtggtcgaatccgggccggcaactcatcccccggtccaggcgatcctgggagacctggtgatagtcgaccagcccattggggccatctggtggcaaaagccgcaactccccgcagaggagaggagggcccacgcaaacctggcggaagaggtggggcgtgtcgaactgaatccgtgggcggcacgtag

SEQ ID NO: 13784 - DNA, 1044 bp, Artificial Sequence
  Description of Artificial Sequence: Synthetic coding sequence
atggctgcaggtaccgcagtgggggcttgggtattggtattaagtctgtggggggccgttgtgggcgcccagaatataacagctcggataggcgagcccctcgtactgaagtgcaagggtgctcccaaaaagcctccacagcgactagaatggaaactgaacacaggccggacggaggcctggaaagtcttgtcgccacagggcggtggtccctgggactcagtcgcccgcgtgctgccgaactcctccttgttcctgccagcagtgggcattcaagatgagggcattttccgttgtcaggcgatgaataggaatggtaaggagacaaaatcaaattacagggtgagggtttatcaaataccagggaaacccgaaattgtagactcagcaagtgaactcaccgctggcgtgcctaataaagtcggaacttgtgtgtccgagggctcctatccagccggcacactttcttggcatctggatggaaagccgcttgtgcccaacgaaaagggagttagcgtcaaggaacaaacaaggcgtcatcctgagactggtttgtttaccctgcagagtgaattaatggttacccccgctagagggggggatcccagaccaacgttttcctgttccttcagcccaggactacccagacaccgtgcactgcggacagcccctatccagccccgggtatgggaacctgtgcccctggaagaagttcaactggtggtggaaccagaaggcggagccgtcgcgcccgggggaacagtgactctgacatgcgaagtgcccgcccagccatctcctcagattcactggatgaaagatggggtcccactacctctgccaccttccccggtactgatcctgcctgagattggaccacaggaccaggggacatattcttgtgtcgctacccacagtagccacggtcctcaggagtcccgagccgttagtattagcatcattgagcctggcgaggagggtcctacggcaggcgagggatttgacaaggtgagagaggccgaggactctccacagcacatgtag

SEQ ID NO: 13785 - DNA, 1215 bp, Artificial Sequence
  Description of Artificial Sequence: Synthetic coding sequence
atggccgccggaacagccgtcggggcatgggtgctcgtgttgtccctgtggggcgccgtggttggggcccagaatattaccgcacgcattggggaacccttggttctgaagtgcaaaggagcgccaaagaagcccccccaaagattggagtggaaactcaacactgggcgcaccgaggcttggaaggtcctgtcaccacaagggggaggaccttgggactccgtggcaagagtcttaccgaactcctctctctttctcccggccgtgggcatacaggacgaaggaatctttagatgccaggcgatgaacaggaacgggaaagagaccaaaagcaattacagagtgcgggtgtaccagatcccaggaaaacccgagatcgtagattccgcctcagaattgactgcaggcgttccaaacaaggtgggaacatgcgtatcggagggatcgtatccggctggcaccctgtcctggcacctcgacggcaagcctcttgtgcctaacgagaagggagtgtcagtcaaggagcaaacacggcggcatcccgagaccgggctgttcacactgcagtccgaactcatggtcacacctgcaagaggcggcgaccccagacctacatttagctgttcattctctcctgggttgccaagacatcgggcgctgagaacagccccaatacaacctcgcgtttgggagccagtgcccctggaagaggtgcagctagtggtcgagcccgagggaggggctgtcgccccagggggaaccgtgactttgacctgcgaagtgccggctcaaccaagtccccagattcattggatgaaggatggcgtccccctcccccttcctcctagtccagtgctgatattgcccgaaatcggcccccaggaccagggcacttatagctgcgtcgcaacacacagctctcatggtccccaagagtcccgtgcagtgagcatatcaattattgaacccggcgaggagggcccaactgccggttcagtaggaggctcaggactgggcaccctcgctctcgcgctcgggattctgggaggattaggtacagccgccctgttgatcggagtgattttgtggcagcgacggcagcgccgcggagaagagcgcaaagccccggagaaccaggaggaggaggaagaaagggctgagctcaaccaatctgaggaacctgaggctggagaatcctcaacaggagggccttag

SEQ ID NO: 13786 - DNA, 705 bp, Artificial Sequence
  Description of Artificial Sequence: Synthetic coding sequence
atggccgctgggacagcggtgggggcctgggtgctggtcttatcgctctggggagcagtggtgggtgcccagaacataaccgcaaggattggtgagccactcgtgctgaagtgcaaaggagcaccaaaaaaacctcctcagcgactggagtggaagctgaacaccggaagaacagaggcgtggaaggtactgagcccccaaggcggggggccatgggacagcgtggctcgtgtattgcccaatagcagcctcttcctccccgctgtcggcatccaggacgaggggatttttcggtgccaagctatgaatcgtaacgggaaagaaactaagtccaattacagatccctacggacctttacaatcacggccagcgattggatcttccccccaagcgaaataccgggcaaaccggaaattgtagactccgcctcggagctcacagcaggagtgcctaataaagttggaacttgtgtgtctgaggggtcttatccggctggaacgttgtcatggcacctagacggtaagccactggtccctaacgagaagggcgtcagcgtgaaggagcaaactcggcgccatcccgagacggggttgtttacgctgcaatctgagctgatggtcacaccggcccggggaggcgatccccgtcccacattcagctgctcttttagccctgggctgcctcgacacagggcactccgctag

SEQ ID NO: 13787 - DNA, 402 bp, Artificial Sequence
  Description of Artificial Sequence: Synthetic coding sequence
atgaaagacggggtcccgctgccactgccacccagccctgttctgatcttgccagaaatcggaccacaggaccagggtacttattcctgtgtggccactcatagtagccatggtccacaggaatctcgggctgtcagcatcagtattattgagcctggtgaggaagggcctaccgccggctctgtgggcgggtccggactcggcactctggccttggctttggggatcctaggtggtcttggcacagcagccctgctcataggcgtgatcctgtggcagcgtaggcagcgcaggggagaggagagaaaagctccagagaaccaagaggaggaggaggaaagggcagaactgaaccagagtgaagaaccggaggctggggaaagtagcacgggagggccatag

SEQ ID NO: 13788 - DNA, 1308 bp, Artificial Sequence
  Description of Artificial Sequence: Synthetic coding sequence
atgggagctggagaaagagttcaggcacctccacgcgcggaagcaacagctgggagaggcgcagaccgcgcacgtacgttagaaggctctagaatggccgccggaacagcagtgggggcgtgggtgctcgtccttagtctgtggggtgctgtggtgggggcccaaaacattacagcccggataggtgagcctttagtgctgaagtgtaagggagcacctaaaaagccgccccagcgtcttgaatggaagcttaatacaggccgtaccgaagcatggaaagtactgtccccccagggagggggaccttgggattctgtcgccagagtgttgcccaattcaagcctgtttttgcctgccgttgggattcaagatgagggtatctttcgctgtcaggctatgaacaggaacggaaaagagacaaagagcaactacagagtaagggtgtatcagattcccggaaagcccgaaatcgtagacagcgccagcgaattaacagctggagtgcccaacaaggtaggtacatgtgtctcagagggatcttaccctgccggcacactgtcctggcatctggatggaaagccattggttcccaacgagaaaggcgtatccgtaaaagagcagacgcgtcgtcatcctgaaaccgggttattcaccctgcagtcagagttgatggtgactcccgcccgcggcggtgatcctcgcccaacattcagctgttcattctctccaggactgccacggcaccgagctctgcgcaccgcgccaatacaaccgagagtttgggaacccgttccactggaagaggtgcagctggtggtagagccggaggggggggccgtggcaccgggcgggacagtcaccctgacatgcgaagtccccgcccaaccttctcctcagatccactggatgaaagatggcgttccgctgcccctccccccctcaccagtgctgatcctgccagaaataggaccccaagaccagggtacatactcttgcgtcgccactcatagcagtcatggtccacaggagagcagagctgtctcaatcagtattattgagcccggcgaagaaggacccactgccggcagcgtaggcggcagcggcctggggactctcgccctcgccctgggaatcctcgggggattaggcaccgctgccctgctgattggcgtaattttgtggcagagacgccagcggagaggcgaggagagaaaagcacctgagaaccaagaagaggaggaggagcgcgccgagctaaaccagtcagaggagccagaagccggagagagctctacagggggaccctag

SEQ ID NO: 13789 - DNA, 387 bp, Artificial Sequence
  Description of Artificial Sequence: Synthetic coding sequence
atggccgcgggaaccgcggtgggtgcctgggtgctggtgctgtctctatggggggcagttgtcggcgcacagaatatcactgccaggatcggcgaacctttggtcctgaaatgcaagggtgcaccaaagaagcctccacaacgactggagtggaagctcaacacaggccgaaccgaggcatggaaggtgttgtccccacagggcgggggtccgtgggatagtgtcgccagggttctccctaatagctcgctgtttctgccagccgtgggaatccaagatgagggaatcttcagatgtcaggcgatgaacaggaatggaaaagagaccaagagcaattacagagtgagagtgtaccaatttgagaacctccataattattcgttgtag

SEQ ID NO: 13790 - DNA, 462 bp, Artificial Sequence
  Description of Artificial Sequence: Synthetic coding sequence
atggcagccggcacagcggtgggtgcatgggtactggtgttgtctttatggggcgctgtagtgggcgcccagaatatcacggcacgcattggcgagcccctcgttctaaaatgcaagggcgcaccaaaaaaaccaccgcagagattggaatggaaactgaacacaggtagaaccgaggcttggaaggttctgtcaccccagggtggtggtccctgggactctgtggcccgtgtcctgcccaatagctctttatttttgcctgcagtgggtatccaagacgaggggatacttggtgggctggggactgcggcgttactcatcggggttattctgtggcagagacggcagaggagaggcgaagaacgaaaggcccccgaaaatcaggaggaggaggaggagagagccgagttgaaccagtcagaagagccggaggccggcgagtcctccacaggaggaccgtag

SEQ ID NO: 13791 - DNA, 885 bp, Artificial Sequence
  Description of Artificial Sequence: Synthetic coding sequence
atgaacagaaacggcaaagaaacaaagtccaactatagagtgcgggtctaccagattcctggaaagcccgagatcgtggatagcgccagtgagcttaccgcaggcgtgcccaataaggtcggcacatgcgtgtctgagggatcttacccggccggaactctgagctggcacctcgacggaaagccactggtccccaatgaaaagggtgtctctgtcaaagaacagacccgcaggcacccagagacagggctgtttacgcttcaaagcgaacttatggtgactcctgcccgcgggggtgacccacggccgaccttctcctgctccttttctcctggccttccacgccatagagccctgcgaaccgcacctattcagcctagggtgtgggagcccgttcccttggaggaagtgcaactggtcgtcgaaccagaagggggcgccgtagcccctggcggtacagtcaccctaacctgcgaagttcctgcgcagccctcacctcagattcattggatgaaggacggcgtaccccttcctctgcctccaagtccggtattgatcttacctgaaataggacctcaggatcaggggacttactcctgtgtggctacgcactccagtcatggcccccaggagtcccgggccgtgtccatttctattattgggtcagttggcggaagcgggttggggacactcgcccttgctctgggcattctcggggggctgggcactgccgccctgctgattggagttattctctggcagcggcgtcagcgacgcggtgaggagcgtaaagcacctgagaaccaagaggaggaggaggaaagggccgaactgaatcagagcgaagagccggaggctggggagtcatccacgggaggaccatag

SEQ ID NO: 13792 - DNA, 366 bp, Artificial Sequence
  Description of Artificial Sequence: Synthetic coding sequence
atggcggccggtactgcagttggtgcttgggttctggttctctcgctgtggggagccgttgttggtgctcagaatattacagcccggattggggaacccctcgtactcaagtgtaagggcgcgcccaagaaacccccccaacgcctggagtggaagttgaacaccgggcggacggaggcttggaaagtattatcaccacagggagggggtccctgggactctgtcgctagggtacttccaaactcatcacttttcctgcctgccgtcggtattcaggacgagggaatcttccggtgccaggccatgaaccgtaacgggaaagagaccaagagcaattggtggtggagccaaaaggtggaacagtag

SEQ ID NO: 13793 - DNA, 1092 bp, Artificial Sequence
  Description of Artificial Sequence: Synthetic coding sequence
atggctgctggcaccgcggttggggcatgggtgctcgtgctgtccctgtggggcgcagtcgttggcgcccagaacattaccgcacgcataggggagcctctcgtgcttaagtgcaagggtgcccccaagaaacccccccaaaggttagagtggaaactgaacactgggcgtacagaggcgtggaaagtgttgtccccacaggggggggggccctgggactccgtggcaagggtgctcccgaatagcagcttgtttctgcccgcagtggggatccaggatgaggggatctttaggtgtcaggccatgaatcggaatggaaaggagaccaaatccaactatcgagtgcgcgtctatcagatcccgggaaagcccgagatcgtcgatagcgctagcgaactgactgcaggcgtgccaaataaagtggtggaggagagtcgccgcagcaggaaacgaccctgtgagcaagaagtaggaacttgcgtaagcgaggggtcataccctgctggtaccttgtcatggcacctggatggaaagcctctggtgcctaatgagaaaggggtgtctgtcaaggagcagaccaggcgccatcccgagacggggcttttcacgctgcaatctgaactgatggtgacccctgctcgcgggggagaccccagacccacctttagttgttctttttcaccgggtctccctcggcacagagcactccgcacagcccctattcaaccccgcgtttgggagcccgtgcccctcgaggaagtacaattggtagtggaaccagagggcggtgctgtcgcaccgggaggtacagtaacccttacttgtgaggttccggcccagccaagtcctcagatccattggatgaaggatggggtgcccttacctttacccccatctcccgtgcttatcctcccggagatcggccctcaggatcaggggacatattcttgtgtggccacccactcatctcacggcccacaggaaagccgggctgtgagcattagtatcattgagcctggggaggaaggacctactgccggtgaaggatttgacaaagtgagggaggcagaggattctccccagcatatgtag

SEQ ID NO: 13794 - DNA, 3633 bp, Artificial Sequence
  Description of Artificial Sequence: Synthetic coding sequence
atggcagcccagtccagtctgtataacgatgaccgcaacctgctacggattcgcgaaaaggaacgacgtaatcaggaagctcatcaggaaaaggaagccttcccggaaaagatccccttgttcggagagccatataaaaccgccaaaggcgacgagctgagctcccggattcagaacatgctgggcaactacgaagaagtgaaagaattcctcagcaccaaatcacacacacatcggctcgatgctagcgaaaatcggttaggaaaaccaaaatatcccctgatccccgataaaggaagcagcatcccctcgtcatcctttcacaccagtgtgcaccatcagtccatccacacgcctgcaagcggccctctttctgtgggaaatatttcccataatcctaagatggctcagccccgtactgaaccaatgccttcccttcatgccaaatcctgtggcccccctgacagtcagcacttgacgcaggaccgtcttggccaggagggctttgggtcatcccaccacaaaaagggagatcggcgggcggacggagaccactgcgccagcgtgaccgactctgccccagaacgggagttgtcacccttgattagtctcccgtctcctgtaccgcctctcagccccatacactctaatcaacaaactctgccaaggacgcaaggctcaagcaaggtccacggcagctcaaataacagcaagggctattgtcccgctaaaagcccaaaagatttagctgtgaaggtgcacgataaagagactccccaggattccctggtggcacccgcacagcccccgagtcagacttttccccctccaagcctcccctccaagtcagtggccatgcagcagaagccaaccgcctacgtaagaccaatggacgggcaagatcaagcaccttcagagagtcccgaattgaagccactgccagaagattatcgccaacagacgttcgaaaaaaccgatctcaaagtgccagccaaggcgaaactgaccaagttgaagatgccctctcaatctgtcgaacagacttacagcaacgaggtgcattgcgttgaggagatcctgaaggaaatgactcatagctggccgcctcccctgacagctattcatactccgtccacagctgaaccatccaagttcccctttccaaccaaggactctcagcatgtgagctctgtcactcagaatcagaagcagtatgacacgtcttctaagacacatagtaatagccagcaaggaactagtagtatgttggaagatgacctgcagctcagcgattccgaggatagcgactccgaacaaactccagagaagccaccatcttcctcagctccaccaagtgcgcctcagagcctgccagagcccgtggcaagcgcacattcaagttcggccgagtccgagtccacttcagactcagatagcagctcagactcagaaagcgagtcttcatccagcgattcagaagaaaacgagccactcgagactccagccccggagcctgagcctcctacgaccaacaagtggcagctggataactggctgaccaaggtgagccagccggctgctccacccgaggggccacggtcaactgaacccccgagaagacatccagaaagcaagggctctagtgactctgccacctcacaggagcacagtgaaagtaaagaccccccccccaagtccagctctaaggctcctcgagcccctccagaggcaccccatccaggaaagaggtcctgccagaagagcccggctcagcaggaacctccacagagacagacggtgggcactaaacaaccgaaaaaaccagtcaaggccagtgcccgcgccggcagtaggacttctctgcagggtgagagagagcctggcctgcttccttatggcagccgagatcaaacctctaaggacaagcctaaagtgaagaccaagggcagaccgagggcagctgcaagtaacgaacctaagccagcagtacccccctcaagcgagaagaaaaagcacaaatcttccctgcccgcgccaagtaaagcccttagcggaccagaacccgccaaggacaatgtggaggatcgcaccccagagcatttcgccttggtgcctttaacagagtcacaaggtcccccgcacagcggttccggctctcgcacaagcggctgtcgccaggcagtagttgtccaggaagactcgcgaaaagatcgactccctctgcccttgagagataccaaactgctcagccctcttagggacacaccaccaccgcagtccttaatggtcaaaataaccctggatctgctcagccggattccacaacctcccggaaaaggttcacggcagaggaaagccgaggataaacagccccctgcggggaaaaagcatagtagcgaaaagaggtccagcgactcgagtagcaagctggccaagaaaaggaagggagaagccgagagggactgtgacaataaaaaaatccggctggagaaagagatcaaatcacagtcctcatcttcttcctcaagccataaggagagctctaagactaagccaagtagaccttcttctcaaagtagcaagaaagaaatgctccctcctcctccagtaagctcaagctcccagaagcccgctaaacctgcgctcaaacgcagtcgccgagaagctgatacgtgtggccaggaccccccgaagtccgctagttctaccaagagtaatcataaagactccagcatccccaaacagaggagggtcgaaggcaaaggatcacgctcttcaagcgagcacaagggctcctcgggagacacagctaatccatttccagtcccaagcctgccaaatggtaactcaaaaccaggcaagcctcaggtcaaattcgataaacagcaggcagatctgcacatgcgtgaggccaaaaagatgaagcagaaggctgagctcatgaccgatagagtgggaaaagcttttaagtatctggaagcagttttatcctttatagagtgcggtatagccaccgagagcgaatcccagtcctctaagtccgcttactctgtctatagcgagaccgtggatttgattaagttcattatgtccctcaaatccttctccgatgcaacagcacccactcaagaaaagatttttgccgtcctgtgtatgcgctgccagagtatacttaacatggccatgttccgctgtaaaaaggacattgcaataaaatactcaaggacacttaacaagcattttgagtcatcatcaaaggtagcccaggctcctagtccgtgcatcgcttctactggcaccccttcgccattgtctccaatgccttctcctgcctcctcggtgggatcgcagtcatccgccggcagtgtgggttcctcaggagtggccgcaacaatttcaacccccgtgaccattcagaacatgacctctagctacgtcaccatcacatcacacgttctgacagcttttgatctgtgggagcaagcggaggcattgactagaaaaaataaggagttctttgcccgactcagcactaacgtttgcacgctcgccctaaacagtagcctggttgatctcgtgcactacacacgtcagggctttcaacagctgcaggagttaaccaagaccccctag

SEQ ID NO: 13795 - DNA, 1266 bp, Artificial Sequence
  Description of Artificial Sequence: Synthetic coding sequence
atggcctttaccgagcgggtcaattcctccgggaattctttatataatgacgatcgaaatctcctgcgtatacgtgagaaggagcgccggaaccaggaagctcatcaggagaaagaggccttccccgagaagattcctcttttcggagaaccctataaaacagccaaaggtgatgagttgtcgagtaggattcagaatatgctgggaaactatgaagaagtgaaagaatttctttcgacaaaatctcacacccatcgtttagacgcttctgagaataggttggggaaacccaagtatccactgatccctgataaaggtagctctattccttcaagctcatttcacacttccgtccaccatcagagtattcacacgcccgcctctggcccacttagtgtaggcaacatctcacacaatcctaaaatggcgcagcctcggaccgaacctatgccaagtttgcatgccaaatcatgcggccctcctgactcacagcacttgacccaagatcggttaggccaggagggcttcggcagttctcaccataaaaaaggcgacagaagggctgacggcgaccactgtgcctcggttacagactccgcgcccgagcgcgaactctcccccctgatctcacttccatctcccgtccccccattgtccccaatccactcaaatcagcagaccctcccccgcacccagggatcaagtaaagtgcatggttctagcaacaattccaagggctattgcccagctaaatcacccaaagatcttgccgtcaaagttcatgacaaagagactccccaggatagtctggtggccccagcccaaccgccaagtcagactttccccccgccgagcctcccgagcaaatccgtggccatgcagcagaagcctacagcttacgtccggcccatggacggacaggatcaggcaccttccgaaagcccagaactcaaaccacttccagaggattacagacagcagacttttgaaaagaccgacctcaaagtccccgcaaaagccaaactgacaaagcttaaaatgccttctcagagcgtggaacagacatactcaaacgaagtgcactgtgtggaagaaatcctcaaggactctcagcacgtgtcttccgtaacacagaatcagaaacagtatgatacctctagcaaaactcattccaattctcaacaggggacctcttcaatgctcgaggacgatctccaacttagcgattccgaggacagtgacagcgagcagacacctgcaccatag

SEQ ID NO: 13796 - DNA, 3657 bp, Artificial Sequence
  Description of Artificial Sequence: Synthetic coding sequence
atggctttcacggagagagttaattccagcggaaacagcctgtacaatgacgatagaaatctccttagaatcagagaaaaggagcgccggaaccaagaggcccaccaagaaaaagaagcgtttccagagaagattccactcttcggtgagccttacaagactgccaaaggagatgagctcagctcacgtattcagaacatgctcggcaactacgaggaggtgaaggagttcttgagtaccaagtcccatacccaccgccttgatgcgagtgagaatcggctggggaaaccaaagtatccactcattccagacaaaggaagcagcattccctctagctcgttccatacctcagtccatcaccagtccattcacacaccagcctctggaccactgagcgtaggaaacattagtcacaacccgaaaatggcccagccacgcactgagcctatgccaagcctgcacgctaagtcctgtgggccaccagactcccagcacctgacgcaggaccgcctcggacaagagggctttgggtcatcccaccacaaaaagggggaccggcgtgcagacggggaccactgcgcttccgtcacggactcagcacccgagcgggagctgtctccgctcatttcgctaccttcacccgtgcctcccctgtctccaattcattcgaaccagcaaaccttaccacgcacacaaggttcgtctaaagttcatggcagcagcaataacagcaaagggtattgtcccgctaaatctcccaaagacttggccgtcaaggtacatgacaaggagacaccccaggactcccttgtcgccccggcccaacccccgagtcagacattccctccaccatcccttccaagcaaatcagtggctatgcagcagaagcccacagcttatgttaggccaatggatgggcaggatcaggcccccagtgagtctcccgaactgaagcccctgccggaggactatagacaacagacgtttgagaagacagatcttaaggtgcccgcaaaagccaaactgaccaagctgaagatgccatctcaatccgttgaacagacatacagtaatgaggtgcactgcgtggaagagattttgaaagaaatgactcatagctggccacctccactgacagccattcacaccccaagtactgccgagccttctaagtttccctttcctacaaaagattcacagcatgtgtcttcagttacgcagaatcagaagcaatatgacacatcctccaaaactcactccaacagtcagcagggtactagtagcatgctggaggacgacctacagctttcagatagcgaggactcagactctgagcaaacacccgagaagcctccctctagctccgctccgccttctgccccccagtccctcccagagcccgttgcctccgcccactcttctagtgcagagagcgaaagtacctcagattccgactcatcttcagactcagagtcagagtcctcttcatctgactctgaagaaaatgagccactggagacaccagcacccgaacctgaacctccaaccacaaacaagtggcaacttgataactggctgacaaaggtttcccaacccgcagctcccccagagggtccacgttccaccgagccacccaggcgccatcccgaaagcaagggctcctccgattccgcgacaagccaggaacatagtgagagcaaggatcctcctcctaaatcctcatccaaggccccaagagccccgcccgaagctccccacccagggaagcgaagctgccaaaaatctccagcccagcaagagcctccacagcgacagaccgtgggcactaagcagcccaagaagcccgttaaggcctctgcaagggccggatcacgcacctcgcttcagggggaaagagaaccaggactcttaccatatggttccagggaccaaacatccaaggacaagcccaaagtcaagactaaggggcgacctcgcgccgctgcgtcaaatgagcctaaacccgctgtgcctccaagctccgaaaaaaaaaaacacaagtccagcctgcccgctccttccaaggcgctaagcggacccgaacccgcaaaagacaacgtggaagatcgcacgcccgaacactttgcccttgtacccctcaccgagtcccagggcccacctcactcgggatctggctcccggacgtctggctgcaggcaggccgtggtagtacaagaggacagccggaaagatcggctgcctctgcctcttcgagacaccaagttgctttcccccctccgcgacactccgcctccgcaaagcctgatggtcaagattacccttgatctgctgagtcgtatacctcaacctcctgggaaggggagcagacaaaggaaagctgaggacaagcagccacccgcaggtaagaaacattcgagtgagaagaggtcttccgatagttcgtctaagttggccaagaaaaggaagggcgaggcagagcgcgactgtgacaataagaagatcagactggagaaagagatcaagtcccagagtagctcttcctcctcatcccacaaggagtcgtctaagacaaagcctagccgtccctcctcacagtctagcaagaaggagatgctgccccctccccctgtaagctcttcctcccagaagccagcaaagccagccctgaaacgcagcagacgcgaggccgacacatgcggacaggacccccctaagagcgcctcatccaccaaatctaaccacaaggattcatctatccccaagcagaggcgcgtcgagggaaagggtagcaggtcttcctctgagcacaagggctcatctggcgacacagcaaacccttttcctgtgccgtctctccccaatggtaactctaaacctggcaagccccaagtgaaattcgataagcaacaggccgatctgcatatgcgggaagctaagaagatgaaacagaaggcagaactgatgacagatagggtggggaaggcatttaagtaccttgaggcagtgttatccttcatcgagtgtggcattgcgactgagtcagagagccagtcgagcaaatccgcctacagtgtctactcagagaccgtggacctcattaagtttatcatgagccttaagtccttcagcgatgctacagccccgactcaagagaaaattttcgcggtcctctgtatgcgatgtcagtctattctgaacatggccatgtttaggtgtaagaaagacattgccatcaaatattcccggaccctaaacaaacactttgagagtagcagcaaagtcgcccaagccccgtctccttgcattgcaaggtcaacaggtactccctcacctctgtcccccatgcctagccctgcctcctcggttggctcgcagtcatctgctgggagtgtcggtagcagcggtgttgccgcaacaattagtactcctgtcacaatacaaaacatgactagctcctatgttactatcaccagccatgtcctgactgcgttcgatctatgggagcaggcggaggcgttgacccggaaaaataaggagttctttgccagactgagtaccaatgtttgcaccctagccctcaattcttccctcgtggatctggtacattacacacgccaggggtttcaacagctccaagagctgaccaaaactccttag

SEQ ID NO: 13797 - DNA, 1221 bp, Artificial Sequence
  Description of Artificial Sequence: Synthetic coding sequence
atggcattcaccgaacgggttaatagtagcggtaatagtctctataacgacgatcggaatctactgcggattagagagaaggagagacgcaaccaggaggcacaccaggagaaggaggcctttccagagaagatccccctgttcggggagccctataagaccgcaaagggcgatgagctgtcaagtagaattcagaatatgttaggtaattacgaagaggttaaagaattcctgagtaccaagtctcatacccaccggttggatgcctccgaaaaccgattggggaagccaaagtaccctctcatcccggacaaaggaagtagcattcctagctcttcattccatacttctgtgcaccaccagtctatacacacacccgcctcaggtcctctgtcagtcgggaatatctcccataaccccaagatggctcagcccaggactgaaccaatgcccagcctgcatgctaaaagttgcggcccaccagattcacagcacttgactcaggatcgcctgggccaggagggattcggttcatctcatcataaaaagggggataggcgcgctgacggagatcattgtgcctcagtgaccgactctgcccccgagcgggaacttagccccttaatcagtttgccttcccccgtgcccccactctcccccatacactctaaccagcagaccctgccaagaactcaaggcagcagcaaggtacatggcagttctaacaacagcaagggttactgcccagctaagtccccaaaagacctggctgtgaaggttcatgacaaagaaactccccaggacagtcttgtggcgcccgcacagcccccgtcacagacatttcctccaccctcactaccctctaagagcgttgctatgcagcagaagcctacagcgtacgtgaggcctatggacggacaggaccaggccccttccgaaagtccagaactgaaacctttgcctgaggactacaggcagcaaactttcgaaaagactgatctaaaagtacctgcaaaagccaaattgacaaagctgaagatgccctctcaatccgtagaaacctacagtaatgaagtccattgtgtcgaggaaatacttaaagagatgactcactcatggccaccacccctcaccgcgatccatactccctctacggccgaacctagcaagtttcctttccccaccaaggattcacagcacgtttcaagtgtgactcaatag

SEQ ID NO: 13798 - DNA, 1473 bp, Artificial Sequence
  Description of Artificial Sequence: Synthetic coding sequence
atgccaagtcagtcagtagagcaaacctactcaaatgaagtccattgcgtggaggaaattcttaaggaaatgacgcacagctggccccctccgctcacagccattcatacaccctctacagccgagccctccaagtttcctttccccactaaagattcacagcatgtgagctccgtgacgcaaaaccagaagcagtacgacaccagcagtaagacccactcgaactcccagcaggggaccagttctatgttagaagacgacctccagctgtccgattcagaagattccgacagcgaacagactccagagaaaccaccgcatctgcaccttcaggtactgcatagcccttttcagaaccagtggcaccagcacatccccgcggttcaaagtcagaaggcccctgtgactcaaacggtgccacagacgcaaagagcccgggcggtgcaggacagcgaagaaaatgagcccctcgagacacccgctcctgagccagaaccaccaactactaataagtggcagctagataattggctcacaaaagtgagccaacctgcagcaccacccgaaggcccgcgatccactgaaccacccagacggcacccagaaagtaagggaagcagtgattctgccactagccaggagcattccgaaagtaaggaccccccgccaaagtcgagctcaaaggcaccaagggcaccccccgaggcgccgcatcccgggaaacgatcctgccaaaaaagccctgcacagcaggagccgccgcagagacagacggtaggcacaaagcaacctaaaaaaccggttaaagcctccgctcgggctggtagtcgaacttcactgcagggggaacgggaacccgggctcctgccatacgggtcaagggatcagactagcaaggacaagcccaaggttaagacaaagggaagaccacgggcggctgcgtcaaatgagcccaagcctgcagtgccaccttcaagcgaaaagaagaagcacaaatctagcctgccagctccctccaaagcactgagtggcccagagccagccaaggataacgtggaggataggaccccggagcatttcgctttggtaccactgacagagtctcagggccccccccacagtgggtccggcagccgcacatccggttgccggcaagcggtggtggtccaggaagacagcaggaaggatagacttccactccccctgagggataccaagctgctcagcccccttagggataccccaccgcctcagtctttgatggttaaaatcacattggacctccttagccgcatcccacagcctccaggaaagggctctaggcaacggaaggcagaggacaaacagccgcctgcagggaaaaaacatagttccgagaaaaggtctagcgattcgtcctccaaattggccaaaaaaaggaaaggcgaggctgaacgcgactgtgataacaagaagattagactcgagaaatag

SEQ ID NO: 13799 - DNA, 2550 bp, Artificial Sequence
  Description of Artificial Sequence: Synthetic coding sequence
atgacacattcttggccgccacccttgactgccatccataccccgagcaccgctgaaccttccaagtttcccttcccaacaaaggatagccagcatgtaagctcagtgacacaaaaccagaagcagtatgacacaagctccaaaacccatagtaattcacagcagggcactagctcaatgctggaggacgacctgcagttgtcggattcggaggatagcgactccgagcagacccctgagaaacccccatcgtccagtgctccaccttcggctcctcagtctctgcccgagcctgtggctagcgcccactcttctagcgctgagtctgagagcacctccgactctgactccagttctgatagcgaatctgaaagtagtagttctgactcagaagagaatgaaccgctagaaacgcccgcacctgaacctgagccacccaccacaaataagtggcaattggacaactggctaactaaagtctcccagcctgccgccccacctgagggaccacggagcaccgaaccgcctcgccggcaccccgagtctaagggatctagtgatagcgctacatctcaggagcactctgaatccaaggacccacctccaaagtccagttcaaaggctccacgtgcccctcctgaggccccacacccggggaagaggagctgtcagaaatctcccgcccagcaggagcccccacagagacagacggtcggtactaagcagcccaagaaaccagtaaaagctagtgcccgagcgggcagtcgaaccagcctacagggggagagggaacctggcctgcttccctatggttccagggaccagacatcaaaggacaagccgaaggtcaagactaagggacgacccagagctgctgcttcaaacgagcctaaacctgccgttccgccgtctagcgagaagaagaaacataagtcttccctgccggcaccgtccaaggccttgtctggacctgaaccagcgaaagataatgtagaggacagaaccccagaacattttgcgctggtgcccctcacagagtcacagggacctcctcattccgggagtggaagccggacatctggctgccgccaggccgtggttgtacaggaagacagcaggaaggatcgtctgccgctgcccttgcgtgacacaaaactgctttccccattgcgggacacaccacccccacagtccctcatggtaaagatcactctggatctgctgagcagaataccccaacctccaggtaagggatcccggcaacggaaggcagaggataagcagccccccgccggtaagaaacatagtagcgaaaaaaggtcctctgactcatcttctaaactcgcaaagaagaggaaaggggaagccgagcgggattgcgacaataagaaaatacgccttgagaaggagatcaagtctcagtcgtcgagttccagttcttcacataaggagtcctctaaaaccaagccttctcgtccttcctcccaatcgtctaaaaaggagatgcttccgcctcctcctgtttcctcctcatctcagaaacctgctaaaccagctcttaaacgatctcgccgtgaagccgacacgtgtggtcaggatcccccgaagtctgcaagctccacgaagagcaaccacaaagactctagcataccaaagcagcggagggtggaggggaagggaagccgctcttctagcgagcacaaaggcagcagtggcgatactgccaatccttttccagtaccctctctgcccaatggtaactccaaacccggtaaaccccaagtgaaatttgacaagcagcaggcagacctccatatgcgagaagcaaagaaaatgaagcaaaaggccgaacttatgaccgacagggttggcaaagcatttaagtacctcgaagctgtgctatcctttattgaatgcggtattgccaccgaatcggaaagtcagtcgagcaagtccgcatactcggtctacagcgagaccgtggacctgataaagtttatcatgagcctgaagagcttctctgatgcgactgctccgactcaggagaaaatctttgccgtgctatgtatgcgttgtcaatctatcctgaatatggctatgtttcgatgtaagaaagatattgctattaagtattccagaaccttgaataagcacttcgaatcttcctcgaaggtggctcaggctccttccccctgcattgcgaggtcgacaggcactccttcccctctcagtcccatgccatccccagcgtcctctgttggttcccagtctagcgccggatccgtgggatcttccggggtggccgctactattagtacaccagtgactatccagaatatgacctctagctacgttaccattacatcgcacgtactcacagcttttgatctttgggagcaggccgaggccctcactcgtaagaacaaagagtttttcgctcggctttccacaaatgtatgcacactggcattgaacagcagtctggtggatctcgttcattatacaaggcaagggtttcagcagctgcaagagctcaccaagacgccatag

SEQ ID NO: 13800 - DNA, 2376 bp, Artificial Sequence
  Description of Artificial Sequence: Synthetic coding sequence
atgcctgacatgcatttcaaggcacctaaaataagtatgcccgatgtggaccttcacctgaaaggtccgaaagtgaagggagatgtggacgttagtgtccctaagctggagggagatctgaccggcccatctgtgggagttgaggtccctgacgttgaactagagtgccctgatgctaaactcaagggtcccaaatttaaaatgccagaaatgcattttaaaacgcccaagattagtatgccagatgtggacctccatttgaaggggcccaaggtcaagggcgatatggacgttagcgtcccaaaagtcgaaggcgagatgaaagtacccgatgtggatataaagggccctaaaatggacatagacgcaccagacgtcgatgtgcacggtcctgattggcatctgaagatgcccaaaatgaaaatgccgaagttttctatgccggggtttaaggcagaggggcccgaagtcgacgtgaacctgccgaaggccgacgttgttgtgtctggcccgaaagtcgatgtggaggtcccggatgtttcgcttgaagggcctgaaggcaaactgaagggacctaagctcaaaatgccggaaatgcattttaaagctcccaagatctctatgcctgacgtggatctgcatctaaaagggcctaaagtgaagggagatgtggacgtgagcctacctaagctggagggcgaccttactggcccctctgtagatgtggaagtgcccgacgtggaactcgaatgccccgacgccaagctcaagggacctaagttcaagatgccagagatgcacttcaagactccgaaaatcagcatgcctgatgttaacttgaatctcaagggacccaaggtcaaaggcgacatggacgtcagtgtgcctaaggtggaaggtgaaatgaaagtcccagatgtggatatccgtggaccaaaagtggacatcgacgcgccagacgtcgacgtccacgggcctgactggcacctgaagatgccaaaaatgaaaatgcccaagttcagcatgcctgggtttaaaggggaaggccccgaagtggacgtaaatctcccgaaggctgatgtagatgttagcggtcctaaggtggatgtagaagtgcctgacgttagcttagagggtccagaaggcaagttaaaaggtccgaaattcaagatgccagaaatgcacttcaaaactcccaaaatcagcatgcccgacgtggacttcaacctgaagggtccgaagatcaagggggacgtggatgtttccgcccccaagttggagggggagctgaagggcccagagctcgatgtgaagggaccgaaactcgatgccgatatgcccgaagtggcagtagagggtcctaacgggaagtggaaaacccccaagtttaaaatgccagacatgcacttcaaagcccccaagataagtatgccagacttagatctgcatttaaagtctccaaaggccaagggggaggtggacgtcgatgtgccgaagctggaaggggacttgaaaggacctcatgtcgacgtcagtgggcctgacattgatatcgaggggcctgaaggcaagctgaagggcccaaaatttaagatgccggatatgcacttcaaagcccctaatatcagcatgcctgacgtggatctaaaccttaaggggcccaaaatcaaaggggacgtggatgttagcgtgcctgaagtcgaaggcaaactggaagtgccagacatgaacatccgagggcccaaagtggatgtcaatgctccagacgtgcaggccccggattggcatctcaaaatgccgaaaatgaaaatgcctaagttctctatgcctgggttcaaagctgagggcccagaagtggacgtgaatttgcctaaagccgacgtcgacatctctgggcctaaagttgatatcgaagggccagatgtgaatattgagggtccagaagggaaactcaagggccccaaactcaaaatgcctgaaatgaatataaaggccccaaagatatccatgcccgactttgacctgcacctcaaaggcccaaaagtgaagggcgacgttgatgtgagcctccccaaagtcgaaggggatttgaagggcccagaggtggacattaaaggaccaaaggttgacataaacgcccccgatgttggtgtacagggccctgattggcatcttaagatgcccaaggtgaagatgccaaaattctccatgcctgggttcaaaggtgaaggccccgatggagatgtcaagctcccaaaagctgatattgacgtgtctggaccaaaggtagatattgaggggccagacgtgaatatagagggaccagaggggaagctgaaaggacccaagtttaagatggcccaaaggtggtggtag

SEQ ID NO: 13801 - DNA, 450 bp, Artificial Sequence
  Description of Artificial Sequence: Synthetic coding sequence
atggagaaggaggagaccacccgggagctgctcctgccaaattggcaagggagcggatcacacggactcacaatcgcacaaagggacgatggggtgttcgtgcaggaggtcactcagaattcacccgcggcgcgaaccggcgtagtgaaggaaggcgaccaaatcgttggcgcaaccatctacttcgataatttgcagagtggggaagtgacacagctcctaaacacaatgggacatcacacagttggactgaagctgcaccgcaagggggaccgatcccctgagcctgggcagacatggacgcgcgaggtcttttccagctgcagtagtgaagtagttctgaatactccgcagccatccgccctggagtgcaaggaccagaacaagcagaaagaggctagttcacaagctggcgccgtgtccgtgtcaacaccgaatgccggcctgtag
